United States Patent 9,976,180 (METHODS FOR DETECTING A GENETIC VARIATION IN SUBJECTS WITH PARKINSONISM) - sequence listing, part 42

SEQ ID NO: 559 - DNA, 292459 bp, Homo sapiens
agaaacgcttttctgcggtccagtctagggggtctcagattggcggggatgggcagcagcggcaggtggccttggcttttgctgcagccgtcaacgacctatcatcggggtcctgcgtaaggtccggctggctgggacttggctgtgggtgggatggactggctgccggaccgagtgccctgcagttggtaggagtatgaggcagagtgatgcacacccgggcgcccagcatcgttctaattgccggagacattgcctcagactgtgcgctgctagaggctgcgttcctgagcaggaagcccgtttcctgggattggaactacccttcttggccagcgggaagtccccaaggacggagtcgaaaggtcaaatcttatctgtcagtgctgtgtgacagcatcgcaacgggatctgcagaacctgaactcggtatcaaatctattgggagggaggggaacgtgtccgggcaggcgctggggtcgggtggcaaaactggggtgaatttgtagaatttgggaaagggtcattgacatcttaaaataggtggtcgtttggagcaagaatgctcgaaaggggtgagggtaggttaggctctctagtgctgggggaaaacaaaatgtggaaggattggtggaaaccagacctttaagatttatattatgatttgagatttatatgattccatctaggccagatttaaaaaaatatttgacatccccatttctggaatgtaggagataaaggcactaagacgaaggaaatggtagttgtgctgtgtgtattacactgaagaacaaatatttgcaggataaaattaatttggacatttggctggacactgctcggtatgggtccagtttagttggacctcgagcagaagactggctgttgccctgttgtgtaccacaatctttggtttccagtgctgtgttgaaaagagcactaggcttagaatcagaaaactcaggcttaagtgttgactcttccactcataatgtttgaacgagacatgtcacttaaaattctgtctcagattcctcatcactgaaatggagctaataatgtgcactttacaagattgttcttaggattatatatcacgaaagtgtttccaagctctaaaattctacataaatgtaaaatgcatgttgcttgtaccattggttttgggactagtcttataaatttcttaatgatatatggtgttttatctccttcctagaagagatggaaagattctgaagggcagaaacagtttttcttttgtatcttccttccatatgacaaaaagctaagcatgcagaagggactcgatacatgcttgatgaatgaatgaaatgtgaaagaccgtacagtttgagaatcatactgagaataataaatcagaagagggagagagatctcaaaattaaatatttgttggatatatacatgtaaatacatatgtccagtcttctttaagttcaaaaaaatacatatataatgtgtgtatatttatctatgcagtatattatatataaatagagagtgggagagagacctcgagaatggaatacatccctttttcttgggaagaagcaatgtggtgtttttctgttcccaattaaaccactcttctataagtatatcatttaggtgatagaagtaacattgtttaaattaacattcaagttatgaacacacactggtaaaaattctcttaggaatgccttaagacagcaaaggaaaaatttttacctgttggcaatatttattttaaaaagccatataccaaagtataaaatcattactatggtgaatggcgttatataacttagaataaagattttacaattttttttcagtttcagtctttgctaactttagtagatgctaatcagtatactttagctgttaaaggtgattgtactttttcttcttttaaatcaagatttttctttgaagagaaaatcgaacattagaggcactattgacagcaaatggaaacagggattcaagagctaatatatctcttctcttacatttctattcttttgtattgccttatttaggaaattttttattttcttatttgagaactatgaaagaatcccagagtagaaatcagcttaagggaatagtgaaagaaatttaaataatcgattgctcaagggtataattattttgattgctcagaattttgctctatatgtttaatgtgttaaatgtaattaactgccagccaaataatgcttattgcatttaagatgtgaaaaatgtccttttctaatgcagtattttttattgtctcacaatgatctaagtgcctagtacataataggtactcaacgtgtttctagtcaatgatttaatgatctgacaagttaattttggacgaacattcagaaattgagtattttttagtgggcacataaattacttctctaccttattaggtagttaaatctttataaagctttaagagaaatttttgtgtgtatgtggagaaatctgtctttaattatcttttaattagaaaactcattatttcacttccttgcaaattctaaatttttaatgttaatcatgatacttaattcatcttaggtaatattattttccttattttaatttttcaaatgagtgcttaccctgatataaaagatttataaggttttaagacattttacttgttgtgcaaataacctggtttggttcaatactgaagcaggaccgaatctgaattttctcaaggttaatgctgtatatgtagttccttattttctgtgatgatgcaaacagccaaggatcttttcagttagaagggactttagtaaggctataataggtctttcttttcagacattttaaaccaaggattctaacatgtgcttctcttctccaaacttgccactaaatacttaaacaacaaagacattgaatcctggctgggcgtggtggctcatgcctgtaatcccagcactttgggaagccaagacgggcagatcacttgaggtgaggagttcaagaccagcctagccaacatggggaaaccctgtctctactaaaaatacaaaaaattagctgggggtggtggtgcacacctgtagtcccagttacttgggagggtgaggtgggagaattgcttgaacctaggaggcggagatggcagtgagctgagatcgtgccattgcactccagcctggttgacagagcaagacacttcatctcaaaaaaaaaaaaaaaagaaaaaagacgttgaatcctgcaacgtgacattatttatttttattatttgaaatagaagtgcaaaatcaatgttaatcaaatatgtaaaatgtattataaatataaataagtgaatttcagttctggtaaggatgctttaataccagggttctctggcaacataattactgaaatataaaaagatgtttagcatgttgtccatagactatcttatgatttaatactcctatgaatatctacatcaactggttctgtgttaaactttaaaacatgaaccttcagaatttcattttttctttgtttcaagtttttcctttacataattttatgattacacattaaagtggaatagatagggtgaactctctactgaaacttatcaactaaaaacctgtaagccaaaaaaaaaaaaatcagggaaaaaaatctctaaatacgttgaatttatttgggaattagaaaagaggattataacctgagatgcacagctgtggcaagctacatatacatcaaagaagggaggataaagggaaatgtttttctttttttctttttttttttgagacagagtctcactctgtcgccaggctagagtgcagtggcacaatctcagctcactgcaacctccgactccctggttcaagcattctcctgcgtcagcctccgaagtagctgggattacaggcgcacaccaccatgcccagctaatttttatatttttagtagagacggggtttcaccatgttggccaggatggtcttgatctcctgaccttgtctgcccgccttgggctcccgaagtgctgggattacaggtgtgagccactgtgcctggccaaagggaaacttttatttggcaaaaggagaagttcacataaactgcttggaaacagacattggttttggatactcaaagtcagagttggcaccattttagaggaagagatgctgttactgggcaggtattgttttgagagcattttatctgaattgctgcagtcctacagaatttcttattttagaaagtccttgagacaggacttccaaaaatgtcttttatctcgtccatgcaatcatgaaccctactcctttgtgctctcctggctctagtttgtgtttgacaaacagtgatttcatcctggtatctgcaactttcataaacctttatttatatattagtacttcaaagattaaaaaaaattgtaaatctcttgcctcaagaaaaagatttagtgccaaagaataagtcttatttttaaaatattgtgaatgagacttgtttcatttgatttttttaatggcttatgatgatataaaatgaaagctatggactttaaaacatatttatcctgtattctttcttagcactggtgtcttttattaatgctaacagtcgttttaaggttgcatctcttatcacactgtataatatttgaggtaatgataatttacatcttcttttctaatatttctgtcacctattttatcttgtgtttgctagaattgtgaaaagagtgttgaaaaattgagtgctgggctcttctgctttgttcctatttcaatttcgttggtatttcaccagttgacattatattgactttcgctttatgacttttagaaatgactgctaaaattatcaaatgccttttatggggatctaatgataaaaatcatatagtttctatctttgaatttatgagtgtagtgaatatatatatttttctacactgaaacattcccacatttctagaataaactctatttggttgtgaaatattaccattttaattacttgctggatttgattagtttatattttgtttatatggtttcagaattttttttaaataattgccacaagatctcactctgttgcctaggctggagggcagtggtatgatcttggcttactgcagcctcgacctcccaggctcaagccatcctcccacctcagcctaccaagtagctgagaccacaggagtacgccactacccctagctaatttttgtattttttgtagagatggggttttgctctattgcccaggctggtcttgaactcctgagcacaagcaatctgccagcctcggcctctcacagtgctaggattataggtgtgaggcactgtgtgctgcctttacaaactttgttttgtagatacagtgtctccctatgttgcccaggctggtcttcaactcctggcctcaagcgattctccctccttggtctcccacatgatgagattacaggcatgagccccccccaccatacctggccataatttcagtttttaagtaagattggtccatagttttatttatttgtgctatctttatccagttttgatattagtgttagtctaactttgtaaatgaatttagatttccacctttttttctatgctctgcaatagtttaaatgatgaaaaattatcatgctatttggtttttgaaagttagagtgtgctgcaaaaccacctgggcttgctgatacttttagaggtagatctttgattattcttttcttctatgattattgatttgtttgattgtctttctcttcttgaatcaattttagaatttatggtttttagaaaatcatgcatctcatctacattgccaatttattggcaagaagttgcacaaaatattttcttataattattttagtatcttccatgaccatggacgtttttcttttctcattaccactattaactctttaagcaaaacattgaaatcaactttttcttccccaacctgattatcacaaattctagtagcatatcttaacttcttaaagaaaataagaagtcaactatctaagactcataggtttgataaaatttgaaagatcctgcaatccttataatttcctactgtttgtccttatcctgttcatattttattagtaatagcaaccacttaatacgtttattgtgtgtcagacacttggtaaataaaccctttacttgcattatttaattcccagagtagctctatagcctagaaattagtgttcccattttatgaatgagtaaactaaagctcagagaggttatataatttggccaatgatattcaatcagcaagtggcagaatgatgtgggaaccgagtatgtcagattctggggtttgtgcatttaatcaccactctctactttcggtatctttttcattattccaaattataatacttacttttttctaaaaattagtatataaccaagtatcaaaggcctaaataaacccatataacagcttgaaatgcgctgtaaattatgaacctaaaaaaaccttgttattgtaatgattttttaaaggatatttgttttttagatatttctgtgaactttccttaccttatctctgtattttgagactagacatagagcctgatttctaatatttagtctaacagaaaagatgtcactttttttgtatttagagagaccagtaggtgtcaactagtaattcaatttttaaaaaagattatgataaaatagacataataaagtcactatcttaaccattttgaagtgtacaattaagtagtactaagcacattgttgtacaactattaccaacatccatctccagacctcttttcatcttacaaaattaactctgtacccattaaacaataactccctgttccctgctccccagcccctggcaaccaccattttctacttaccacatgtaagtggaatcatgtggtgtttgcctatttttgactggtttatttaacttggcataatgtcctcagggttcatccatgctgtggcaggtgaatggatttccttcctttttaaagccgaataatattccattgtatgtatataccacattgtgggtatccattcatctgtcaatggacatttggtttggttctaccttttggctattgtgaataatactgctataaacatgggtgtagaactatctctttgaggtcctgtttttttatttatttatttatttatttatttatttatttatttatttattttgagacggggtctcactctgttgccagactggagtgcagtggtgcaatctcggctcactgcaacctctgcttcctgggttcaagtgattctcctgcctcagcctcccaagtagctgggactacaggtgcatgccaccatgcctggctaactttttgtatttttagtagagaaggggtttcaccatgttagccaggatggtcttgatctcctgacctcgtgatccgcctacctcggcctcccaaagtgctgggattacaggcgtgagccaccgcgcccggcccgaggtcctgttttataaaaaaaattactttacttttttaaatagattcagggtcttgttatgttgcccaggctggtctttaactcctgggctaaaacgatactcccacctcagcctcccaaagtgctaggattacaggcatgaaccaccgtgcttggccaagatcttgattttatacccagaagtggaattgcctgatgatatattaattctctttaattttttgaggaacgatttgcacttaattttaactaaacaatgcaataaaacaatgttctattgccttgggtcccagatttagtacatccctgaaagtcagggacacctaagataagataatcttgggatttatgtttggcatgaggtcctgggcgacaggggagtgggggagggccaaagttctgggatctagaacctactaaagttttccaccctagcccaccctgcctacctggcttccatagtttagaggatgcccattggtactgtggtttgagcagaatgacagaaaagctacaggacaggtcctaaataaatatggattctttcagactttgtagtgaatctgcattgttattatttagagaagcattaaggcataatgattaagaacatggattctggagcttgacttcttgggtttaacgctcagctcagcctttttttactacttgggcagttacttaaattatctgtgccacaatttccttatatgtaaagtagttattataataatatctacctcataggattattgggaggattaaatgaattaatacatgtaagtgcttagaaaaatacttgacatatagctctcactcaatgttagtaataatgataatattattttttagaaacagggtcttgctatgttgcccaggctggagtgtagtggtgtgatcatggctcgctgcagcctctacttcctgggctgaagcagtcctcctgcctcagcctaccaaagtactgagattacaggcagtagccaccacgcctggccgaataatattattttaaattagcataggttatgatgtggctttccttttaaaatttattttattttatttttttaatttttaaatttatttatgtggctttccttaaaaaccaatacgaagagtaagattccattctgtgagttaaactttttggattgcttatactatgaataaaaaagatgtaacggcagtttaaagaaataggatttgctgtccgatcagcaggattagattatagcttgatgaattctaatctatttagtattatataaattggattgtagcttgatgaaacatagaaaacggatttctagtcacatagaaaatcgatgctatgacaggagctggtcatagaggtttgtgttgtctcttgttgcctagaccctcccaaacattgtccaggaatgagatgcctttgtgcataccccatccaccacttcattctaagcagatgtcagtcaccactactaaagcagaatctgatagcactaaacatttgagtcacataatggactcctctaatccataaggcaaccttatgataatttggcttgctatgtagcttatctacatggagaggctatgtaacctggatgacttgaatatatgcttgcatatccagttataagtcttactagaaatcagtacattagttttttgtctttacatgtcaatctcaagaggtttgttaatccaaacctgcttctgatgagtaaatccattctccctgtacttactaagtaggtagttgagcatataaagctaagacccccaaaccctggaccttggtagattcaccaagataatgtgtccgtctcttcagtctcattgttttcttgggatatatcccagtgccttttccagatcatcatattactagctaccttaatttacttctattttctttatttccattagttctatatgtgtggtggcagagatattcttccatatcaccattgccagttggctgaagaggggtggagcaacccaatttctctctctcaatccccggccagcctgatatgaccaagaatcactgcgtagtgagcaaggaaagctaatcactgcactgcaggatctcactttgtggaactattgctttgctatatgccttcttatagcagacggagctgaaaggaaccttaaagatgaactagcccacatttcttgttttacagatgaggaaacagattacttgccttggacagtatatctttatgctcttctaacagtcttttgtctaaggttggcctggacttacgacctgtgagtaatcttctttgtagccctagtcttatcgaaccagtacaaaagtttaactgccaaaggcactttctttcctatagttctgacaacttctccttttgttatataccactgatatccaggttcagttcatcatctatttcagaccatgtttctaattggattctctgtagcctggttcatgttgtagtctgccattttctggcaacaaattggatctattttaataatgatcagagatgctggatttgtcatgttgggatctttttaactcagtatcccaaattgtggacataggatttcatgaaataaaaataaacctcaacagtacttctttaaataatactcactatatacccagaataaaactatattccagtaattccattaaaatttgtatgctaacaataaaactttgttttaaaatttttattcatgtttattttaaccacaatactaattgctattcctaaaatatgtttttctttctcctcctcccttatggagtattaaatgttttaatgtcatggcaaactcttttattagcttaggattactttatatatatatataaagaaaaaaattaatagcaagttacgagaaaatgtacatttttcttgtaatgtatctttacatatttcaaagaggcaagtggcagcaaatgtgaaataagcataagcaaagtgctttcatttaagtgcttagaggattaatcaaggagcacttcctagaagtgtgttttgaagattttaagagaaggtacaaatattcactggtgacgaggatggagtcagaaagagggaagtaaaacacacattatgcattgggagctgcattagaaaggggaatggatgctaacaaaaagaaaaaacatctcttgcaggatggtgaagcaggctttcagctgggatggagaagggatgctgagttacaatcattggtgaagttattgagatgtcatttcagccttgctactcacattttgctgggtaatgtgctagatcctaagggaaaagctaaagagaagggagagacagtgcttgacctgtaggtacttatgatcttgctgatgagacaaggcaacaggaagttaaaggaggatccttgaaagccagtaagaggaacttggattttatacagtatgtgatgacaggagccattggaggttctcatgtatcatcttacctctatcatctgctcagaagggagaggtctgagctggggaagatcaaactgagcaggtggctaggttttaatctttatagctatatgtaatcagcagaagagctttttcccacacaaaactattttgaatcactttagaaaaaaatgagctgcctaaaatcttctgtccatgattaacaattaatagaaaatcactggtttgctcctgcaaacagcacttaatgtcagtagcttcaggctgtttttcaattttacagtaaattttttaccgaaacaaatttaggtagctattttgtccatgggcttttgtagtggaaagatgatgtgagtaaaatagaataatgagattccttttctgcatcaaaatattagcaagctgctaatggttccattttgatactgccactttcaaaataaaggagagagatcaagttgcttatggaaacattttggattatgtttaaaatagtgtaactttataatagttgatatggtaaataattcaaggtttgcttttagtgcatcagtttatctccatcttggctcagccctgagagagaaagtttccagatttttattgcctatctaataagtcccttggtaattggtttcatgctgtaggaatgtagattttatttcttccctttcttcttcttcttttcatctgcctccttgctacttgcaaactgttctgtgatttccactatctccactgaccttccagtgggaagccttccaaggtccttggtttcctggaatgacatttgaggcatatttaagtgccttacgatattcctgggtttatttgggttttggcccatatgcattggtggtaagtccctgagaggcactagcacaaaaacaacaggagccctgaggtctggaggtaggttgggttggagttgtccactcggcatttgaaaaaactgtccaggaaaggcattgtttaaggggtagctctctaaagcctcctgagcttttgtgtttggattcctttttgtctggagaagaacatcagtgaagtaaggttttacgcctgttatggcattgatttcatatgcgttgtgcctgtcagccagtgctctcccagttaaaatgggctgaaaaacatgtgatcctgagacaccacttataaagctgtggagaacagaatgccagatcccaccacttattggactcaaaacaacccgcggccataagctggccaggctccggagagcttcgcggttccatgctgaggcaggaaagtccatctcagtatgatagagctgagaaaaataaatactaagagtgatgcctggatacgtaatcaggaaattatacattttgctgatgcagcagtggttagcttcattacaaggggagttgttggaatacagaatgatatgcctgatgctgtcattattgtatatggctgagtcaagataaccattcatttcaaagagcattgattctggatggatataattcccagtgcaactgctagcatggcccttttgcaccaggctaccagaagaagtttttagttcataaaatgtgaggtgttttgtttgaggaaatgttgtcccataagggaatccaaaaatctgacaaaattctgtgagggaaactcttgcttcttcacctgttcgaatatggtaaggacaattagagcaatcgagagagaagcttagccagtaatatggttttactattgttccatgatttgctaggtactcctcatatatgggctccattgctagatttactgtcttctagctgcaaacctaaacaaggaagagaaattacatataaaaccagcgcaggaaaaactgaagacagtgcattaatttattaaaccatactttctttaaaggaagtagcacaataaagatagtgatatatgcatagatttaaaagctcaggattcattattctttattgagactcctagagcatggggaggaaacagaagagaaaggcgttcttcaactttacctgtttcatagattccaagtcagtaaagcaaatgagttaacaatgcaagttctagaaacagactgtctggttttaaatttgggcttggccaattatcagcttggtggcctttgacaagttatttaacatttgggagccacagattccttgtctgtaaaatgaagatattaatagtacttacctgataagattgtcttgagcattgaataacagaatgaatataaaatgcttcactaatgtgcttgtcacatagtaaggactcagtaaatattaactcttagtagtaaaagtacaaatcctagggttatctagattattcctaattataaaagtacaaaaaagtgttttgcattttgttcatgatctttcttctcagaatatgttaacatctaatgtattgtgcagaactattcagtgtgcttgcatttaacatcaactttcttaaaatcactggaaataatttggaggtttttgggttttttttgagactaggatcatgggatctcttttgcttaatgatagagacttcttaggaaagtgccacttgagtattctttggattgtggacactcattcattgacatgtaagagttttctttcccgtgagtgggtcttgttagaagacttttgaaaaattactgttacagaaagcaaatatggttctttagaatatttcaaattagtagtttctgggatgttaaactcaaaaagctgagatctttaagtaatgattttttcctttaaaaaatattccttcagttatcgttgttcctataatgctctaggagctacctattttgtttgtttttgagacagtcttgctctgttgctcagattgcagtgcagtgagatgatcatggctcactgtggccccaaccttccgggctcaagtgatcctcctgcctcagcctcccaaatagctgagaccacaggtatgtaccaccatgcccagataatttttttattttttaggagggatacagtctccctatgttgcccacactgatctcgaactcctgggctcaagtgatcctcctaccttggcctcccaaagtgctgggattacaggtgtgaaccaccatgtccagccttccgtcactattaacatgtctattccctccagtctttttgctatatgtgtatgttacatataatataaacaaagtcatgttttataccctgctttttcacttaatattgtgccatgagcattttcccatgttattaaaaataatattcggccaggcgtggtggctcacgcctataatcccagcactttgggaggccagggtgggcggatcatgaggtcaggagatggagacaatcctggctaacatggtgaaaccccgtctctactaaaaatgtaaaaaattagccaggtgtggtggcatgcgcctgtagtcccagttactcgggaggctgaggcaggagaatagcgtgaacccaggaggcagagcttgcagtgagccaacatcccaccactgcactccagcctgggtgacagagcgagactctgtctcaaaacgaaaaacaaaaaacacaatattcatggctaattagttttttattatgtaactgtaacattcagtttcttgcctcttttaattattataacactttgataaatatttctgtgagaaattatctattgcatatattatataatatttattataaagaatcagatttttttttttttttagaatagattactagaaatcatagtattaggtcaaacattgtcaaatcgcttcctaggaaggtgtaccaatcttatcacattctcttacaatgttgtttatcccaatttgagaagggagcattggtatttttttgttgctataatgtgtgcctttattatttctagtgaagttgaacactttttgacatgcttattggtctgtggtatttattcttctgtgaaatatatttgattttttacctattttttgcgtgaagttttccttattggtttgcaagacatttttatgcatcaagaatattaaatctgccacatttgctgctaatattttacctggtttatacagccttttaattatgccaatgttattttaattgcaccaaattttacatttttatgtggtccagtctctactcctgtgattttttttcttattgtatttagaaatgccttcctcatcaaagcataattaagtattccccatattttcttctagtatttatggtttcattttttacatttaactttgtcagataacaaaactgataaggcagaaaatttaaatgaggtaaactgaccattgcaacagaatatatttttcacttttcaaaatctcacttatcatatcacaagtatgaatacttgtgctaataaataaattatggcctctcatatggaagtgctatgttcaccttctgtcttcctcagcccacatcagctcattcattgctgtatttgatacagcttgatctctagcctgaaacctgcagagttcctatgctaatcctatcctgggcagaaaatatgttaaaagcctcaatccagctgtaggtggaatgtagctttattcatgtcaccattatcttagtggctaatatcctgcagtaactctggcaccacatacccaccagattctagatttctcctagcctctgctgtgtcatcttaatccataggattggacattagctttgttttttccttagtactatattttcctgatgtaactgaattcctgccttgaggcttcctagaccttgtcatagctttccttctagagagctggatttaacccttggcagtggacgatctcttggaacctgacgccatttcctgcttactcccgagcattgtttcctctctggacctcctccttgcttagccttcatcaggctggatggatctctccatcagaacttgccaaaaccaagcccaaactttcatgctttttaatattgtgcccttgatgtggtcgacttatgggtggtacaccggacatccaggttactgctcagattacaatttcaactcacccatagacaatttacagattgatttggctaaatgttatggaaacagaaccaaaaggcacttttctgtctttattactatttcttaaggtgatgtgtatgtggagttaactatatataatggtcccataattacccttttgggaaacaaaagtctttgtgtgtttttagataaaggtagcaaaatggaaactccctattgcttttctaagcacgccttcctttgcacccccatcttctgtggctgttttagccagaaatgatacatcattactgtctttaaggagatggagaggactgtggctttaacacatagtggagggagctctgtagtctcattcttgctgacaacttttcagtgtcaaccaactatagtttcctattggtgaagttttcactttttcagagtctttctgggcttgttctttgatcaccctcatctgaagaggaagcaggaaagaactgttgccctctttgaactcttagagaattcatggtttattgtatcaatttgttatcgaccacagattatcttgttaacttttggtatctgtcattttattctccccaaccaggtggaaatgtaccctgtttaggcccaggacctaccttagcaaccttgattggctcacaagccaggttgcttaagacttgtttccccagcagctggtgtccctacttcctgcctagcccttttccttttgctttgtctgtgcttgggaaatacatgttatactctgtagagcagatttgctggcagtaagaacagagatgtgtagagcccagcgtgctggagggctctctgcatctggctgtgagtggcccctggactgggaccgtgggaggacagctttccatagtttaacataaatgaaccacaccataaggacaatctgctctcatttcactcaactaggatttagtgagtactgttaaagcacagtttgcactggagtaattggagaatggagtttgcccttcacaatctgtgcacaatctgttagcagctaaaaacaaatgttagcagttataattaccatcaatttgtctccaggcttggatcacattccaggtgttagaagagatggtccatttccttttttttctcctttaagtcccatgccctgtttcaagtagcttcagaaggcaattgtgctgtaaagattcaccttgtaatgggttcaggactctttcacagtttgtgtctattcgttcatttgaactttgctgttccaagttagaaagcccttgctgaggtgtggctacctctaagaacactgttgattgggtgccatggtaacgtttgcaaagtagctactgctaggatacagctctgacacttattactttatttgcatatcaagccacctgttccaaagatgaaaatatacaggactgcatatcccagtctgggtaaaaggataatagctgactgttgaagagaacatgttgcagtttttctcctgctagctgaagaatcaagttctgagggcctgctcctcagcacctttctcctggtctagagtaggtgccaggcctggcggttctgttgcctgcgtgggtgccagggcttctccttgggaggcttgccctctgtgagagggagcagagagttgacttcctccaagaggcccatagtccctgaagggggtgtttttgattctgtctaaacctaggctatgtgttagcggtttccctcctcttagaaattgcctggaagactcttgctattggtatgtatgtggttccctccagtttaagacaagatttgttccaggatcggttgtagccccttctctgtggctaacggaagagccacttgtccttctccattcttttccttagtctcccttgacccccacatcatctcctagacacaaggcacattgatagtcacaattcactgtcaatcactctggattattccctcattcccctttcccaggccacctgaaggagtgagtggggattgctattgtgtacattccagtaataactattggctgtaagcagacatactctaaaaataactcagggatactgagcacccagagggcaccttctgtcttctcgaagcttcgccacgcctgtttccactgtcagacttccagtctgcaccacagcacacatcctttctcatccagagtgctcctactagacgagatgtttttgtctcctaagggcctcaggtgtattcatgaactcctcagctggttattttcagtttcatcttccttggtgcttgctctggcacatggtcactgctgcatcctgtcccttccccacagtttgccatgggtcatcccttttttctcattgcttgcatcttctaactgaatgaacttgtaaatatggaactgaaagtcaatcctcatagctcatcttttatttaatcctaataaatgacaatctattgcaaacattactttaaaaatattacttatcaaaagctgggtgaaaggataatagctgactgttgaagagaacatgttggggtttttctcccgctagctgaagaatcaagttctgagggcctgctcagttctgtaagaaagtattagctgtctgacaggttccagtgaggggaggaaaagacaaaaaatatagtccccaaatctgcaccagcatcccatgtgcactgtgcaccttccatggtggattagatgctcagcaaatgatatacctatggaaggttaagcctaaagaaacaggaaaaatgagcctttgtccactagcacatttatcaattgcattttagggtgattttagggataggcaaccccaattagtcattattctttaaaggtagttgtctgttagatgtaggaagactccaaggaatgttaagttggcaacattccatttaggttgcacagaatgacttttaagactaaacttcatcaggaggaaatgaaaggcctttaccatggttcctgttcacagtgaaattgacatgtattggaaaggagatgcttggaagaaatgtctagcttccccaacagactcctttcttctcttttctgtcttcctttgttaatctgccatgtttcatcttcattcagatgagttatgatgtatattatttatgtagagatattatgagattataatgaagaagatttacaaagactaaactatcctgcaatgatctaaatttttaagagacatttactcagtttggcactccaaaaattattaatctatgttctgacaacccagtttggggtatatccaagatggcttgtgtgttgctagttactgcttataaggcaactttctctttgggtggcaggaagtaaaatatttataagttattgctaaaatgttaaagttttatttgaacctactgtacccaagtaattatataattcatcactttagtagcagtttggttgacactgaacaacaatgctcaaattcatgtagcagtaacaaactacgtgataaaaggaactgaatttagaaagcaagcttcaagtaaagatcagaagattaagtagatttcatggagctcactaaggagttagatgggaaagatgagataagaaaagcactggagttgagaccaaaaggagacgaaaaagcagagggtggatcttcgagctcggggggttataaacaagatggccacaaggtggcagcacagtcttaacagcagagagctttctgtagggccacccttaatttgctaacaccacagactttctcttagaattcctccatgttgattttcctcattatcctaggggaaacagcagcaaatgtttagaattaaaaatgactcctaaaacttaagctgaggaaaagtatagggtaaaggcagcatctttacttccagagactgtttagatgctctaaagaaggcttccaactctctgtgggaaaggaccaattgacatttccaaaccatatgttaaacagtgatgggaggccattgttttgggctaagcttgtacactaggccccagccgaccagaccaaaccaaaatggagtcactcatgctaaatgtgacataaactaaaattttaaggaaacagatagatcccaaagcagaccaagttttttttcttttcttttcttttttttttctcatgaaaacaggagattccggcacaaggaagtccccttggctctctaactcttacaaaaaagtaacctgaaatccatgttcccaccttaaaaaccaactgttctgctctttccccgtgggatctgagaccaaataagtacatttatgatggtaacagagtgacctcaatgcctaaagttttggtcagtgtcaaaattgagaggttgaccaaaaggtggggaattgttaaattaagtttagcctaaagctgcctccttacatattttaagttcagcctaaaggtttcttcgtactcagcgaattgtaacctaactggaatgtaaatagactgtaacctactcttgtaccaatcaccaagttttggccaaaggcagccaactgttcaaactgtgttcaaatcagggaaatgccaagctgtaacaaatccagctgtttctgtacctcacttccattttccttatgttgctttccttttttgtccacaaatcctctgtgaccatgcagcagcactggagatgctttgaacctattctggtttggggagctgcccaatttgccagtcgttccttgctcagttaaactctgttaaatttaatttgtctaatgttttaacacatcatacactaatacttttgtaaaagttaataaaaatgatattatacaaagaagaacaaaaaagacatacagaacataaacctattttttggtaattagttaaactaattgtgaaaatagcacatcaaactttctttttaaggtttttgaaaaccagaaaatctaattattatgctctagccaaactacccaatgtttgctttacattctttccccacaaaatgaaattagtgaacttaggcagactcaactaagttcacaaaatcgactcaaaaaaaaaaaaaaaaagattgctttgcttattggggtcttttgtagttccatatgaattttagaattttttttatttctgtgaaaaatgtccttggaattttgataagggattctgttaaatctgtatagcactttaggtcatatggacattttaacaatattaattcttccagtccatgaatatgagacatcttgagacatctttccatttctttgtcttgttcagtttttctaatcaatgttttacagttttcagtgtataaatctttcttttttaaaaaattttattattatactttaagttttagggtacatgtgcacaacgtgcaggtttgttacatatgtatacatgtgccatgttggtgtgctgcacccattaacttgtcatttagcattaggtatatctcctaatgctatccctccccgctccctccaccccacaacagtccccagtgtgtgatgttccccttcctgtgtccatgtgttctcattgttcaattcccacctatgagtgagaacatgcagtgtttggttttttgtccttgcgatagtttgctgagaatgatggtttccagtttcatccatgtccctacaaaggacatgaactcatcattttttatggctgcatagtattccatggtgtatatgtgccacattttcttaatccagtctatcgttgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatcgttgaactagttcacagtcccaccaacagtgtaaaagtgtttcaatttctccacatcctctccagcacctgttgtttcctgactttttaatgattgccattctaactggtgtgagattagatctttcaactcattgcttacatttattcctaagtattttattctttttataaacgggaatttttcgggggtggagccgagatggccgaataggaacagctccagtctacagctcccagcgtgagcgacgcagaagatggctgatttctgcatttccatctgaggtactgggttcatctcactagggagtgccagacagtgggcgcaggacagtgggtgcagtgcaccatgcgccagccgaagcagggcgaggcattgcctcactcgggaagcgcaaggggtcagggagttccctttcctagtcaaagaaagggctgacagagggcacctggaaaatcaggtcactcccaccccaatacagcacttttccaacaggcttaaaaaacggcgcaccaggagattatgtcccgcacctggctcggagggtcctacgcccacggagtctcgctgattgctagcacagcagtctgagatcaaaccgcaaggtggcagcgaggctgggggaggggtgcccgccattgcccaggcttgcttaggtaaacaaagcagcctggaagctggaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacacagctggagatctgagaacgggcagactgcctcctcaagtgggtccctgacccctgacccccgagtagcctaactgggaggcaccccccagtaggggcagactgacacctcacagggccgggtactcctctgagacaaaacttccagaggaacaatcagcagcattcacggttcacgaaaatctgctgttctgcagccaccgctgctggtacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctcctccaaaggaatacagctcctcaccggcaatggaacaaagctggacggagaatgactttgacgaattgagagaagaaggcttcagacgatcaaactactccgagctacaggaggaaattcaaaccaaaggcaaagaagttgaaaactttgaaaaaaatttagactaatgtataactagaataaccaatacagagaagtgcttaaaggagctgatggagctgaaagccaaggctcgagaactatgggaagaatgcagaagcctcaggagccgatgtgatcaactgaaagaaagggtatcagtgatggaagatgagatgaatgaaatgaagcgagaagggaagtttagagaaaaaagaataaaaagaaacgaacaaagcctccaagaaatatgggactatgtgaaaagaccaaatctacgtctgattggtgtacctgaaagtgacggggagaatggaaccaagttggaaaacactctgcagggtattatccaggagaacttccccaatctagcaaggcaggccaacattcagattcaggaaatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagtggatctctcggcagaaactctagaagccggaagagagtgggggccaatattcaacattcttaaagaaaagaattttcaacccagaacttcatatccagccaaactaagcttcataagtgaaggagaaataaaatactttacagacaagcaaatgctgagagattttgtcaccaccaggcctgccctaaaagagctcctgaaggaagcactaaacatggaaaggaacacccggtactagccactgcaaaatcatgccaaattgtaaagaccatcgaggctaggaagaaactgcatcaactaacaagcaaaataaccagctaacatcataatgacaggatcaaattcacccataacaatattaattttaaatgtaaatggactaaatgctccaattaaaagacacagactggcaaattggataaagagtcaagacccatcagtgtgctgtattcaggaaacccatctcacgtgcagagacacacagaggctcaaaataaagggatggagaaagatctaccaagcaaatgcaaaacacaaaaaggcagaggttgcaatcctagtctctgataaaacagactttaaaccaacaaagatcaaaagagacaaagaaggccattacataatggtaaagggatcaatgcaacaagaagagctaactatcctaaatatatatacacccaatacaggaccacccagattcataaagcaagtcctgagagacctacaaagagacttagactcccacacaataataatgggagactttaacaccccactgtcagcattagacagatcaacgagacagaaagttaacaaggatacccaggaattgaactcagctctgcaccaagcagacctaatagacatctacagaactctccaccccaaatcaacagaatatacatttttttcagcaccacaccacacctattccaaaattgaccacatagttggaagtaagctctcctcagcaaatgtaaaagatcagaaattataacaaactgtctctcagaccacagtgcaatcaaactagaactcaggaataagaaactcactcaaaaccgctcaactacatggaaaccgaacaacctgctcttgaatgactactgggtacgtaacgaaatgaaggcagagataaagatgttctttgaaaccaacgagaacaaagacagaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaagacattcaaaagctagcagaaggcaagaaataactaaaatcagagcagagctgaaggaaatagagacacaaaaaacccttcaaaaaattaatgaatccaggagctggttttttgaaaggatcaacaaaattgatagaccgctagcaagactagtaaagaagaaaagagagaagaatcaaatagacgcaataaaaaatgataaaggggatatcaccaccaatcccacagaaatgcaaactaccatcagagaatactacaaacacctctatgcaaataaactagaaaatctagaagaagtggataaattcctcaacacatacaccttcccaagactaaaccaggaagaagttgactctctgaatagaccaataacaggctctgaaattgtggcaataatcaatagcttaccaacgaaaaagagtccaggaccagatggattcacagccgaattctaccagaggtacaaggaggaactggtaccattccttctgaaagtattccaatcaatagaaaagagggaatcctccctaactcattttatgaggccagcatcatcctgatatcaaagccgggcagaagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaacctttcatgctaaaaactctcaataaattaggtattgatgggacatatttcaagataataagagctatctatgacaaacccacagccaatatcatacttaatgggcaaaaactcgaagcattccctttgaaaactggcacaagacagggatgccctctctcaccactcctattcaagatagtgttggaagttctggccagggcaattaggcaggagaaggaaataaagggtattcaattaggaaaagatgaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaataacagacaaacagagagccaaatcttgagtgaactcccattcacaattgcttcaaagagaataaaatacctaggaatccaacttacaagggatgtgaaggacctcttcaaggagaactacaaaccactgctcactgaaataaaagaggatacaaacaaatggaagaacattccatgctcatgggtaggaagaatcaatatcataaaaatggccatactgcccaaggtaatttatagattcaatgccatccccatcaagctaccaatgaccttcttcacagaattggaaaaaactactttaaagttcatatggaaccaaaaaagagcccgcattgccaagtcaatcctaagccaaaagaacaaagctggaggcatcacgctacctgagttcaaactatactacaaggctacagtaaccaaaacagcatggtactggtaccaaaacagagacatagatcaatggaacagaacagagccctcacaaataacgccgcatatctacaactatctgatctttgacaaatctgagaaaaataagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagtttttgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtggacgaaggatatgagcatacacttcttaaaagaagacatttatgcagccaaaaaacacatgaaaaaatgctcaccatcactggccatcagagaaatgcaaatcaaaatcacaatgagataccatctcacaccagttagaatggcaatcattaaaaagtcaggaaacaacaggtgctggagaggatgtggagaaattggaacacttttacactgttggtgggactgtaaactagttcaacccttgtggaagtcagtgtggcgattcctcagggatctagaactagaaataccatttgacccagccatcccattactgggtatatacccaaaggactataaatcatgctgctataaagacacgtgcacacgtatgtttattgcagcactattcacaatagcaaagacttggagccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaaccattgcaagaacaaaaaaccaagcaccgcatgttctcactcataggtgggaattgaacaatgagaacacatggacacaggaaggggaacatcacactctgaggactgttgtggggtggggggaggggggagggatagctttaggagatatacctaatgctaaatgacaagttaatcggtgcagcacaccagcatgacacatgtatacatatgtaactaacctgcccattgtgcacatgtaccctaaaacttaaagtataataataataaaataaaataaaaataaatgggaatttttcttgatttccttttcagatagattatgattggtgtaaagagatgcaactgtgttttgtgtgttgatttttgtatcctgcaacttaattcattttgtgttctttacggttttcttcatataggatcatgtcatttactgagtacgtgctctgtggcaacaattttacatgcatcatatctgtactagtttagaattattataatttttatttgacaaataaaggaacttgggctcagagttgtttgctcaagattatacagctagtaactggcagagctgagatttaaacccagagcactctaactctaactccagagggcatacttttttttttttttaatgccataatcctgctatcgcatcctactttttgagcaaaataaaataatttcaaatttatgaactagtcttaagataaatgggaaaattgtatttcaaaagtgagacagtgataaagctaaggacaagaaaaaaatgttaactttgtatcctgtaaccttgctgtaattgcttattatagttccaggagtttttcggtcaattctttttggattgtctacatagatgatcatgtcatctgcaaacaaagacagttttatttcctcctttccaacctgtatacttttttttcccaatcttattgtgttagctaggatttccagtacaatgttgaaaagcagtggtaggaggggacatccttgccttgttcctgatcttagtgggaaagctttattgttttttaccattaagtatgatgttagttgtagattttttaaaaatcaaggtgagaaatttcctgtctattcctagtttgcagagagtttttgtatttaaaatcattaatgggtgttagattttgtcaaatgccttttccacattcattgatatgtggaaaaatcatatgatttttcttctttagcctgttaatgtgatggattacattaactgattttcaaatgttgaatcagctttacatagctgggacaaatcccacttggttgtgatgtgtaattctttttatatattcttgaattcaatttgctaatactttcgttgagaattttcacatctatgttcatgagagatattggtctgtagttttcttgtaatgtctttgtctggttttggtattagagtaatgctggtctcataaaatgagttagtaagtctttcacttgcttctatcttctgaaagacattatagataattgtgtaatattttccttaaatttttggtagaattcagtgaacctatctgtgcctggtgctatatgttttggaatgttgttaattgttgattgaatttctttgatagatataggcccattaagactgcctatttatcttatgtaagctttggaagattgtgtctttcaaggagttcgtccattttatctaggttgtcaaataggtgagcatagattgttcatcatgctccttgattatccttttaatgtctgtgagatccgtagtgatgatgtcccctctttcatttctgatattagtaattcgtgtccttctgttttttcttagttaacctggcttgaggcttattgattttattgatctaaagaaaacctatcagctttcggtttaatgattttctccattgtttttctatttttaattttattgatttctgcactggtttttattatttcatttttttctgcttactttgaatttaatttgctgtgctttttctagtttcctagagtgaaagcctagatgattgactgaaggtcttctttttttctttttttttttttttttgagatggagtttcgctctttttgcccaggctggagtgcaatggcgtgatctcggctcactgcaacctctgcctcctgggttcaagtgattctcctgcctcagcctccagagtagctgggattacaggcatgcaccaccacactcggctaattttgtatttttagtagagacagggtttctccatgttggtcaggctggtctcgaactcccgacctccggtgatccacccgcctcggcctccgaaagtgctgggattacaggcgtgagccaccgcgcctgggcctaggtctttctttttttctaatgtatgcattttatatatatttccatctaattattgcttttgctgcatcccccaaattttgaaacattgtattttcattgagttcaaaatagttttaaatttctcttgcaagttattctttgacctatgtattatttagaacttcgttgtttaatttccaagtattttggaattttccagctatctttcttttttcttttttaaaaaattgagatgaggtttcaccatgtttcccaggctggtctcggactcctgaacgcaggccatccacctgatttcagccttacaaagtgctgggattacaggtgtgagccaccacgcctggcaggaattttccagctatctttctgtttctgatttctagttgtaactccactgtggtctgaaagcagacactgtatgatttctattcatttacatctgtgaaggtatgttttagggtccagaatatggccaatttggtaagtgtttcctgttagcttgagaagaatgtatggtgttgaatgaagtaatttataaatgtcaattatatccagttgattgatggtgctattgagttcagctatttccttactgattttctgcaggctgtatctgcccattctgattgaggagtgttaatgttttcaattttaatactggattaatcttttgccttgaagttctatctgtttttgcttcacatattttgatactctgttgttaggcacacacacattaagcattggtatgttttcttggagtattgatcccttaaccatttggtaatgcttctctttattcttgacaactgtctttgctctgaaattaatgtagctactcttctttctttcgattattattagcatggtatatctttctttatctctttcaatctgtatgtgcctttatatttaaagtgggtttcttttaaacaacatatagccaggttttgtttttttagatcattctggcaatctgtcttttcattgatgtatttagatcattgatttattttttatttatttatttttttgagacggagttttgctcttgttgcctaggctggagtgcaatggcgcgatctcggctcaccgcaacctctgcctcctaggttcaagcgattctctagcctcagcctcctgagtagctgggattacaggcatgtgccaccatgcctggctaattttttgtatttttagtagagacggggtttcttcatggtggtcaggcgtgtctctaactcccaacctcaggtgatctgccctccttggcctcccaaagtgctgggattacaggtgtgagccattgcgcccagccagatcattgatgtttaaagaaattattggtatttggattaatatctaccttatttaatactgttttttatttgttgctcttattctttgtttctatttttgccttccacactttttcaaccttttatattttttattgagcaatctgtatgattgtatttttctgtcctttcttagcacatcagttctacttctttttaaacatttttcagtgattgtcttagagtttgtaatattcatttataactaatctaagtacactttcaaataacactatacggcttcaggtagtacaagtactatataataacaaaatatttctactctctcatcttttgtatcattgctgtgatttattttacttacatgcttatatatatgtgtgtgtgtgtgtgtgtgtgtctgtgtgtaattaaatgcattgttgctaatatccttttaaacagtcatctgttagatcaattacgaataaaaaaataaaagtttttattttaccctttacgtattcattctcaaatgctcttcctttctttatataaatccaagtttctgagctatatcattttcattctctttgaagaacttttaaaaatattacttgcaggtcaggcttactgacaacaaattctctcaatttttgcctgtctgaggaagtatttctctttcacttctgaacgttaatttcacagggtgtggaattctaggttgatgagtttttttctatcaacactttaaattttttcttccactctcttcttgcttgcattgtttttgagaaatcatgtgtaatttttatctttacttctgtgttcataaggtgtttaatgatttatttttaatttaatttaatttaattttttaagagatagtgtctccctatattgcccaggcttgtctggaactcctggcctcaagcaattctaccacctcagcctcccaaagtgttcagattacaggcatgagccatgagccaccacacctggctgcgattttttctttatgtttaattttttgaaatttgaatatctatgcctaagcatagttttttttgttttctttttgttttgcatttatcttgcttggtgttctctgagcttcctagatctgtggattggtgtctaacattaatttgggggaaattttcactcattattgcttcaaatattgcttctgctcttttctctttttcctctcctgggatttccattacatatgtttacaccctttgtagttgtcccccagcttttggatattctgttatgagtttttattttcagtctgttttctttttgcttttggtattggactttcttttctttttttttttttttgagatggagtctcactctgtcgccaggctggagtgcagtggcagtggtgcaatcttggctcactgcaacctccgcctcccgggttcaagtgattctcctgcctcagtctcccaagtagctgggattacaggcatgtgccaccatgcccggctaattttttgtatttttagtagagatggggtttcaccatgttggccaggatggtctcaatctcatgacctcgtgatccacctgccttggcctcccaaagtgctgggattacatggacatttttattgttatgtccccaagcttggagattctttcttcatcatgtccagtctactaatgggttcatcaaaggcattctttgtttctcttacactatatttttttgtaatctctgtgatttcttttttgcttttagaattttcatgtttctgtttacattatatacctgttcttgcatgctatctactttttccattaaagtccttagcatagtccatagtccatagaagcattaaatttctggtctggtaattctagcgtttctaccatatgcgattctgtccagatatgcttgttcagtctcttcagatctttaaactgtgttttttgtcttttagtttgccttataatttttggttaaaaggtacacatgatgtactgggtaaaaagaactgcagtaaataggcctttagtaatgtagtggtaaggtgtaggaagaaggggaagtgtattagttcattttcatactgctatgaagaaatacctgagactgcgtaatttataaataaaaagaggtttaatgcactcacaattccacatggctggggaggcctcacaatcatggcagaaggtgaaggagaaacaaaggcacatcttacatggcagcaggcaagagagaagtggcgagaaaaagggggaaaaaccccttataaaatcatcagatctcatgagaactcactcactgtcatgagaacagcagcatgggggtaaccacccctatgattcaagtacctctcaccgggtccctcttatgacgtagggattatgggagctacaattcaaggtgagatttgggtggggacacagccaaaccatatcagggagcattctgtggtcttatgagtaggtctcagtcttttggtgagcttatgcccctgaattgtgaacttcatcactgtttctctgtccctatctctctccatctccccactcccactcccacactttacatgggaaggaatgacttagaaggggttggaattgggtatttcttttcttccatgtggaaagctagagggagctgggttggctatttccctttccccagcttgatcaggctctgatcaaaccccagtaggctctggtaaaatagtttcttctgaggccaggctttcttaagaacagaatgctctggcacatttcaaaattggttttattttgtgtccccctgctggaatcataagggaatttttctctgatatttgctgtcaggtagagctcctggatgtaaaacgcataaaagtgtggaagcccccatatgactgggtctctctggagttttaaacttacagttgtcttcactgagcctctagcaatccattaattacagttcaggttttcctatcctagcacttgttcctgtggaggtttttgcctgggagtttatgttctgataagttgtgattctcagtatctgcctgtctctctgatatttggggcagtggtttgtcctataactctacttttctgatggttctaagaagagttgttgatttttcagtctgttccagtttttacgtgatgttaggatggagtagcaacttccaagctccttacatgctgaaccagtttattcctttttaatgctgaataatattccatcgtatggatatactacaatttgtttattcatctgttggtggacatttgaattgtttctagtgttgggctatcgtattagtccattttcatacttctgtaagaactgcccaagactggtaatttataaaggaaagaggtttaattgactctcagttctgcatggctggggagacttcaggaaatttatgattatggcagaagaggaaggggaagcaaggtaccttcttcacaaggtggctggaaggagaagtgctgagtgaaggaggaagagccccttataaaaccatcagatcttgtgagaattcacccactatcatgagaacagcatgggcaaaactgcccccatgattcagttacctccacctggtctctcccttgacatgtagaaattatggggattacaattcaagatgagatttgggtggagacacaaagcctaaccatattatgaaaaaagccactctgaacattcatgtttaagtctttgtgtgaacatatgttccacttttcttgcatgtatacccaatagtggaattgctaagttttatgataaataaatttcaactttctaagaactgccaaactgttttccacagtgatttaccattgtacattcccactagcaatttatgagcattccagttgctccacatccttgccaacacttggtattgtcagtgaaaggaagcatttactatatcaatttagaaagactagtttcttctaagcttgccatttgacagaaagggaatgaagagtggatgggactctgtagtttcttcatttggatagctaatgccccataaatctccaaagataccacatttatcaagaaatttgatatttaaattatcaccattttcagcttctcttgtcccaatttcttccaaatggagctaaactcagttcaatctggttttccaattaggtagagtatatggaagctgagaggaagtattatggctgtagactcagtagggcatatggtgagctctgaaaatcctccaagtggttgctgttgagaaattcattgtcggtctagttgtttcattatagataatttttctttgtgacatttaagaaacattccttacctttgattttttttttcttttttttttttgagacagagccttgctctgtcacccaggctggagtgcagtggcgcgatcttggctcactgcaacctctgcctcccaggttcaagcgattctcctacctcagcctcctgagtagctgggattacaggcacccaccaccatgcctggctaatttttgtatttttagtagagatggggtttcgccatgttggccaggctggtttcaaactcctgaccttaggtgatctacctgcctcggcctcccaaagtgctgggattacaagcatgagccatggcgcccagcccttacctttgatattttaatttcactatgatgtgtttaggtatggatttatcctgcttaaaacccaaatttcatgattcttatttttcattaattcagaaaaatagtcattattttctgagtcttattttctcaacagagaaatgtttctctgttctcaacagataaaaatatttctctcttttcccatcttttggaacatagatttggtatatgttgaacattttcatttattctatgtgattcttcatttctcttttgcagtggctataaaaattatcattcatttttcaatgctgcattctagttaatttctccggatcagtcatctagttctccacttctttctacaggtctttaatctgctatttaacctacttaaggggttttaaaaatccagtgcttatgtttatcatttctacatgctttagggattttggtctttaattaatttaaatgttcttatagactataacaaacaattctattttctaaagttcttgggagtctaactctgctttttgttatttctacctactcttgcttacctggattgctttttgagtgtggtaaaattttatttagtaagtcatacttggtggggatcctgtgtggcttacattcatgggatgtctttctagagcaatgtttccattttcttcttcaacttttattttaaattctggggtacgtatgcaggatgtgcatgtttgttacataggtaaacatgtgccatggtagtttgctgcacagatcatcccatcacctaggtattaagcccagcatccattagctattcttcctggtgtagagcagtgttttttaattttcctgcatattagattaatctactgagcctttaaatatcaagatgccaggttgaagctcagaccagttaactcagatactgtgagtatgagactgaagcatcagtgtttttaaaacctcacagtcaagattgagaaccattgctctagagaaaatttgcctttgatttttacaggcactgtgagtgtgttttcagacctggaccagtttaatatcagtgtctcaactttgggttcctgaactatataggtagcataaatttgaaactcatgtttggggaacctttttctttctctcatcaaacatgtaggctgagatagacagattccttgtcatctctttgcacttagagagtagccctttaggggtcatgggggcaaggaagggctctgttctacttcatcaggttgagcaaacccaaggcttcattgttgattccgtatgtctgtgaaatcctgaacttcttgattaccaatattaacaaatgccctctgtgtgacttaaatgtcgatgccagtgcagcagttctatgtttatgtctttttctgattttggttctaaattcctcttacttccgtgagagctcagctgtacatttagaatctttgttatatttaacaattctcagtttttctgtgtacttacatcacactattgctagaaatagaagtcttgctatgatggcattctctacctttgtggccatgccctaccctttgggatcatcctcttttccagatgcctgcctaaaccaagtgtgaacttgctgtgtctttagacatggtgcattgggtttgcaagtgtctatctggcaggcccctggagcttgtatgtgttccttcaccctgcttggcttggtcttggctttgtcttaatccatctggtctctgttgccaaggtctaggcatgctttgaattccaacctacctgaattatgtcaacctctattctttttcttgtgtttccaagtctttgtcttcactcacttgctaaactcaggtctggtttcagtttatttcctggactcatctttccacaaaggactcgctttccctgatttgagggtttgtagcacagtttataacaccatgggagtgagtccagctcaggattcacatttctaggatgccaagatggtctgagcaaatagcttctaactttatatgtcattaaaaaaacacttgttactgagtatgtaaattccaaatactttctattatatattgataacatttgtacctatagtattaattgaagataaatgctgtatcactgattttgtcaggaagaaggataccctttacagttgaggatacacttttgttttttttaaatttgcttaattcatgtatagccatcttcctgtgtatcaaataaaaccagctgtgactggattgtggctcttgtagtccatgcaacctttttactctgagaccttggaaggaagctgagtttggtggaaagcatccagagaactcttggcagccttgatggatcatttaccccagtttggacttttctatctcttttaggaagctctgctgagatcattactgaaacatcagttttcctcagagaataacccctggtcttctgccagtggagttagcatttggttatgaagatggctttgagaattaaataagatacctggaggcaagagtgcattatgtaccggtagtgagcccacagaaatgataggttgcatgattgttggtggatagtggtctaatataatctttaatctttcatctatcaattgcatcctttaggatttgtgttaatgcccccctttcaatcattctgtctttatttagatttctcttcatattttctgtcttttctttcttggcagtatcttcaaaagtaattaggcggctgtcccagaagttgcctttgaagattgttgcaatgtgtatacctgtcaaaaggaattgaccaaaccctgctgaaagctattttacacatcaatttatgagccaatctcagctcttctgttctgagctgatcatccagaatgatccaaaaggaaaccatcagagccaatcatagtgcctggagtgattttcagatgcctttttttcttcttttacttacacagggcactcgggaatcttgcactctggatgaacccagtttacattttggttgggatggggaaagtagagctttagactttattttgaaggcaaaaacccttttatttacataggaaacatttcaattctatatggtttttttttttctctttgttttcttttcttctttccctctatccttccttccttccttccttccatcctcccaccctccctcccttctttccttcctacctaccaacctacatttttttttctctcttttggtatcttggaacatatctaaggcttttggaaaatggacattgttgaagaaaaagtgttatcactattacaaaaatatgatttagaataatggaacctcagatttggaaagaacccaaggattcctttatttcagccatttaactaatgcttaaattctttccaatctagtcacagcccatgatgggatacctacatcacctgcaagtgttgggaaacttctgtgtcctgcagtatcccttacaattttgaacagctctggctgttatttagttactgtttatgttgagctaaaatatactctcctgtaatgcctatcctctgctctttagtttcttttttggggaccataaagagcagtatttttaaaatttcaggctgaaattcagggttgtgaaataattttaattggttatgaccatcattaaaagagaagaaaaaggccagatgtggtggctcatgcctgtgatcccagtgctttgagaggctgaggcaggagggtcacttgagcccaggagtttgagaccagcctcggcaacgtaatgagcacaggtctctacagaataatttaaaaattagcttggcatggtgatgtgtatctgttgtcccaactactcaggaggctgaggtgggaggatggcttgagcccagaaggtcaaggttgcaataagctgtgattgcactgctgcactctggcctgggtgacagagactctgtctctaaaaacaaataataataaataaataaaaggagaagaagaacaaatagaacagaatgagagtagaacaaaatagaaaatatcagagtatatcacaagtagtaaagttttcatgaaacctttgtcttgattttatgtttatttaattatataattaactatgtatgtgcactgtatctcaatggtcaaaagagtttgaaagctgctgaatagaacatgtctcacttttcttccctatgccacccacatagttgagccattctcatgccccatcaagtcttttcttccctacacgaagcatttccatttctttccactcatccatatgtatcacagtctcacatttccttgccacactgaacacagttcaatgaatctagtttgtatgaaaaattgggacctggaatcaaaaacaatgtccctagctatgttctaactgaaacaggggcaagtagaactaccctgttcttggttagcagaatgcacttcactgcattttaatgcagcctgaagtgattagatcgatgaggatgtgtcacagagactccagagccagaggcccctgggctgtgtctcatagtgatgaaatacacagcccaggggcctctggctttggagtctctgtttagtcagtgtaagcctgcagataagctgaagagtaaccaagggcaagttacttctctatgcctcaatttcctcatctgtaatataagcatatttcaaatttgcagtattttataatatttttggattttttttgtgagtattaaatgagttaatacatgtaaaggacagaaaagggcatataataagcacttagcaatcccaaatatttttaaagcaatatcagcaaattattgattcattgaacatttcatcaactcagacatgtagagctttcagcatgtgtataaatagtgtgattatatgtcccattgtgcccagggtagccctagtttttacctattgtcctggcataattaatggtatcccctttcattctcaaaggctccaacagaacctcagatttgcttattccaaatcgtatttttgcagtaggaattaatattttcctcagttgtgtgccatcctagataaaagccacaacttctctcactaaatatttaatcaattttggatttacttggaagatgggatctctctctctttttttttctactgaagtttcacctgagcccgctgcccattgctatacctcctttccttgccaagtggcagaagttagcttcagactagaaactccaaaggggaggctgtcccccttgggcccaattacctgggtttaatttgcccatcattctgttctgtgaagaccttttggattctgattctgtcattcaggatatttactaatcctcaatttcatgttattttcaagtcctttttcctagggagctgacatcccttaaaggttgctttatgtcttaatccaagtaagctgaggttacccaatggggttttccagagagggtttatataaagccctgtggaagtgttaatggttgctatgtattgaacctttattatgtgcaaacaaactgcacagtatccctcaaattaggggtgttgtgaacattttacacatgtatattccctggtcaatgtcacatcaccatgagttaggtgttatctccattttaggggtgagggaagcaaggttgtcacgtaggtagtgaggcggagagctgggacttgaatccagtctgtgtggtgaggatacctggagaacagggcaccctcagaatgaaggtctgaacagaggttcttgataacatagcctttaaactggaaggctttttttctgatgtgataaaattatacttccatatgtaattcatcattctgttgaggtctcatagtccttatttaaaatatcaattatttccataaagatgaaactattaaagcagatgtggatgaggtggaactttgggggttggaggattaataatttgagggacactgtgcagttttttttcttgtaaaacatctataatgtctatttgcttttcctcatacgaatgaaagaatatgtgcacctgtgtgtaacctcctaggcaatgaaacagttggctttctgtggaatagattggtgcaccaaagaccaaagtgccttcctttgaattattttcccactttccatagatttatattcttccctatcatgataccataatcagtgagttttttattgatttatatcagacttacttccaaagagaacttgagtttatatcactttttgttgatgtatcagcaacgttaaaaatattacttctgtattactaacatagtctattactaaaaagtaggcactataatggaatatgtgaatgaattggtgaatggccaacacatattaactttaagaatgtttctctctcacttgtgttttgttgttggtgagttgagctactttgtctctttttttttgacaccaagattttttttttttccctgagacagggtcttcctctgtcgccaggctggagtgcagtggtgtgattatggctcacttaagtgcaagattcttctaagcaagatttctttttttaaaaaagttgtgatgtttgaaagaatgagtctatttcctaaggctttggcttttggagaggtctggttagcttctttgaagatccagtctcacactgactggttacctgcatgacagaaggggtagaaaacagcctttccaagggtgagacaaagacctcttaactgtcactgttagtccccttttacaagcccaaaatagttactgaagccgctagggctgggcatttgccatattaacacctccagcttttaagtggaaagactaggagacgtgagtaccaaagtggatggaagagcatttatatataggtcctaagcatatcagagggaggaaaggctaagcccatcatttgttcctggctcctcctgctgatgcctttgagatgtgagggtcaggttgcttcagcagagcctaaaacttagtctttcccttgtagaaccttttaaatttctacctaagttataattcacatccgaaagcacaccagtctttgatttaagtatttttatatttacatttattatttatttttattatactttaagttccgggatacatgtgcagaacatgcaggtttgttacataggtatacatgtgccgtggtggtttcctgcacctatcaacccgtcatctacattaggtatttctcctaatgctatccctccccttgccccccacccccgacaggcccccgtgtgtgatgttcccctccctgtgtccatgtgttctcattgttcaactgtcacttatgagtgagaacatgcggcgttcagttttctgttcctgtgttagtttgctgagaatgagaatgagaaaaaaagaatgctcatccttttttatggctgcatagtattccatggtatatatgtgccacattttctttatccagtgtatcactgatgggcatttaggttggttccaagtctttgctattgtgaacagtgctgcaataaacatatgtgtgcatgtgtctttacagtagaataatttataatcctttgagtgtatatccagtaatgggatttctgggtcaaatggtatttctggttctagagccttgaggaatcgccacactgtcttccacaatggttgaactaatttacactctcactaacagtgtaaaagtgttcctatttctccagatcctctccagcatgtgttgtttcctgactttttaatgattgccattctaactggtgtgagatggtatctcattgtggttttgatttgcatttctctaatgaccagtgatgatgagcttttttttcatatgtttgttggccgcataaatgtattcttttgagaagtgtctgttcatatcatttgcccactttttgatggggttgtttgtttttttcttgtaaatttgtttacttccttgtacattctggatagtagccctttatcagatggatagattgcaaaaattttctcccattctgtaggttgcctgttcactccaatgatagttttttttgctgtccagaagctctttagtttaattagattccatttgtcaattttggtttttgttgccattgcttttggtgttttagtcatgaagtcttttcccatgcctgtgtcctgaatggtattgcctaggttttcttctagggtttttatgttttaggtcttatgttgaagtctttaatccatcttgagttaatttttgtataaggtgtaaggaaggggcccagtttcagttttctacatatggctagccagttttcccaacaccatttattaaatagggaatcctttccccaatgcttgtgtggcgttatttctgaggcctctgttctgttccattggtctatatatctgttttggtaccggtaccatgctgttttggttactatagccttgtagtacactttgaagtcaggtagcgtgatgcctccagctttgttctttttgcttaggattgtcttggctatacaggctcttttttggttccatatggcatttaaagtagtttttttctgattctgtgaagaaaatcaatggtagcttgttagggatagcattgaatctataaattattttgggcagtatggccattttcacgatattgattcttcctatccctaagcatggaatgtttttccatttgtttgtgtcctctcttatttccttgagcagtggtttgtagttctccttgaagaggtccttcatatcccttgtaagttgaattcctaggtattttattctctttatagcaattgtgaatgggagttcactcatgatttggctctttgcctattattggtgtataagaatgcttgtgatttttgcacattgattttgtatcctgagactttgctgaaactgtttatcagcttaaggagattttgggctgagactatggggttttctaaatatataatcatgtcttctgcaaacagagacaatttgacttcctctcttcctatttgaataccctttatttctttctctttcctgattgcactggccagaacttccaacactatgttgaacaggagtggtgagagagggcatccttgtcttgtgcctgttttcaaagggaatgctttcagcttttgcccattcagtgtaatattggctgtgggtttgtcataaatggctcttattattttgagatacattcaatcaaagcctagtttattgagagcttttagcatgaaggtgtgttgagttttatcaaaggccttttctgcatctattgagataatcatgtggtttttgtcattggttctgtttatgtggtggcttacgcttattaatttgcatatgttgagccagccttgcatcccagggatgaagctgacttgatcatggtggataagctttttgatgtgctgctaggttcggtttgccagtattttattgaggatttttgcatcgatgttcatcaaagatattggcctgaaattttctttttttgttgtgtctctgccaggcgttggtatcaggatgatgctggcctcacaaaatgagttacggaggagttcctctctttctattgtttggaatagtttcagacagaatgataccacctcctctatgaacctctggtagaatttggctgtgaatctctctggtcctggggtttttttggttggtagactattaattactgcctcaatttaagaacttgttattggtctactcagggattcgacttcttcctggtttagtcttgggagggtgtatgtgtccaggaatttattctagattttctagtttatttgtgtagaggtgtttatagtattctctgatggtagtttgtatttctgtgagatcagtggtgatatcccctttatcattttctattgtgtctatttgattcttctctattttattctttaatagtctggctagtggtctatttattttgttaatcttttcaaaaaaccagctcctggattcattgatttttttgaagggttttttgtgtctctatctccttgagttctgctctggtcttagttatttcttgttttctgctagcttttgaatttgtttgctcctgcttctctagttcttttaattgtgatgttagtgtgtcaattttagatctttcctggtttctcctgtgggcatttagtgctattaatttccctctacacattgctttaaatgtgtcccagagattctggtacgttgtcttggttctcattgatttcaaagaacatctttatttctgccttcattttgttatttacccagtagtcattcaggagcagattgttcagtttccttgtagttgtgcgcttttgagtgagtttcttaatcctgagttctaatttgattgcactgtgttctgagagactgttttttatgatttctgttcttttgcatttgctgaggagtgttttactttgaattatgtggtcaattttggaataagtgcgatgaggtgctgagaagaatgtatattctgttgatttggggtggagagttctgtagacgtctattagatgtgcttggtccagagctgagttcaagtcctgaatatacttgttaattttctgtctcattgatctgtctaagattgacggtggggtgttaagttctcccactattattgtgtgggagtctaagtttcttttgtaggtctctggtaactttctttataaatctaggtgctcttgtattgggtgcgtatatatttaggatagttagctcttcttgttgcattgatccctttattataatgtaatgcccttctttgtctttgttgatctttgttggtttaaagtctgttttatcagagacgaggattgcaaccccttctttttttttttgctttccatttgcttggtatatatttctccatccctttattttgagcctatgtgtgtttctgcatgtgagatgggtctcttgaatacagcacactgatgggtcttgactctatccaatttgccagtctgtgtcttttaattggggcatttagcccatttacatttacggttaatattgttatgtgtgaatttgattctgtcataatgatgctaggtggttattttgcccattagttgatgcagtttcttcatagtgttgatggtctttacaatttggtatgtttttgcagtgggaggtaccagtttttccatatttagtgcttccttcaggagctcttgtaagggaggcctggtggtgacaaaatctctcagcatttgattgtctgtaaaggattttatttctcctttgcttatgaagcttagtttggctggatatgaaattctgggttgaaaattcttttctttaagaatgttgaatattggtccccactcttttctggcttgtagagtttcacccaagagatccactgttagtctgatgggcttccctttgtgggtaacccgacctttctttctggttgcccttaaaaatttttcctttgtttcaaccttggtgaatgtgacgattatgtgtcttggggttgctcttctcgaggagtgtctttgtggtgttctctgtatttcctgagtttgaatgttagcctgtcttgctagtttggggaagttctcctggctaatatcctgaagagtgttttccaacttgattccattctccctgtcactttcaggtacaccaatcaaatgtaggtttggtcttttcacatagtcccatatttcttggaggctttgtctgttccttttcattctgttttctctaatcttgtcttcacactttatttcattaagttgatcttcactctctgatatcctttcttccgcttgttcaatttggctattgatacttgtgtatgcttcacaaagttctcgtgctgtgtttttcagctccatcaggtcatttatgttcttctctaaactggttattctagttagcaattcctctaaccttttttcaaggttcttagcttccttgcattggattagaacatgttcctttagcttggaggagtttgttattacccaccttctgaagcctacttctgtcaattcattaaactcattctccatccagttttgttcccttgctggcgaggagttgtgatcctctggaggagaagaggcattctggtttttggaacttttagcctttttgtgctggtttttcctcatcttcatggatttatccagctttggtctttgatgctggtgactttggatggggtttttgtgtggatgacctttttgttgatgtttatgctattcctttctgtttgttagttttccttctaacaggcctctgtgctgcccctccttccaccaagctcgagcgtcccaggtcgactccagactgctgtgctggcagcaagaattttatgccagtggatcttagctttctgggcttcatgggggtgggatccactgagctagaccatttgcctccctggcttcagccccctttccaggggagtgaaccgttctgtctcactggtgttccaggcgccactggggtatgaaaaaaacttctgcagctagcttggtgtctgctcaaatggctgcccagttttgtgcttgaaacccagggccctggtggtgtagggacccgagggaatctcctggtctgtgggttccgaagaccatgggaaaagcgtagtgtctgggccagagtgcactgtccctcatggcacagtccctcacagcttcccttggctaggggaaggagttccctgatcacttgtgcttcctggttgagaggacgcccccaccctgcttcggctcaccctccatgggctgcacccactgtctaaccagtcccagtgagatgagctaggtatctcagttggaaatgcagaaaatcacccgccttctgcgttgatcttgctggaagctacagaccagagctgtttttatttggccatcttctatttacatttatttttatatgtagttatatatttaaaactttatcttgaccacttgatttagagtaatggaaattggagaaatgtatacagtacagaacattctacattggctttttttttcctatttaaaatgcttaaacgttctttaactcaagaactttaattttgctaataacaaagattcttaagcttagtgtgaaacatggaaaggaaacgccagcagcctggttatgaataggatcagcagtgccatcttgtggtaaataccttgaattacaattagaggcacccgcatgggatctgggagactaagaaattctactctatgctcagtgatttacatagaatgtaaaaggtatttctcaccattttaagactttgggtttatataatcagaggaggttcttcctttacaaatgtggcaaagactacagttttctacaagaccttttaatgttgagcttttaatgttacatacaattacattaaatgttactgtatgtaatattaaaaactacagttataatttcaaaaagattatagtacatgaaacattttctctagcagcagctctaatgtgtaataaaacctagtattataggttaaattggatatatctataacataataaggtaagcagctatagataagtcaaagcatggcaagtatatgatcagataataatcctgtttccttcagacctaacatgtggtaatacagtaattttgtgttctttagcttgtctgctgcttttgaaaattcttttcaacagttaacaaatattgatgaatccaactggaaaaaataatgtttacctattcattagttccaagtctgtgatagttaaatacgtgggaccattgtagtttctagaataattacatttaaaatccccagcaccttgcaaaaatatttattcaattcatattttgctttttacgttatcaacacatattagtttagagagtttagcacaaatcactaactagaccagtattagtaatccattggtaattccaagtctcacactggatcatcttgaaaatagttcatgggttactatttttttcattagttatatatgtcatgccgaatcaacattattttcagaagtcattcctctttattttattgcccttttgtgtcactttctttttcaaattataaaagtaatatatgttcatgatgcaagttcagatattaaagtaatcattcctgataaacttaacccctggaaataatcaccatttacagtctggtgtattattttcagttgctgcatttattaataaaaatattttctcttttcagttggtcagaggtaggggcaccccatcttcatttccctcagtggcactttcttccagaaaatttgctgacaatatgttttttttgtctgctaagataactgggaatttcattaccctgataggaaattttgatttttattcctagttttgctgtttctcacttcctgcagtgttggatttattgggcactggatgacaacactctgtagtgctatacagatttcctagcatgttcagatatacattaaccatgcatagaaaggttgtagaaagcttaatgactttgcccaagttagctaacatgtgactagccacgatttaaatcccttctgattatacctgtacctaggtgaattcttctggtcccatgactttaaataccatctgtatttgagatgactctcaaatttgtatctttagccctgccttcccccctgagcatcagacttgtatatgcaatttaaaaaaatacatctccgcctcagtgccatctcaaaccttgacttggcaataaagagaatgcttgatgtcctcaccgctaccttttttctcccaaagacttctccattttagctattggcatcattagctatccatttgcctaagcacaaaccttggaataacctttggtttttctcttcttcaagcgtgacatcaatccatcagcacatgctgattctaactacgtttccctaacataagttcatctcttacctaggctaacataatcacatcccaattggttttcctgcttcccctctgtctgtcatcaccattatgtgctattctattacctttttatttttttcattatatttaacaatatctggtattattggcttttggatctattgtctgtcttactttccttctagaatgtaagctctgcaaggcagaaacttttatcttgtcaccactgaatccccaagacctagaacactgctggcaggtaggtttcgtgttgaacctgtaaacaaacaaattaattaatagaagaagtctggtgcttgttcagtagttgggaattcaggaaaattattcctttgctggttttctcagcgctgttttgtatagcgttgaaagaactgaaaaacttttatttaataatgtgttcttgagattgatattagagtcttattatcttagatatacagtatcacttaggccttgctgaatgcattttatgctccctgagatctttttgggagattttctgtggaaacctgaaaaggaaaccatcacagtgctttctcagagaagcaaggctcaacaaatgactgggaagaaacttttgctggttgagagaggtattcagtatgtgcttcaacaatgatgtaaaagggaacaaagagaagtgaatgcaaaacatctttatttgctttggactgcccttcttccactaaggctaactttgaataaagaggaactcgataccgggccaatgaataaatttttaaaactggaaacttaaaatgaaggtttgaggatcctgaaatactatatattttaaaaaatcaatgattcttttaagaaatggaaaacaaagtgagggaagagtgggtagagagattgattggtcattctatatctagtgtaatggaaaaggtattttgtgtcagcaagatctgggttttgattctagtcttgccactagctggccacatgaccttggatgtcttgcttctgaaatctaggcttgttatttctgttggtggtttaggatgatcacatgagatgaatcttgggaaataattcttacaattataaagcacaatacaagtgtaatatattatcctgattatcattatctcaccattctagtatgaggatccagggcttcattctcttgatgttttcaactttgtggtcccagaactccaatggctacaaagatgccaagatctgaactcagagattcatgaaacagctctaaatagttttaaattacttccttgggaaatttttgcttgcttatgtgtatctgagattaacaacagtaaaaacaccttttatatagcaccatcagtgaggctttatgtctttattataaattttggagcatcctccaggctctcaaaatgaaatctctggatctactgaagagagagagagagagagagacagcaaggactttcatgtctttaaaagcaattacaggctcaggtctctgaaaaagtattaagtgccaagactgacgcctctgcaaccatttattcttgacattttttcaacttttttttaagccagactattgatgcattttaataccattagtatttgttaaaattagttcagcagtattattaatttgtcttcttaaaataaaaggcaggaaaacagtattatgcatgtatttaaataagtcccctttccagatattggaaggtatgtttttaagtattctggagaaaagtcattttaaaaaaatttccaagcagaccattttgctttagaaatattgaagatgcaatatgtgaatcatatttggattttaaagcaggatattaaacttcacagtaaaaatgattccatagttgttaaagtccaaagagaggtttacgaagccagcagacagagaaactgaaattcacttggagaggtaaatgacacaggaatggaaacattgaataaataactttacagcaatttttcttgatgttattttatcccttaaaggcagacagatcattaaaattaaaattgtattaaaaatattctctataaaaatatataacccaataaaatgaatgttgagtcagccacgtgtatttctttccaaacccataatttggatttggattggatttccaaacccacaatactaaatttatttagtattttgaaattcatatttgctaggcagtgcatcttagtaaattaaaaaatatatattcccattacttagttcatgtaaataatcctaaaggtgaactgaattggccttactgaaatggaggctcatgccagggctgaccagggaaggtgaagagaggataagagacattttatcttcatgcatttgtgtctttgcatttgctgtttctctcctggatgtgtttcccatcctgggtcatttgcttaaattcataccaattttttttagcatctatttcaagcaccctgttctccactatgacttcactaacatttctagatagatagttgctcctttctattgctgccttgtatgtaactctgttattgcatgtaacacatcatcaataatttgcttacatttctgtagcttttgtatttccagtacctaccttagtgcttgacatatagtaagaacttaataaatgtctgctgagtgaataaataaaaaagtgagtgatagctcctgatcactgcataacatagatacaactcataaagttgtgattcctggcctcatccttgtggggcaagtaggggtggtgggacagaggctacccagaagatgaacagagggatgggttgattatgcaataaaaaacattcattcagcttctggcactgtgccaggtgctgtgggggaaactgcagagatgtgaggtacattgtatctgctttcaggggtttaccagttaggtttaagggcctaatttacctgtatgaatcatctagagggaaattgaaggctaagttgtaagacttgactgtgtgtctatgaggaagttagaaaagttagaaacccacatgagttgaaggagcttggaaaggcttcatgaggagccacaagttaatttgggctcagcagtattgactgaaggaagggctgatgaagtggcaagccttgggctaggtgggagttgaatgggtggctgtgtgggaattggcttgtggagcagtgtttactctgggagaccacagacactttctacacctatggatggattttagagatgctttgaacccctggaattatttgcaaaatgttgtatgtatgtttatatgagcagttttccagggagaattctcagctttgaaagaagtagatgcagattttaaaagaatgttacgttttgtagttgtaatcacgaataggtagcattatcattatttatcttttcatgaagtcttaaagaaagggaaaaaggaagaattcgatggggtagggaggtgaagggaggagggagattcaggctaacaatataggtatcaatatttattaaatgatctttccctgaaagtgtatcactaacatgctgtatctttagctgattgtcaaaagagatcatctaagcgatggaggctacactgcctgtttgagagaaactactgaactaaaagtgaatgaaaatgtatcccattgttgcccaaatgaaaatatacttaattcaaaggcagaaataatttttaaaaattgttagtgctagaaagatgaggtacttataaaaaaaaaaaagaatgtatttcaaccagatcatgtaaaagtatgcccattctcccactgatttttcttctacttgttaatagttttgctttttatacttagcacgttagcatatttgaagtttatgacatcaagtagtgactcaagttattttaatggaaagcaagtcatgttaagatcacttcttgaacaacttatgcttttgtcattgacatgatatgcctaattgaggtttatgttgtatatatcctgattggggttcactgagatttttggatttgtagattaaagtataaattaaattttggaactttaaaaaataaaaataaaaaataaaaataaaaattgttagtgctttaaccagcaaacattattttttaaggattattctatttaggtttttgaatgtagggatttgcctcataatgaaaaatctgcatttcatcataaaaactgaataaaatgaacatgacttggttatttgccatagatgcggattcttttaatattggatgctcagtttgtatagaaaacatttggattggagcccctctttgggccattgccaactagaggttaacatactaatatatcagagataggagtgatggatttctacttctgggtgagtgttacgctatcacatgccctgaagtgatagctctatcatgttgcaattgtgagttaaggaggaaggaaagagatctatgaaaaaataagctgttcctttgtttcctggcttgttccaaaaaggattgcaataaaaaagagtttcatattattggtttatgtaattgataagagcccagtaattgaggaacaaaaaagttgttaagtttatgcaaacgaataatacaaaagggattttcccataattctatctttaggagagtaattaattggataatagttaaagaagatagtaatgttgagagaatgaataggtatataaacctcaattatatcttaaacattagtaagccatatttttacatagaattcagtttaattggaggacctgagaaatttgttgacactggaaacttgtgcatttttgatttataaacctgaaatatgcataactaatgttaatttaataatgttgaattttaatagccttaaagtcaagcattaagaaaaatgctcagatcatacaattttatgaaaaatagactattcaactcttaatgattcaacataaagggccacttcagtgaatgttcaaaatgtattatcacttctgtggtgatctaatcttatttattgaatctggtaacatatatttatgtatatatgaatatgagaatcttaatatatattttaatatatatattattacattattctgtgtaatatactttttgagttcttaatatcttatattttctataaagtcatatatgtggcagatacatatatggagatatttcagattattgtattgcaagctgaggaatgtagtatcttcagaacttgccacttgctagggacgaggttggaatgagaaagtgtattggcctcatggccattcctaagtcttggggccgaaggctggaggttggccctagtgaacaaattacttggaggatccagaagtggctagtgcacaggagacagtgcaatccattcccaatggggagcagtgggtcatgactggatgaaccatatacatcatcagttctgaaaatgaggctgattaaagggcattcaggagcagggtgaatgaagcttctctggggaaggagagaaggtccaggcctttgtaaacaggattgagttttctaggttgcccagtcccaggttgactttggctggaattaaaagtcatggttcaggtagttcaccttttatagtttcgtgcttattaacataaatttacttttattttgaatacattttgctataattagttaaaacaattatagtaacaagatgcttaactctcactctataaacaatagcattatgaagggaatatggaacaaacaacaatctatttatgaagaacagatcagtggttgcagctagggtgggagcagtgactataaaggggtagcaacaggaagtttcttggggtcatggaactgttctggatcctgatagcggtggtgtttacacacatctatatgcattaaaattcatagaatcatctgccccaaaagtccatttaactatacgataattgtttttaaaaagcaaaaaatgctagcagggagataaaaaaaatttttttttttttttgagatggagtctcgctctgtcacccaggctggagtgcagtggcacgatctcagctcactgcaacctctgcctccgaggttcaagcaattcttctgccccagcctactgagtagctgggactgcaggcgtgtgccaccacacccggctaattttttgtgtttttagtagagacgggatttcactgtgttagccaggatggtctcagtctcctgaccttgtgatctgcccacctcggcctcccaaagtgctgggattacaggcatgagccaccgtgcccagccagaaatgtttaatatatcaaatatacacaacagaacaaagtaaatcctaacagtcctagaaggctataggaaagccagagtcctaaaagtatgccatttgcctgtttctgaatgtcttaggttggtggaaggcacattttacctggaagctgaaaatgatttggtcccctagttcttcttttatcttgctttcaaaaatagacctgtcttccttcctttcttctttcctccctctcttctctttctttcgatcattcctcccctccttactctctttctttcttaagttcatgctatctgacatggtgaagtggcattctagattactttttttttttttggtcacaagtgcctactggtggaagggacatgaagggaggatgagaagctggtctagctctgctccaatcctgagggtggacagttgagccagaataaaaccaaaagtgaagcctcactgcttaccagaatacacttgtgtagtgcctacactacctgtaggccttcctgtttcaggcagtaaagtgttgttctggagctgagcacctgctttgagttagaattgagacaggcaccagaagttggatgcagtccagactgatcagaggacccttggaatagactttaagttgaccttgaccctttagtcttctttggattggacttcccaggattactctgtccctttgaaaaaatatatttgtgtcttgggcctgaaccaaattttaatcagtctcctagaaattgtgaagggctgctatggcatggcacaacatggcctgttttctcaatattgtctctttaacttctcatttacttggcaacctgatttctgattttctgaatgggtgttgctgtggacatttgcccagaaaacagctctgagtgagggactatcagagagaattttatgtctcttgggaagggaaaggttaacttttatttccaagaggactggctgcatgagttcttggatgcagcagtccccaggagagtgcggtgtgttgagctgtggctagtgtgtgtagttccacacaggcaggagtgggctgtgcagagctacttgtttacaacagcttcctgaatctgctaatgccagactgagtgaatgaaagattagtttgaagttcttgacccatattctttacattaaacattgatgaccattttttctttcagtccttcctctatgttattctggatttgaaatctctagctatgagataatattaactgaaattcttgacatttgccaaccctagtcacaacccttgctatagatcatttcaacataaagcatttgtcttttagcttgtctgaaaatatactgcagtatgttgctggtggtaatggatttcttggagttgaaccattgggtagaggatttgtgattggagtttaccatctgatttatatgttctatggtcatgataactcagatttgcagatctgggtactactgggactgtggggctattgtgcctgacttaattgcatatttaaatgtaaggctagaagtaaagctgaaaaagcagatggatttggaaaatgagattgtcctgttttgaggtcatatggaaagccaagaaattgctggagcagctctgacagggatttcaggaaaacaggctggtaatatttccacttctctcagcttgcagtctggctgaaaatgtagtaagatcagccttttccaaaggtcttggtatttctgcagctgttttcagaaagccttgaaagtgaaaagcaaaggagtccacagaatctcaagtatccatgctccaatcactaaagctcttggatgatctaagtggaaaagagctgaagccatgtaagtgaaggtgtgtatgacacagttcatgtgtggagtctgctctttcagatatgacatcatgtctgtggcccccaaaagcttccaggaaagcatcggcttgacagcgaggatgccaaaaagtccttgataggagctctgcacattatatttccaccttctattattttagattcttttttgttccattcacctaagtcagctgggccatctgcctaagccagccaacatctcacattttctaattggtctagttagtccagggttaatatgtcacttactatcactaatgagagactgtacttgctagactcgtaaagcatttttaatgaatgcttccagtattatgattcctgttctacagaaaaagaaaccaggtttcagagaatttatgtgatttgtacaaattatttgaacagattagtggatcatgagggctatggaatgtatattttatactgtcagccaccaactttcaagtggttgaagctctccacatatgtaatgtgtttaaaaggaagtttaaaataatagaaatgactagattgtgtcagtgatttttaaatattctgcaaatgaaacttaagtaaaagttcaatatgttaaagctacaagttctattttagcatgaatttatttcacaagttcaggtttctaataactacttatcttcaaattaaccagtaacattaacgaagctatttatgaacacaagtatttgaaatctagatttgtagatgtgagttggagccttaatatctaatatattttaaagttttgttcggttgtcccccactgaaaaaaaaaactgatttacagataaattcttgaaaataggtataattttcttaaaagctaagcctactgaaaatattattcaatctgattgaatcagacacttgagaaattattaacaggtagttttggacccactttgaatcactatctaactatacctgaaaatattcatttttcctcttctctcctaagcccagtccaattaccatcctctgaaacagcatttgtcaaggtccctagacctctgtgtagccaaatctgtccataaattctcagttctcacttcatgggacccatcatcagcatttgacactcttgatcactccacttactctccaaggctcgcgctctcctggctttcttcccatctcaaaggccacttctcagcttcctttctgtgcccccgtcattgtcctgactatctcaaactccctatcagtccttttcaaccatggtttctcatctgaaccaaggacacaaaaaatgattccagagaatattttctcaactttttccaaggaaaataactagttctaggtgcataggaaggaagttaatccatcacatacaatgggtgccttagggctttgtcttaatgtttcttcacataacctcagttgacaaaggttgccagcctcaatccacaaacattaggcatctgatgcattttcatgaccttaactccatctatatattgacaactcccaaatttatatctccagcccaggcctctatctgaacacaagataatgttctctccaatttgatgcaacctcttgtaaatatctgacatctcaaacttctcatgttcaaaaacaaaacccgatctttcccccaaaaactgttccactcagagttgtcatctctcaggccccaaattttagtcatccctgaacttctggtctttctctcacatctttcatccaatcctttggcaaatcctactgtacctatgtttcaaatacatccagaatctgaccaattcttgccacctttacttctaccaccctgacctaagccacatcattctctagagcttgaactattctagttgcctcctaattggcctccctgctttcattgttggacctctacagtctatttcaaacacagcagccaaattgatccagtcctttgctcaaaattctccagtagctcccaattacaatatgtatggtaaaagctggaaaccttacaatggcctacgtgatctgtagtgcctctttcctgactgctgcagtctttttgctgttcttacaatacattgagcaacttccacccagggcactttcccctgctcccgccccaaacccccatggcttactgctcatttctttcaagtctttgcttagatgataccttatcagtgaggcctttccctcccaaccttttaaaaattgtaacggccctaatcactcactatccccattccattgcttatttctccctattgtgtttattattttctaatattttacatggtttgcttatttatttttattgtcttccttttctactagtgtgcagtttcctcaagggcagagattttgtccatcttgtccactactatatgccaagtgtttggaacagtttgcacggaggaatggttcctgaatgaattgaatgcatggtgagcgtttaatttgaaatttgaaatgtgattaatggaattttaatcattttaaattctccttgtattgcacaaaatgcttcttaaatgcacgttgtaacatcatgagatagtcaatccagatacctcagtgcccactcctgctaaatatttactcaaaggttaaaaactgtcattggttttgtatgctgaggccaaatttgaatttttagttgcgtgctggtacttcatctgcagatgtaggtatcatgcatttcaaccctacattgctaggttaatctaattgagtatattgaaaatatcagtaggattccaagtatctcagttctctcccttccccactgtactctgtgtgagttgtagcggggctggtccctgcaggttgcatttctcttggttgggcatctttctgtctgtgttgacctaattgcaggcagtaatgcatgatgagaagcagcttggagaagccagggtattttcccctccttgtctgctgctgtcagcttcctgccatggccacagcttctgtcaaatgattccatcctagtgtgtgagccagctcacaccagttcatgagggacaattttgtttatttttttcaactccacgtttatgtttttccaactccatcaatatcacattgatgacttaaaataggccaaatcctggctttccactgacagagaaccaatttgttaaacattgaccagcacaccctggtgggctcagcccttgcgttctgtaacacccctttttccttttctctctggtctaggagtggtagtggcttccaactgttgctagtccctggcttattcactcttccctgtttaggactcaattccttggtcacctttgtaaagaatttcctgcattaattctcttcccttttagaaacaggaaatgatttctgttttcctatactttgatacaatgcctaaaatagaacaaccatgctatgtttgagtgaacttgagagaacctttagcagcaatacaaaacaaaaatctttgtctcatctgaaatatttgcaccagtgccttgccttggaacacataaaaatactttgatacaaaaagtaaatttctgatctcattgccaaaattattacacattattttgaaatgctacaacttaaagacagcactctaatatagttaacacttaacatgacattatccaatatagttttaagagatgctgccattttgttacctcctaatacttgtttctgaagcttataggaactacttgaatactttttttcaattgcttttcttataagtcattttcagttgctttcctatggcttactcatcatttgtagacttggtcacgttgtgaatgagttacttcatggtatgttcaaagtcatttaaatatctccctctgttttgatgtatgtattgagtgtttttcaaggctataaactcccttaggtttggccacaggaacaaagtgtacaaaaatggagaataggaagaactataacatccatactctcatttagttgaattataaagattttagctgtcttattcatcacatatgttggatgcccagtcttgggtgctgtgagctgtgatatctgacaatggtaccaatatttcagaggcagggaagcctggtcatttaacacattcactgtggggtcagtagctcaggaggtaatagggttcacccagtgtgtttccttcacatgtgttgatgtaacttaccctgaacaatgtttttaaattcatttttaccatttaaatactactggtccagactgagtaagcatccttgaaactatattgtagtcccatctacagtcctacatcaaggcttgttccaaaattgctccaggtcgtagacttggactttaactccatctttatctctatgcccaccttacagagtcctctaaggaatgttctagagagcccatctttctgtataatcagtctatttagagtggagcaagtgatgaaatttaatgtgaaagattccttgattttcatattatcctattgtctgaagattctgatcaatctaataaatatgcaggttaggcctagtctggttttctttatccaggatcccttctatccccagctagagccactagatcactaaatcaatcgtatgtgcaggctgcctctgatttatttccctcgctgctgctggcctgcccctgccttttagccctgattggaatgtttcaatgtttgctttgttctaatactctgtcccttgtactctcttttaaataaccagcctctgactgtcttggttcttgtttacccaccttttcatcagccccttcctcattcttcaagcccaaattccagcttgaagtctgggttctacaatctgttgacagacttcctcgaagcttatgatctgcattcctgaccttcctaggagtgtctacctcacaattttctgatgttatgttgtgcaatgacacctcattttgtttgtttttgctgttgctgactggaccattgtatatcagatgtggtgttttgcctgccagaccaagccttcccgtattgcatgggagtatactagtggctgtgaccagactgattttaagttctaatccctcttcccactcctaccctcaacctgctcagacctgacaaagtaatagggaattgcccacccatttaagtcccataaaaagccatactgcaccactagccacttcaattatgatgagtggttttatgggaagaaaggaattgtaggctgatgatagtagctttgttgagttggtagcactggatccagtctctgagggaaacataatggttggatttcaactttgtagtattattccaggagcatctgtatagtatcataaatatgggatctcacatgacgtcttcctgtgtctcagaaaaatggacagaaagcaggtttcaataatcttttttttttttttaatttgactttaagttctgggatacatgtgcagaatgtgcagttttgttacataggtatacgtgttccatggtggtttgctgcatctatcaacctgtcatctaggtttgttttttttttttggcagagtctcactctgtcacccatgctggagtgcagtggtgtgatctcggctcactgcaacctctgcctcccgggttcaagtgattctcctgcctcagcctcctgagttgctgggattacaggtgcacaccaccacacttggctaatttttgtatttttagaagagacggggtttcaccatgttggtcagactggtcttgaactcctgaccttgtgatccgcccacctcggccttccaaagtgctgggattacaggcttgagccaccgtgcctggcctgtcatctaggttttaagccccacatacattagatatttgtcctaatgctctccctttccttccccctgagcccctgacaggccccggtgtgtgatgttccgctccctgtgtccatgtgttttcattgatcaactcccacttatgagtgagaacatgtggtgtttcgttttctgttcctatgttagtttgctgagaatgatggcttccagcttcatccatgtccctgcaaaggacatgaattcattcttttttatggctgcaagattaaagaatcttttgcaacagatggggaaattgagatttagattgatcaattgttgcccttgagatcacacacagatttgttgataggatagatcctaggttttggttttggggaataacaatccactgtcccagggacttccaaccatttgatgaaagaatggtttttagttctctgaagccttaaggtaatttaatttcagagctggtctggaactgaccttggagattgcctggttattagtctaaaccctcattttcaaggtactgatgacagagaataggaggtgtgttccatttccctaccccggattgtatgactgatgggaatggagaggtagagtaggacagaggtgtatggtctatcaagaaaggcttgaagtcctctctcaatcttttgtgcaaccagttttattaaatggatggaattcaatgggaagtgaaatagggaacaacctctacccaaaatcccaccccaccctccactgccttcaataatgttaggctcttaatttttccatttttcttttttaaaataatattttattggccgggtgcagtggctcatgcctgtaatcccagcagtttgggaggccaagacaggcagatcacaaggtcaggagttcgagactagcctggccaatgtggtgaaaccccatctccactaaaaatagaaaaattagccgggcatagtggcagccacctgtaatcccagctactcgggaggctgaggcaagagaattgcttgaacctgggaggcagaggatgcagtgagctgagattgcaccattgcactccagcctgggtgacagaccaagactccatctcgaaaaaaataaaataaaataatattttattgttttttgcataatgtctttattttgcagaaaatgctttctgcttattgtctttggctactttgtcaaaactctaggtatgtcaactctagctatgatacctgacacaaaagaagcctgaacattacttgaaagcaacaaggaagagaatgaaagtttgttttttatctcactaaagtaggaccattgtttacaaattctggtatgccaaagtcatctatatgctatatgagaaacaaacaagaagtttctggaccctagtgaacagttttttttttctgtgagtcatggtgaattacgcccaactgcattgcttccagccttgaattcacctagatgactcaggacaacactgccactgcagattaccagcaaagtgggaggtggtgatgggactttttgataaatagtagaatatgtattccttcttctattttaaaatgaagttaataaggctttatttccttcctttgacccatgcgactgccattttatacctagtagatccatcagatgaacgctggttgcaaagtcattgcatatttcaagacataggtcttgattcacatggaaggtggtgacatggctgtctatgaggctaccagtaaggttgggctgaggcattgtactggctgtcaggcgtgtctgtgtctgtgacagtcccttcatacagtggggatcctagagctagtagatggattggtgttatgactcatggggcacatactgatgtgggcaggcattcgaggctggaccaactgacaggggattggagcatggataaacacacagatgaattgtcagaattgtaaggctcttgtatcggtttgaaccctgaaagcgcaccaacgaacaacacaaggcggtgtggagcaacacgctgttttaatgtgtgcctgggtgcagacgggctgaggcttaaaagggcatcagcaccaaatgcggacagggtagcagttttatagtctcctgtaaacaggaagtatctcagtctgatgtaactgctatgcagtacctggacagcagtacctctctcggtcttcagggggtacatgtcttccggccagttctcttcctgcttctgccatcttgctgacaaacactgttggcacaagtggtcttgtgccttgggactaggcctcagaagtgaggagttattcaccaccacctccccccgccggcttccaggccctggggaaagtctttcattcttgtctatttggttatagaaaaagggaaaagcgacgactttctcaataactacttcaagcgtgacatagggggtggtgtggccaccttggaaacaaaaacttaattttgggggtatttttgagagatgggttggtattcatcatgtcgttgcagcaggagcatcgtctggattgtctggtggttaactatggtttcaacaagacttttattagcttttattattagtgggataatacaggggagaaacaggaggagcccagtgatgaagattactgtccctaccagcattttaaatcctcttaaattagagaaccaccctcctagaatgtttgttgggtcccatcccttccaggtttggactggtacatgggctacttttctgatgtttgaagcgatttatagtactgtttttccattatcgtctatgttaagacaacaattggagatattaaacttaccacaaacctcaccttctgaagttgtttggaactacccacctggagaaagtacagacaaagactagaagatagtggagctgtttatcgggtgggatgtgagtgaagtctacttgccaatcttgcccaggtacctgtctctgggcttggtgggtaggaaaaggcagtggctggagggagccctggggtgacactgagtggcagatagagcaggactgggtgatttcttgaacacagctggaaaggtgaggacaagtgagaatagggcggagaagttgtaagagaggtttggaactgacatggaaaagttgtggagactttgggggatagggattgtttgagagtgaggaagaacgaagcgcccttccttgacctaccatggtccttgcttttgaaggttttgggctcagaagtcctccttttcttccgaggattaaagaggagagaacaaggacagggacaaaaactggccttgcacaggttgtaggtgtacttgtttggctacctaatctgctagtgcatttccagctgctataggatcgtatggagtttggtggcctctgcaatgaatgatggcaactttctgtgggagcctggcagcttgaaggagtttgttgatgagagagccatgtatgacaggagtgttttttgcagttaggaaacgctgttctttccagatggaagagtgtgagtgcactatgtggaatgcataatgagaatttgaatatatgttgatctgttgtctggctgctagagtgagagcttgagtgagggcaatgagttcagctttttgggaggtggttcttagagggagcatattggcttcaatagtgtgtggggggtgacactataaaatagccagcatgttggtgtccttgatgtaggaaggagctgccatctacaaaccaagtaaaggaggcatctggaaggtgttggtctgttaggtttggaaaatgtataagaaatgtttgaacagtgttcacacaggagtgcgtagggtcttgggtggttgtagcttcaggtaagagtgtagccaggtttagacaggagctggttagcatggtgatgtggggagtttctatgaatagagcatagagttggaggagctgttgggcagagatgagacttagtacactgcagtgagctagcatgtctttgatgttatgggttgaataaactgttaggttggcatgaagagatagttttaagctttcaagggtgaggatagcagctgccgccaatgcttggaggcaggcaggccatccaagaactgtggcttcaagctgtttaggcaacaacctggaaggtgggtcccttagactgggttagaacacttattgcaactccacatcattcattggtgtagaaggagaaaggtttggtgaggtctaggtctgggagagtgaggacgggggctgaggcgagagccttctggagtagacggaaaggttaggtaataggcagtgcagggtttaaaggctcatggagagggcctttagtggcttggtataacggtttggtgagtagagtgaaggagggaactcagagcctaaaatatcctgctagtcctagaaaagagataatttcttgcttagtttgtggaggtgggagggactggaggagggatatgccatcggttgtgagccctcgggtttgcggggtaagagctaggcctagataggtgactgggggggtgcttatttgtgctttcttaggggagacctgatgcccccattctgccaagaagtttaaaagagagatggtatggacattgcagtctctttgagagggtctacataggtgtagatcatcaacatactgaaggagagtggatggttttagggataaggtacagaggtcacgagccagggcctgcccaaaaaggtgggggctgtctctgaaaccttgagttagtatgcaccaggtaagctgatgtgaaaggtgggtgtcggggttttcccatgtaaagacaaagaggttttgggaatcagggtgtaaaggaattgtgaaaacagcatcctgtaggtctagaacagaaaaacaggtggtgttggagggaattgcagaaagtaaagtatatggtttaggaactactggacatactaggggtatggcttggttaatgagcctgaggtcctggactaagcaataagttccatctggctttttgacaggtagaattgatgtgttaaaaggggagtctgttgggcagagtaggtgactgacaaggaggtgagaaatgataggctttaggcctatgagagctgcttgggggatgggatactgcttctgtgataggaactgggtggggactttaagagtaacgtggacaggggtgtggtgttttgtgattgagggtgtggaagtatcccaaacagtggggttaactatggatgggggataaggaaaggttgcatgttttaaggtgggaggttggaggagtagaagaaagttagaagccccagaggggtctgggttgatgcgttgggtactatggggaatgtggaagtggagagtagtgtggagttttgaaaggatgtctctacttaggagcagagttgggcatgagggcaggactaagaaagagtgagtgaaggaaaaggtgtgcagggagcagaaaagtggagaggtggctcggggtttggagacttgtccatcaattcccacaacagagacttgggaggactgggtgggtcctgaaaaattaggtaaagcagagtaggttgccctggtattaattaaaaaacatactggcctacctgccaccatcagggttacccttggatcacatgaagagatggtagttgccggggtgtctgttccagggcactgtcagtcttcagcagcaaggctgatgagatacgagtaggaggttttgactggctcaggaagggatgggggcagtccttgtgggggctgctcacagtctgacttccagttgggtcctccacagagggggcacagcctggtgggcttacctgggtttgggcattgtctggaccagtggccttcattgccacacttgaaacaggcaccaggtggaggtggattgctaggaggcttctgtgtggagctgcggcccccgtgggcccacagagcccctgatggcagaggcaagcatttgaaactctgcctgttttttgccttttacttttctcatcacgattgttaaggactttgaaggctaaattaagaaggtctcgtgtggtttgaaggctgtcgtcaagcttctgaagcttgcgccaaatactgggggtggattgggagatgaactgaaggtttaagatagtggttccttctgggctgtctgggtctaggttggtatactttctcatggcttcagttaaacgagacagaaaagggctgggtttttgtcgggaccttgggtgatttctgaaagcttttcatggttgactgctttatgagcaccctttttgagtcctgtaaggagacacacaatcatgtggtcttgatggcggcgtccaggggccctgtcttgataatcccagtggggggcctggttggggactgcctctgtgtcactaggctgggcaggagcttggtgatgaattgtatcagcatgcgcctgagctagggtccagatacggtcccagtcttctggggtgagggtggaagagaggataacatagaggtcatgccaggttagttcataagactgggtgaggtactgaaactctctaatataagaggtaggatcttctggaaatgaaccgagtcttttgttaatttgagagagatcagtgagggggaagggaacatgaactctaacaatatctttagttcctgctacttcccaaagtgggcactctagcacaggcgctgaagtaagcgtggggcatgggccaaagatggcacctgagcgagtatgggaaggagagaaggaagagcctggaagtggttcctgctgagggtttgaatggggaaaggggggttgagttaacaggcagtggaagataggggcgtaaggtggcgggatgaatttgcaagcctcaggagagggcgctgggggaggacaatgggtacaggcaattctagaattgtcctgaggaggggacggtgtagaaaaagaagtgaatacagctgactgggaagatggcagctgggaagatggcggctgagaagctaaagaggaggcttgggggttaaagaagatggttgagaggggagaggtaggggctgggagaggtagacagcagactgctggatcaaacaaggaaaaagaggtggggtggggaggaggaaggcgatctgggtggtgagaatggaggagaatgatttgaacaggtgagcaagaattgcagaggtcaggttgtgatctgagtgcaaaaaggcctggacataaggaatttctccccatttctccagttgtcggcaataattgcttaaattagttaaaattataaagtcgaatgttccatttgtgggccatttggacctgttatgtaattcgtactgtggccagattgaattgcaaaaaaagacaaggcgcttagggcggatatcttgcatgaggcctaaggtctgcaggttttttatgaggcagtctagaggctgccttttggaatggaagactgggaatttcccataacggagggtaggctcgggagaacagggaaaaggagaccatcctggacggccggagggagatgataaaaggagcgatcgtcactgctgcctttttcaaggccttgttcatgttcccttccccctcactgatctctcccaaattaacaagacttggttcatttccagaagaccctacctcttatattagagagtttcagtgcctcacccagtcttatgaactaacctggcatgacctctatgttatcctctcttccaccctcaccccagaagactgggaccgtatctggaccctagctcaggcgcatgctgatacaattcatcaccaagctcctgcccagcctagtgacacagaggcagtccccaaccaggcttagaggcatccccctaagaccagatgatcagtgagtgcctggcacatgccagagccttcttggaccaacattggatctttggattggagaaaccaagagaggccacgtggatttttctctgttaacccggctcctgggaaatttatcagtagatgagatcagtgactggtgtgcatgcacagagaggtgactggaggctgaggagcttcctttgtccggttgctgtggactaccgtccagggtggaaggacacaagggacgcggaccggggccccttccagatttcggcaccagatgtaaggctcttgtatcagtttgaaccccgagagcgcgccaatgaacaccacaaggcggtgtggagcaacgcgctgttttaatgtgtgcctgggtgcagatgggctgagacctaaaatggcatcagcaccaaatgagaccgggcaggggttttatagtctcctgtaaacaggaagtgcctcagtctgatgtaactgctacagggtacccggacggcctctctctcagccttcagggggtacgtgtcttctgccggccgtctctcttcctgcttctgctgtcttgctgatgcacgctgctggcgcaagtgttcttgcgccttgggactgggcctgagaagggatgagttattcaccccctcaccctcttcccgcccagcttccaggcctcagggaaagtctttcaagaatgtgttggagaactgttccagtgagcacagggctagggtaggaggatgaatgttggttcctcagggcagggtacctttcacagctgtatgtggaaggaagtgagggaggcctccaaactgaggatgggggttggcaggtggacagaaggtactggttctaggaataagctacccactgaatgggagttcctagattggggttcttcctggctgccttggagttcttccatcatatctttgtaattgcttctttcctttgcatccagggaagcttttgcaaatggattgtgtttaattttcagctgtgagctcttcattctgataagctgtcacagttatttatgaactaggtctcggaaagcaatggctagtgatcatgtgttgtggacaccccactctcactatgtgaattcgaggctggtgcttattaaggagtttgacataatcaggccccctctgtgtagctagttgttgatcttgactttgctgagggagatggacaccttcatctagtagggccctgagttgggggaattgggctggatgggcacacacctgagcacctgcagctcaggcttgccctctggcacccattcctggttcccactcctggttttcttccagcgcttactgtgggcctccatgaagtccagcaagaaggagtacatggctcttaaagccaggccagacatgcttggcactggaaacaacttcctggcattcctggtggtgatcatgtcattggtgagctccttgaagcatagccacaacttgctctcctccaggcctatgtgccactttcactctacatggtcacccttctcaatgcctggcttgttgctcacgcttcatggctctcagcaggtggtccactcggtactgcaggctcttcgatgcacactcttaccagtgctgtgggagctcattctcctgcctgcctcccccgcacccccactttcttctaagccccaacttgctacttgagaaccatctttacctctccaagacctatgaaggtgcctgggtccctgtatagacttggaggagggtaaggacggagatctggtcaggaaaggcactggtggtaagggggaaggttatcatacttgaactcctgaaaggcatgactagggcagacctcttgctcttttgtttttgcatcccctgttttttggcaggtgtttcccaggtgtattagtccattttcacactgctgtaaagatactacctgtggctgggtgattcataaacaaaagaggtttaattgactcatagttctgcctggctagagaggcctcaggaaacttacaatcatggcagaaggtaaaagggaagcaaggacattcttcacatggtggcaggagagggagagagcacacaggggaaactgccacttttgaagtatcagatctcatgagaactccctcactatcaagagaacagcatgggaaaactgcccccacgatccagtcacctcccaccaggtacaatttgagatgagatttgggtgagaacacagagtcaaaccatatcaccaggatcacagaagtagtggaagtggataactagaaggaaaagggcaaaaatcccttgcttatctgggtgccatctttctcttggcccttgatgctttccagatgtgacatgcttacatatgtcttctctctcctgagctacacttctgcatctttggaggcctctcacttgggatgtctctgctttacccttctttgaatttatcctgagctcctgctcctggaggttgaccccacaacctgttattgagtcagcccttttaggccgggtcacacacgatgtctcaaggctgggttaccctttgcagtgtgcactcagatcctgggcaactcacatcgttatgcaaagggtagcctgctgcacaccctctgcactctacttttgcacactggttccaaccaactcttcagtgagaagcagaacccaagctctgtgttcataggcacccagattccagaggacatctgtcattttctctcatgaactgtccctggatgtagttcaatgacattcagcccatggagcctgcagtctctcccagcctcagtgagcagttttctgggagccctccaactctcccacccaccactgcacttaatgagtatgtaggaggtgttggggggtgaggtgacagagaagcactctagagaggagtgaaatactatagcccactcttactgggtctttccaaccgcctcttaagattagtaaggttgaatggggtacaaaggtgagagtctaggggcctttagttttccccttggaaagccttggaggggaattcattccatgtcctgttataattatctggagaggtcagctctacattcaattgaacctgtgagtggatttggcaactgtcttgagcttagccctggttgccataactcattaagtttctcacaagcatttactatgttaacagaacgctgggaatggggtgtgggggcgggcggagaagaagaagacattcacagttaacacctctgatgacatctctgatagcaaatagatactattacaagactctatccacccaagagctaaatcgttagtcacagatgcaaagtgctgtgtggtcttgagtaagcctctcagttttcccatctataaatctagagtagcagtgcagatttacttggcaaggtttttctgaggattaaagtaccctaaatcatgtaattaaaatgaacataaagtattttccaaatttgaagagccatggaaatgagaaaaataattactaagagacccagtgaggggctatgtttgaactgttggccattccttgggcagtagtaatttcctggcaggaactggcctgggagggcccttgacagatgttgcacagaactagtttaagaagggctgactggcatgtggtttttattttatctttgtaaagctacagtgtgaggcctgtgacagcaggaggaggccgtgaggtattcacttgacagcctgccattgtcaactctaatgggagagaaacttcagtggctagaagggcagcctcaggttgtaagcgattcatttttagttcagctgcaataactcctgctggtgatttaatcctgtgacttaggaactcttcgtgtgtgcttgagtgaatgaataaaagagagacagagtgagagagagagagagtgtgtgtgtgtgcacgtgtgcacacatgcacacacattcatgtgaacaatttctattcactcacttgtgattaccaatgggccacattctatttaggttttggaggcttggcatgaagcatgttttgctaggatgatttgttttttggacaaggaagctaacatggtaagtcatatgataatttagtttatgtcttcattgttgcagagtttggctgatagcaagggcagtcgagaatgatagtctcatatagaccttaatcccagctcctaaagtagaatggaattgtggaaatcaagttttctggtctaaaataaatgttttgtggcattcttataaaaggaacaggttgaaaagtccctgtggaatcttaattttgccactgcagattattgaagaccccaggtgagcaaatcaactgtgaggaggtgatttttatcagttggcattgaacagaccacagcatagctatcacctgcatggccttcctttgcctttgatgatcgtgtgtgtcagtgggatggaggattttttttgttttgttttgagacagagtctccctctctcgcccaggctggagtacagtggcatgatctcggctaactgcaacttccacctcccaggttcacgtgattctcctgcctcagcctcccgagtagctgagattacaggcgtgtaccacaatgcatggctaatttttctatttttagtagagaaggggttttgccatgttggccgggctggtctcgaactcctgacctcaggtgatccttggcctcctgaagtgctgggattacaggcatgagccactgcacctggctgggatggaggattttaaaaggagttgtattgcctttttgaaaaaaaaatctagaggcaccccccccccccgcttttataatgacccttttgactgaaactttatcttaaaaattccaggataagggataaattagccagttgaatgtgatttccatgtgctataaattttcatattctcccaaaattcctttctcaatgcgatggcatttgggagtggggccttttggaggtaattaggtcatgagggcagaactctgatgaatgtgattaaaggccttataaaagaggttccacagagatccctcatcccttctaccatgtgaggtcacagggagaaagcactgtctgtgaaccagaagatgggttttcactagacaccaaatctaccagagctttgatcttggactttccagcctctagaactgtgagaaatcatttctgttgtttataaaccattcagtttataatattttgttatagaagccctgttggactaagataccatgaatctagagatattttgcatattttattcaccgctgtatccctaggccctagatatgacctgacatttatttaaggtgctcaataaatatttgtttgatgaatgaatcaatcgaaaaagggctataacctcctattaggagtgatctctgggtattggctcatgcttgccttttgggatcatttgcatggatgtcataagtgctaaaatcttaagccacgagaaatatggagcttgtttccaccgcagtgattttctgtgaaatcactacccaaagatttttcacgctttccaaaaatattttttgaatgaacacatgtcatgggtggggaagttttcctcttattgggcagatatttattttcttatttcatgcagatgcccctgtgatgttaacttaaccctactactgggttttccatttttttgcatttgaatcatactcaaacccatgccagagaacaatgcagttcagctttctgatgaccatgtacagtttttgcaaggtggtctatcttgtccctttttaaactgaggactaatttagtataaaagatcatttagagaacctattccatctattctagctttgccagcatgcacagaaacacccaatgccacaaaatcactgaaatgagactcacacaccaggattaagggaagatgatgcttttgatgaaacattagtgaacaaatagaattttagaatcaatgataatctctgcctcattatgtaatttaagccccttgatttgtacctgaggaaaccaaagccctgtggagcacagactaaggacgtataagaactggagttaagacttatgccctctgactgacagtaaattctttccatagtactgtcacagcatgccacagggaacaagtgtctttttatcttttaataactgtatcgaatgcttaaggccagaaagaagagtatagatgttaacagatatttgcactgtaccagctcccagccacctgaaagagcttgatgggtcggcatcagtgagtcttggagagtacatgaagacccgttgctcacagggtgtgaactgggagttggaggcagtctggtgcaggtggaaaggcattgaactggggtggagtgaggaagcttaggttctgattctgatcgagccattgccatgctatatatattttaccttgtttagtcctaattaccatcctactaggtagggatggttattcttattttaggaatgaggaaaccggggcttagaaaggttaggaaacttttttaaattaaggttatacaggctaataagtggcagagcttcatttgaaccccagcctatataatactacccaaaagttactgcccagtttccctctctgagcctcattgaaaagaaaatgtttggatgatctctgacattccttccaggtcacaaattctacatttgatcttgttttttttgttttttttagtgatgtttggctttgaagatttagtccaccccctttcctccctcgttgttggtgaactgattgttacacaaccaacctcacctcattgttggtgaactgattgttggtgaactgattgttatatatggtgaactgattgttatatagattttcacacgtctgtctcccaggatagtgtgctaagaggaccattggagactgtagaagtttgtttcttttaggtgtaagccttgtttctcagggtactatgctttcactagcatcttaaataattaggtgacagagactattaacactttattttcacataacaccaagtaactaagaattgctattattttgccaattagcccatgcaatccttagctcataaaccaaactattatcttcagatacatattagtctcgattacccagagaaacagaaccaattggagacctatatctatatctatacctgtatctttctataactatacatgtagaaagggagggagggagggagggaacgatggagaaagaaactataaggaattggctcatgtggttatggaggctgagaagtcctagaatctgcagttggcaagctggagactcaggagagctgatgttgtagttctagtgcaactctgaaggtctgagaaccagtagagctgatagtgtaagttctagtctgaggagaggactgaagacagaagactaatgttccagctcaaagacaatgaatgaattggatgaggctcacccacattggggtgggcaatctgctttactcattctgccaattcaaatgttaatcttatctagaaacactctcacagacatactcagaacaatgttaaaccaactatccggataccacattgcccagccaagttgacaaataagttaaccattacaatatactagaactattatgtttttacacttcaagaggtgttgaagtgactcagtcgatctaaggggaaaaggtgatatgctattaaaaatataaacacagataaaaactgtatgttttagttagggtaagctaactgttataacaaatagactccaaaatttctactggcttaatcataaaagaagtttatttcttgcttgttacaaagtactgatcaagttaccaggtcagcagagtccctgctaaaagaggcctcttcatctttaatatgtagcttctgaagtcagcccaaatgttgtcttcatctcaaccagctgggaggagaaaagagcatggagaagtgccacatgggaggattttatgagctaggccaggaatggcccaagtcttttctgtcacattcttttgcatggaactcagtcacatggctgcacctaactgtttgggggcggctgaaaaatgtagtccctggctgggcagcccatatcccagcatgtccactgtaccctgtataaagaatcagaagatctgaattctggaattggctttcctattaactggctggtgatcttttcttgtctgtaaaatgtaaaagcttgttgatatcccaaataccttcttgctctagaattctgtgtctctgttttgctctttaaaagaaaatgttctgtgtgaagacagctagttctttgcctggatgcagtgaaggtcctggttcatgcagcaaactttgtctcatgtaggacttaatactggcaaatcagggagccaagtctgggggctcttttgatcctgtactggataaattattattcactgggcatagtaagcattgattcatgggtggcagtttactgtattttaggggtcttctaagtggtgtgtgcccctggcccacatgaagatttttccaaagggttaggtgttacagccagcatttttagaggatcagttatctttaatttttatatgtacctactcctaaactgatcaaagaacatctgcaatgaaagaattttgttagttcttctttcccacctctttcacagttgcccttctctacctttacaaatgaaagtctactgcttactcagcctgcatcttgcatagttcattgttccaagtgtagaaacctctagggcaccaaagtgattttttaaaatatgtgtcacttatattcaagatattaaacatactttctccatctggcacattaaagagtatatttataataaaagttttgctttttatgtttagtaataatttatgaaaagtatatgtatttatgttgttttgatcaattatgtaccactcataattgagaatacagctcagtaaaacattatttaacttatagcctgatagtgacagaaacttaaaaaatattttttatttatatttggtacttttaaatttaaaactattttgccctaagagaaaattctatagcaaaggtgaaacagaaatacaatttcaagaagctaaaggagtgactgtgtgtactcgggtgatgattgagatagattccgcccttgtggctgataaactagtggaggaggcataaacaagtaaattagcaaaagtgcaagataattttagaccatgataaatgctatgaagaaggtaagcaggagggtggtcaaagaaagcctctcagaggaagtggcatttggtatgagcacagaagaagtcttctctcctcttgagcaaatacatcctctcaggttggggcatggatatggtggaagggaagcagagcttatttctgttaaaaagagcttgttcatggctgggtgcggtggctcacgcctgtaattccagcactttgggaggctgagacaggtggatcacgaggtcaggagatggagaccatcctggctaacacggtgaaaccctatctctactaaaaatacaaaaaatcagctgggcatggtggcacacgtctgtagtcccagctacttgggaggctgaggcaggagaatcgcttgaacctggaaggtgaaggttgctagtgccactctactccatcctgggcgacagagggagacttggtctcaaaaaaaaaaaaaaaagagagagagagagagcttgtttatgtatattttaaatggatgctgatggagatcaaattgctttggtatttatattcccactggatacatttaaaggaatgacataagtttgtgatatttaaactatttcaatagtcaccatacactagaaattatatcatttgcaaatatttaaacttacaatgaaaactttttcatatcaacctaaaatgaacaagtggtaaatagtttattaaaatgtttttggggatacatgagcaaaggactttcaaaaccactggcatagtagcttagaatatgggctttgagtttaggctgcttaagttggaatcctggatccactactactggtcgtgtgatgaagagtcagttctgtgagcaacagcatctgaatctgtaaaacagaactgtaatcccagcactttgggaggctgaggtgggtggatcacaaggtcaggagttcgagaccagcctgaccaacatggtgaaacccccgtctctactaaaaaaaaaactacccgggcatggtggcacattactgtaatcccagctacacaggaggctgaggcaggagaatcgcttgaacctgggaggtggaggttgcagtgagccgagatcttgccacttcactccagcctgggcaacagagtgagactctgtctaaaaaaaacaaaacaaaacaaaaaaacgaaaacgaacaaacacaaaaagcacctaagaaggaggaaatttgaagtttacatgagataatgcatgtcaagtgctaatctcacaataagggctgaacaatgttttctatattatcaacattataactttgctctcaactgtatagtgctgattgaactctattatctttcatatggttgcagagcaggctgaaaggtaaattgtgaaatctagccctttgctgaactggagtagcacttaggggcaaactacactattcatttcattctttcctacttgctttatgtgttattgattgatattcattcattcattgatagtccaagttgagtatgttttgagacacttactgagcagtcctgcaccttgactacagtgtggtctcttctcctccttgtagttcattgaagtcattccaaggaaattacagattttccttctctccctgtgcacgtgtacctctagagtgtagggagatgcaatcttgagaagagtacttggtttctccctgaggacaagctgatggcactggctctgtctcctgatgtccttgctgtggcttcctcctttgttctgctaaggccttagggcctttgtgtgacacagctggggattactaggaagaagtaaatatttgcaaagggtgttctgtagaatgttaaaaaaaaatagaaaaaaattaaaggccaggtgcagtggctcctgcctacaatcccagcactttgggaggccgaggcagatggatcacctgaggtcaggagtttgagaccagcctggccaacatgggtgaaaccccgtccctataaaaatacaaaaattagctgggcatggtggcgcatgcctgtaattccagctactcagggggctgaggcaggagaattgcttgaaccctggaggcagaggttgcagtgagccgggattgtgccactgcactccagcctaggcaacaaagtgagactccatctcaaaaaaaatgaaaaaaaaattgcaaaggaaaggggaccttgggagcaagttaacatggtctggtgaggtgaagagaaaagctgaatgaaggtggcattagaaggagagaggatttaaaattattgagggaagtatgattaaagaaactggaagatgaaggtaaaggatggtagaaaaattagcgttaaaaaaatagagtctgccaaaagcaaaagtaaggattcattaagatacatagcagaaggaaaattgtgaaatgaagtaaaggaaaaatacaactgatgaatcaccagggagttatagcaaggccttaaaaatcattaatggaaagtttaatgccaaaatattagagtaaaaagatagcttgaaagtacacagcttgtctgtgcctggctcctaaaaaacaccacagaacggccaatcctttgcctctggcacccacacagcatgcatgccctgaagtgaaatctttcataccgtccctatactccctcttcacacacaagctttgttaccattctttttatttcattcccactggtccaaaactgtatatgcaacctataagaactgacccagcggtgctgccaatgtgcaaagacctgcatccatgggctgcctacttctggcaaaggatcagtttgcttaagttgtccacttcccttgtcatactactgacttgtcaatattacaagtgtttattgacagtcttccttctttcagctgaaggcctttcaagttagggactgtggctcttttgcttattgtagtagtcctggaacctaatgtgtggagaatggattagatggggagagagtaggagtttacctactaccagggtaagaagtagttttggtgagttaagggtgacttggtttagggagttggaagctgcggcataggaaaatgtctgtttgagacttttaggagatatgttttgatgaaagaaaaggacttggtaattgattggatgtgggtactgagcaagggaaagtgtcaaggatgacttggagagagctctgattgggtggtggtataattgagtataacagagaacactggacgaggatcaagtttgcgagggaaataaaaaacccctgagatatcctggtggaaatgttgagttggcagttggatgtatggagctgaaagtgatgtcctttcactcccatttctctagacttgacttacttcctgatcccagatctctgtttccaaccaattattgaacatattatctggaaaaaccacaggctgctcattctcagcatgactaaaactcacctaatcatattcctctgtgtagcctggtttccttcttaaaatcttagtcattcagtgggaattttattttcctgtttcctctgtctctacctgacctgcaaatccattccacccttgtcatgtaagtctttttgatctatacgtctaactcttattttcatttccactgccattgttccactcccactgcctgatgctcattttacccctgcctattataatagcttccaaatttgtctccctgaaactgtgatttcttaacttcaagcacacgtccttattcacactgggtgcaatctttcaaaggctcaatagtaagtatgagttttaaccccacagtatgttagaaaacgcctttccccttctgtcctctgcatacctcaccaatcttgtcttctttgctcaaccaatctgtaatcagatctttggataacctgctattatacaaatgcgcactctaatttaggcacccttgtgcctgttgtttcctctcttcaggatgaagtttcttcacctttggccaccttggatactgttttcttagcttggaatgtgttttcctcacttcattcaaaggaccagcttaaacatcacctcctcatagagacctacactgtgcctgtgtcttggtttagctcccttgcctacttttactttaagacacttatcacaatgatgatggtattatttatgtgatcatttatgtaatgactatctctgtcactagattaaagacctcatagggtcagggtctgtgactatttcattcaccattgtgattcagcatctgtggattgcagttgcaagcatggatagggatgaaattagtcaaagagaaaatttggagtgaggaaagaaagtcaagacagaacactagggaataccaatatttatggagctggacatgaaggcagatcccacagagaagtctgtggaggagcactggagaaggtaagagaacagggcagaacagtgtcatggaagtcaatgatggagaggattccaagaagaaggagagaacacttaatagtctgggaccaaaaaaaaaaaaaaagataaatgaacttgaaggcatagcaatagaacctatccaaaatgaagcttacacacagagataaaaaagaccaagaaaaataagagagacctggaggcaataacatgttgactgacatatgtaaatgggaggcttcagaagagaagagagtaaaagagaacagagataatatttaaagaaataatgaccaaacatctttcatattttatgaaaggtataaactcacagagctaagaaactcggaacatgaagcaagatacctactagggaaaccacaccaagaacttcattatcaaattacagcaagttactaattctgacaaaaatcttaaaattagagaaaaaagggcacattccatacagggaacaacataaaaataattacaacagagttttcggaaactatgcatgtcagaagacaatggagtaacatctttaaaatgctggaacaaattttgtcaatctaaaattctagacccagagaaaacacctttcaaacatgaaacatgtctttccttagacaaagaaaagttgtgagagttggccagcacacctgcagtacaaggcttgttaaaggaagttcttcaggcagaaggaaaatgatacctgatgataatgtggatctacacaaaagaataaagagctctgaaagtgataaatatgtgggtaaactaatttcatcatttaaaaaattttaaaaaggcaacagtagactgcttaaaacaacaaacagcagcaacaatatattgggggaattcatgacatgagaaagtaaaatacatgacaacaatagcacaaagggcattgggggggaaatggaagcacaccaatgcaaaattcttgtattttatgtaaaatattgtaatgtttttccaaggtagacaaataagataaagatgcgtattaaaagccctagatgaatcattaaaaaataaagtatagccaataaaccaatagtattgagaaaatggaatttaaaaatactcagctagcaggaggcagagcaagatggctgaatagaagccttcaaccaattgtcctccttgcaggaacaccaaatttaacaactatctacccacataaaaaaacaccttcgtaaggactgaaaatcagttgagtgaccactgtacctggttttaacttcatgtcactgaaagaggcactgaagaggataggaaaaacagtcttgatttgtcagtgccatccctctctggttccctggcagtggccgcatagcaaagagaatctgtgctcttgcgggagggagagtacagtgactgtgggaccttgcattggaactcagtgctgctctgtcacagtggaaacaatactgggcagaactcagccagtgcacgtggaggaagcatttagaccagccctagccagcagggctttatccatcctagcagtgggaacttgagttctggcaagcctccccaccacaggctaaagtgctctggggttctaaataaacttgaaaggcaatctaggccataaggactgcaactcctaggcaatcctagtgctgggctcagagccagtggattttgagggcatgcaacctagagagacaccagctggaatggccaagagagtgcttatgccactccttccccaaacccacgcagtgcagctcacagctccaaaaaagactccttctttctgcttgaagaaaggagagggaagagtaaagaggactttgtcttgcaacttggataccagctcagtcacagtaggatagggcattaggcagagttatgaagcccctatcccaggccctagctcccagataacattactagacacaccctgggccagaagcaaactcattgccttgaagggaagagcccagtcctggcaagattcatcatttgctagcaaaagagctcttgaacccaaaataatcagcagtggtaggtgggtagtacatgccatgggtcttgggtgagactctgagatgtgctggcttcaggtgtgacacagcacattcccagctgtggtggctatgaggagagactgtttctgcttgagaaaagcagagggaagagtaaaggagacttcatcttgcagcttaggtaccagctcagccacagcagggtagagcactaagtgggctcttggggtccccagttccaagccctggctcttggacagcatttctggacgtcccctaggccagaggggagcccacttccctgacatatgagtcctaagcctggcaacattcaccacaagctgactggagatcccttgggccttaagtgaacatcagcagtagcctggcagtactcctcacaggcctgtagcagtggtcaccatgaagagagactcctctgcttgtggaagggggagggaggagtatgagggactttatattgtagtttgggtgtcagcacagcagcagtagaatagagcaccagggagattcctaagatttccaactctaggccctggctcctggatggtatctctggacctgcctggggcctggggggagcttgccatccttaagcgaaggacatgagcatggctgttttcaccacctgctaattatagaaccttagggccttgagtgaacacaggcagtaggcagatagtggttatagcaggctttgagcgaggcccagagctctgctggcttcaggtctaacctagcacagtcccagtggtagtggccacaggggtggttgtgtcatctctcccccagctctaggcaccacaacacacacacacacacacggagggaagaggaggaggaggagagagaaagaaacggactctgtttctttgggagaaagtaagggaagagaataagagtctctacctggtaatctggagaattcttccaaatcttatccaagatcatcaaggcggtacctctataagtctgcaagagccacagcgttactgagctcgaggtgtccccctaatgcagatacagctgcagtgaccaaaaactcagatgacaatatccaagttcctttgaatacctggtaagctttcccaggaaggatggtgtattagtctgttctcacactgctataaagaactgcccaagactcagtaatttataaaggaaagaggtttaattgacggttctgcatgtcttgggaggcctcaggaaacttacaatcatggcagaaggggaggcaaatgcatccttcacatgatggcaggaagaattgctgagccaaggctgaacttttaaaaacccaattatgtgtagtctataaaaatttatttaaataaaaatacacaaaagagaaaagctgggaaaagataaagctgttttagttatattaatagccaaaaaaaataagaactattaccagggataaagaggaatatttcacaatgatggagtcaatgaatcaataaggcataacattcctaaatgtgtattcaccttataactaaacctcaaaattcattaagcacttgacagatctggaaagataaaaagataaatctacaattataattgcaaatttcaccactccttttagtaattaatagaacaagtcaacaaatagaaatatggaagaattaaactaatcatcaacttgaactaattgacatttttaagaacatgtcacttaacaaatgcaaaatatacattcttttctagtgcagtggagcatttaccaagatagaccacatgcttagccattaaacaagtctccagaaatttaaaaggattgatatgatatagagtatgttttctgactacaagggaataaattagaaataagcaatagaaagatacatagaaaatctcaaaatacttggaaattaaatagcatacattgaagtaattaatggtttaaagatgaaataaaaaggaaagtagaaaatatttgggggtaaatgaaaagaagacacacatatcaaaatttgtgaaatgcagcctaaagggaaatttataggcttaaaagcttaattagaaaagaagaaaactctataagcaacaggccaagcttccatcataagctagaaatataagagcaaattaaaccccaaactagtaggaaacaaatagtaaagaagagaaataaatgaaatagagaaacagtgaagaacaatgaaatcaaaatctgattctttgaaagatcagtataatagataaactgctggctatattgatcaaaaaaacaaaaaggatgacaaatattaccaatatagataatgaaaaaggggacatctctaagattctttatatactaaatgtctataattaagggaatattataaaaaaacttgatgttaataaattaaacaaccttgatgaaatggacaaattccttgaaagacacaatcaaaactaactcaagaatcaacagaaaacctgaatatcaattaagcacattaatttgtaattagaaatctttccataaaaaaatgtataggcccagatttattacctggtcaattctattaccgggtcagtttattacctagtcaattctatcagacattcaaggtagaaatataagtgacaatcccttatccaaaacgcttgggaccagaaggactttagatttttgattttggaatgcttccattatacttaccagtggagcatcccaaatccaaaaatttgaagtctgaaatgctccaatgagcatgttctgtgagcaccatgttgttactcaaaaagttttagattttgaagcatttcctattgctgatttttggatttggaatgttcaacctataccactatatgaatttgttttgaaaatataggagaaatacttttattttatatggtcagcacttttctgatctcaaaaccagaccaaaaatattgcaaataaagacaactacagaataaaattacttatgaacatggaccaacaatcttcaacaaaagatgtgcaaactgaaaatgaaatatataaaaaacgtaatacatgataatcaaataatgtttatcctaggaatacaaggttgcttaacattacaaaattaatgaatgtagttcatcttattgtcataatgggacaaaaaccatatcatcatttcaataaatgcagaaaagccacttgataaaattaacatccattacatattatcatattgtaccataatcatcttccagtaaactaagaatagaaaggaacctcctcaatctcataaaaggctgatgatgacacatttctatgaatatactaaaaactaccaaattttacactttaagtgtttgaattttatggtatgtgaattattaaactgttttttttaaaaaacctgttgctgacttagtatttaacctgagtgcttttgccctaagatcaagtagacaaggatggtcactctctccacttttcaacattctattgaagactcttgccagtgcagtaagacgaggaagaaaaataagaggcacataggttagagagctacaagtaaaactgtctttattcacagatgacatgatcaagcatgcagcaaacagcaaatcttcatgaatctaccaaaaactagtagaactaataagtgattttagtaagatttcaggatgcaaaattaattgcatttctatatattagcaataaacagatggaaattttaaaaaggacaatattatttgcaatagcatctcaaagcatgaaatacgtgagtatgatgattaattttgtgtattagcttgactgggctatagggggcccaggtgtttggttaaacattacttttgggtatgtctatgaaagtatttctagatgagattaacatttgaatgggtagactgagtaaaacaggttgccttccccagtgtatatgggcctcatctaatccaattcattgggagcctgaatagaacaaaaagcagggaaagggagaatttcctctctctgtttttaagctgggacattggtctcctgcagtcagactggaacttataccattggctcctaggtctttggacttgaactggaacgtatatcatcagttctactgattctcaagcctttggacttggagtagaatttacattgttggttcttctggttcttaggtgtaaggacttgaactggaagttcaccatcagctctcctgtgtttccagcttgcagatggcagatggtctgacttctcagcctccataattacattagccaattccatacatatatagccaatttatatacatatatagttggttctgctcctctggagaaccctgaccactccaaaggggttaaattaaataaagtatatgttaaaacccctaccctgaaaactggaaacatttctatgtgaaatttaagaatatgtaaatgtattgatttatgatgtttatagattggaagacctgaaattgtgatttcagttcctcgaattgatttatagatttgatgacattccaataaaaatccagattttcttatagaaatgttcaagccatttctaaaacctaaatgcttagaataaccaaaacaattttgagaaagaacaaagttagaacacttaaacttactggctttaacacttactgtaaagatacagcaatcaagttggtgtgttattggcatagttttgacacatagatcaattaaacacaatcgagaacccagaaatagacgagcatgtgtatggccaattgatttctgacaaagatgccaaggtaattcaatatggaaaggaataccttttcaacaaatggtcttgaacaacttgttatccacatttaaataaattaacatcaacccttactttatggtacacaactggataatcttaaatgtaaatgctaaaactatacaacttctggaagaaactttataaccttcacgtaggcaaagatttcttaaacaggacacaaaatagcataaacataaaaagtataaaaaatttataaattgggctacatcaaaatttaaaacccgtttataagaaaatgcaaatgcaaaggtagacctcagacagataaaatatatatgtgtgtgtgtgtgtgtgtgtgtatactattttatattataaggactgatatctagaatatataaagaagtctttcaactcactgatagaaccaattataaagtcaataaaatggacacatttgaacaaactttaccaaagaagatacacagatagccaatatatccatgactagatgctcaatatcattcatcattagggaaatgaaaattacaaccacaatgtgatatcactacacatccgttagaacattagagtggctaaaattaaaaggaccccaaatactaactgttgatgaggatatgaaaccactgagattttcctgcatacaccgcttatgggaatataaaattgtacaaccactttggaaaacagttttggcagtttcttataaagttaaacatagatttaccataagattcagcaattctactcttaggtgtttatccaagagaaatgaaagcatgtgtccacaaaaagagttgtacacaagtgttctttcactttatttaaagtaacccaaactggaaacaacacaaatgtccatcagcaggtgaatgtataaataaaatgtttaacaatggaatactacttagtactgaaaaggacaaactatttaaacatgtaccaacatagatgaatctcaaaataaatgtggtaagtgaaagaagaccgaaaaaaaagtaggtattgtatgatattcaatataaacctctagaaaagaaaaacttaacatatatttacagaaagcaggttcatggttgcccggggccagtgatagggtgagatcggctgggaaggggcttaagagaatgatcttttgaagtaatggaaatgttctaatcttgactttagcagtggtaacatgggtgtatactatttgtcaaaagtcatagaatatacccttaacatgagatatgtaaactatccctcattaaaattgtgcttgtatgtagtagttgctgtttttgaggggcaacatcttggagtcagtaaagggaaacattataaaggtgttgacaatttctccatagtataaagcctgttccatattgggcactgtgtcaggcattcctgtgactcttggctgtaatacaaagcaacttcccacttaaatactggctaagaccaagagccagggttccctcctagaagtcccaagctggacccagaggaaggtgctaacatggtgtgtttcggccacaggtctctttcagaggaccacaaaactcactacctcccctctctgagataatggagtgagtgtgttaggttggctcagtggctcagactaaagcgtcagggactcttatatttaaaattgatgtcactgctaatgtactgcttgaatgtatctaagcccctgcctttctatttcaatttcctctgtggttacaggaaaccaactatgacagtccattatacatggaaggctagtgttgccagattttaatttggagagtacagaacataattttgactaattggtccagtaggaactagagtagaatctaaacaactctggaggtctgtggcaatgaaacagggaaggagggagagatttaatcaaccttcacccaggcaggctgttgacagatttctaggctgacttaatcaatgtacttatttctcaggtaagacctcaaaactatttggatctaatttcactatacttcatcctgttcatgatattatgctttcaaagtaacaagcctcgaattccttttaagggcacacaaaagagtaaaacacactttctttttgtcccgtctgaagtggacaaatggagtgggtgcatagaagttgtaactctgagtccacttaagttttgcaagtgtataagtcatttttcagtacacaatgaagttaacaattaatatctttgtggtatccagaaacaatgtcaaccaaaattggagcaatgaacctgagaattgaattcacttgagctataaatcataaacccatcaatctctagagcagaagcaaaagtgaagtcattgaatattataatagattccatatgttgttttaaagaaggcttaaaaataactagacttacaggttaccatatttctgtggcaaaaatttacatatgtgaataagaagtgaaataactgactgtccaatttttgcttctgttttctgccacttctttttagtagtggaataattatttagctcttgaagggcagggcagaggaagtgtgataggcactagagaatgtggaggagctgataaaatagaatatgaagggaggtagaagaaactgactctcagctttggtagaaaaggtagcacagataaggaagcacaatttcagataaccctcttggcctttcccctgctaccttattacagagagttagtgtttctccttaagcattaaagttacaaagccaaatagtaacatggccacaattctgtgaaaattttgaaaggccatgacaaaatgaaaatgaaagctttgttctaagtcagacagatctgttttcaaatttggaccctgctctgtgaccttgggcaattcacttaatttctctgagcttcagtttcatctggatggggaattaatacttacctcaaagagctctcagtgtaatacacttgtgtatttctctcttctaacacctatcctgtcagtttgaaatataatctatcattttgaaatgtatctctttcttctcatacgattgtagacttcccaggaattgagattaagaactcccagctcaagggccaattagtggagaacacaggcttaacttatctttgtttcgccctgccccatacacacctcgcacaataattaggctatagctacgtaaaactttagggacttcttccttcctgtgacagcatggtgctaggtgagatttaaggaaactacacgtcatgtccctgcaaatttgccatcttgttatagtcagtcagattggcccactaaccctccagctagaaagtcaggaatgctaaatcttatatttgcatgattgctgttgtgctaaggtgtcagaacgcaagatacaatcttagttcaagtttacactttggtttatgggaaatagcaaggtcaatctgtggcaatgaaaaaaatggaaagtcctgtaaaagtttaaggagggaagaataaaaggaagagaaaagaaactgtaacccagttggaatgaaatggtaacatggaatgaaatgatcctctttccccccagacagatgttggcatggatttcatatggactctgaaactaaagccgacacccaaccgagtgctcaagccctacattccatccacccctcatttgttagtatcaaaattgaggcatttcacaaacttggctatcgaatactgtatgtgtgtggaaaagggccagataaaatgggccaattagaacacagccacatctgtcaaaactctaacccttaaccttagtgaaaatataatctaggatcaaacacagaagccccgcagatgtacacaagtcatttaatgcagcccttggaaagactgtgatgaacagctggtgctattgtgaaggcctgatgagaaagccaggcttggttttgctacgaatatttgcaattttaaagaaaaaaaataggttctaattgagtaaccattgaatgtatcccagtaaggtccttcccataggctgagttgaaaatactctgactccgttgctatgcaaagcagtttctaaacatgttttgaaaatccgtttgaaatttgagagtagaatttggttctcaaaggcttcatttaggcttaaaaccttttggttcactctaaaataatgcgagggtttcatccttaatggactatcgaggttaaattcaacagctgcttctcctctgatatatatttatgaatgcaggatgcattctatatggtacagtacaccctcacagagctctgagtaagaggaaaaaaacatggaaacaaatttttttttaatgttggagtgtccttacggggtttgctaaaggacaaatggggctctcattaaaaatagggattgtatcttcttgagtatacatggatcgtgaccaacacaacagtttttactgaatttactgataaaaatgtcactatgttatgtcaagctcaagtctttgggagggtttttcaggattctgtaagatatggctttgactttgtattcgcttttgggcaccaggtcatcagggaaaagtcacaagatctatgcaaaaggcagcgtcaggaagcagcatctctagtggtttccccttggtttcattgtccctgtgttcctgtgttcatctgggttattgagtctttgatcccacatgggaaaggtttgccatgttgagccagtagtagtataactcattctaactaaggcacatagcttctgccctctcccctgctggatgagtattggaccaattcctttgtccttagcaccacttacaaggatttatttccattccagaggatttattcccattcagagaaggaacaacatagttagataggaataaaaatgctactctgtgtataaagcttcttgcacctagctaatctagcaaactggtgttttggtcttcaacactaactagatcattattatgtgacactaattaaagggtcttctgtaatgggataaggtgttatctgatcaaatgaaggaggaatgatatttggcagtatatggtatatgtgaaaatcatggtgttcttgctacttagagactgtgagaagggataaggattggcttagagccagctcactctacatgctctcccagaagtgttttcttgaaagagtttttccccattgggaccttccattttcctctggcttagtaaagtgactgtaattaaatagattcaatttctgtttatggtgaagtaaaagattgagaacagattgctctttaacctgaaatgtggaagggctagtcgattcggaagctagttaaaatgattttgtgtattaactggtaaactcaacagattttttcccctgtgaatctaacatttctagatctttgcattcctcccgtgagaagtccacctctgaatcctttcgagagctcagattcctaggaactcagatttttgaacatctacatgatgttattttgtaagtggaacactgactattaaaggatagcagtggagtggagtggtgagggcacagctctgggtcaggataactggagagaaaccctaaggcttattccataatctctcttgatttgagcttctgaggataaactgaggcttgtaacatgctagcccagtatctggtgtagtaaatattgaatgcactgtggtggagagggttgtgttgtcaatgttgctgttgttattgttgagacctaaaggattgctatgatctaaatcagcttaatttccttcaacttgataaaaattagcctgtgactattgaactggatgatgctctcctaatggtttttgcattttgccttcattcagccagttaaagctggtgtttacagaattgtgaaacatttgagcctgggacagtcatgtgatttacagttttgtcttgtttcatgctttccagcaacataattactgaactttttatcgtaataaaaatataggcaataaaaaaggcagtcccctggaattccctctatctctcttagaatgctaaaggatatttttttgtgatctcagctctgttctgttaagtatcctctcccttccccacgtctgtctttgcagatttgtgaccagacggctgcactgaatggagactaggaagggagcccaactgttttccttgtgttggccctctgtgccgagcagggattgttgagcaaagcagggattgctgagcagcgtttctccagggagggtcacagggtagtacaaacccactctggatttttcttttttttttaattattaaaaactttggccaaatactatcagtaagggggagaaagtatgtggtttgaagaccagttggaccagtcttttaaaatatcaactggaataaagcaagaatgccttacacttctttaattttctacatttaacaggagacagttgctcccagagtcacttctaactccacagacagtattgtgcaaccttgctcagcatttggagacactatataattaaaattcctttgaaaatggttgcccaatgattgacatttattccaaaatacattatcatgttgaatgcttaattccttcttccagtacattttctttaataaaaaagtaaaaatctattttttaaaagggtgatggagttttgtaaaaaattgaagcagtgtaacaaacttatgtctaatcttgctcttaaagagctggcaggctagcaggggagaccagagtaagttatggaaagcaaaaaaagcaatactcaggatataactgagttgccttatatagatagacttgaaatgctgctgagattccaaagaggaagagataataggaatctgttgctctcttacctcctagtacattgactcatacctccacttcaaacacaagcaacatttagtattactacgaaattatctaatgggcttcctttctcagggcagtaggaatctgtctctctgctgtggctttctggagtccttcccttctgatgtctgtctgtgccccagtttccattttcatatggtcatctttgattctggatagctgcttctctctgtgttctcagaagaaatagactagtgagatcactgtcatgccccctccacaattaggaggctgtatcttgagaccttcttggatcccacaatttgtagatatcacaatagcaatcatggttagagaagtctaccaccaaaccaggagttagatgctaaggatgggtgagcatgtccaaatagcagctttaaaaagcctcagcacacttacaatagactacatgtcagagttttgggttatctctgaatagtcaaaaccccgatattatatacatgtatgtaaagaggctattttaatatcatactgtttgtttgacttttgagtagtgaatgcataatatgggaataagtacaatacgtgagtgaaacaccgaaatcacctttcactgttttgtttagtagtttggagccttcagttcttctggaaaaataattcaatgcacattagttttgctttctacatttgagggaggtgaatgctttacttttgtaactgtaagaggtctcagcagtcttgtagcctattcatattaaagataaggacactgaggccaagaaaggtgaaatggcttgcttaatggttacacagagaattaactgtagcttcatgattttaactcaggtcttgtgactagaatttcagtgcactttgcattaggcaattctgaacctttgagtaaaactaaaatgcaaagactgctcttgatagcattctaggtggaagagttgaagatagtaggatataaagataaacaaacctatcttatctggacaggacctcagctcattaggaagaggaatgaggaagagagaatgtaggaggaaagaaatggcagaaagacaaataatcatgggaagggactggaacagggtaaatgccagacattttcaagattagaagaaatctgagttgagtttgaaaaattgaaagatttcttcaggtagaagcaaaaggaaaataagcagaaatattatcacatataagggagtctgcagaggaagaagaaaagcatgaccctaatagataaagataagaagcaccaaatcatttcaataagtttctgaattttaaacactttcttttccttccaaaccatttaaagaggaggaggaggagaaaaaaataacgatttgtgagggatgtctcatatgctatttattataagaaggaaagtaaaattcaataaattacaaaatgatgtatcaaacaaagttcagcatggaggttaataaaataaatacagacttgagtggagttgtgtcctagcacttacttttaaagccatgtttcaaaaaaagggcatccatggaagtgatggataatttttatctgatagcaagaacagacactaataatggcaagttattgtgttcttagattgttattttaatacttaacgttttcaagattagcctctgagaagctgctcatttacttttggtgcataatgatcacttagggtatgaagccatcagctgcgccctttgttatgaccatggaaaatgttatgacctcctgtcaatgattattttggaaggaatagaagaaataagttatgattacatattatagatattataagcatagtgttagtaaatattttaaaaagaagactaggcacagtggctcatgcctgtaatcttagtactttgggagactgaggcaggaggatcacttgagcccaggtgagaccagcctgggcaacatagtgagattctatctctacaaaaaaaaaaaaaaaaatctttccatggctttctcatctgcagattgtttctcagtgtcaagcaagcacatctttcttccatcccacctgtcttccctgttttaattttatttctgtgcttcataaggttgaggcagtatgcaatcacaatccttttacaattacaaaaaaattcccaaacaattttcttttttaatttttgagaaaaattttgcttttatgctctctgatcagatttgcctttatatacatacaggttccttttttcaccccactcccaacttaaggctgattttaccatccagttgtttaaacaaaattctgttttgggtatcaggtgttttaaattaaaaattcttcaaaattgatttccaaaggagtccgtaaggcttacgatattttagaccaattcttaactagaacagaaaattttgccttttaggtttacagtgatttcatattatctgatgattctgttgaaggggcccattatttatggtatttgcctggaggttgtcttgtaagccttgactatgtgttttaagaaagaaggcaggctgagtgcggtggctcatgcctgtaatttcagcactttgggaggccgaggcaggcagatcacctgaggtcaggagttccagaccagcctggccaacatggcgaaaccccgtctctactaaaaaatacaaaaattagctggaggtggtggcagatgcctgtaatcccagctactcgggaggctgaggcatgagaatcgcttgaaccctggaggcagaggttgcagtaagctgagatcacgccactgcattccagcctgggcgacagagcaagactccgtctaaaaaaaaaaagaaagaaaaagaaagaagtcagcagttcaactataagatgcacagtatatcagaggtagtggaaagtctacatatgcctcctattttaattttaacaaaaaaatgactctgtcacatagacttctagctctttttagcggaataggtaggaaacctataatgcatgaattgtttaaagaaagtatcgaggctgggtgagatggctcatgcctgtaatcccagcactgtgggaggctgaggcaggtggataatttgaggccaagagttcaagaccagcctggccaacatggtaaaatctcgtctctgttaaaaatacaaaaattagctgggcgtggtggcaggcatctgtaatcccagttactcgggaagctgaggcaggagaattgcatgaacccgggaggcagaggttgcagtgagccaagactgcaccactgcactccagcctgggtgatagcacgagaccctgtctcaaaagaaaaaaagaaaagaataaagagagtatggaataaaatgctagatttgaagaggaaaaggacaggttggtagcaggactggctatataatttgtggggctcagtgcaaaatgaaaatagaagtccccttgttcaaaaattaagaagtttaaggtagcaacagcaaagcattaaaccaagcatgaggctcttctgagcatggggccctgtgtgacttcataggtcacacactcataaagctcaccctggtcagaagttgagatgtcagtaaaaaggaaaaggaatgatccattccctgtgatgttttcctacctctatgccatccttacctatgtactcatcaggtgtgaccatctctcaagggggcaccattgtgccagtgagctgaggcacagacactggctctagtctatggaggaaggagcatgagaaggaggttgcattctaccagcggcgggagagtaggatggagctgaaggctttctgaactgatctaggagagagagcatgaacttgggaactctgcaactttctagcagtgtagtaaagttatttaacctctctgaatcttattttttcattgccgtaaaatggtgatatctacctctcagggttactgtgtggattacagataatgtggaaaatgcctagcactgtggctggtatgcagtggaagctcaagatatattgtacatatggtcatttttgtaagtgcggagatacactgaggatgagtgaaaaagacttcaagtctcagatagggtggaggatctcagaatgcttgaagagccttgtaagaactggctgcctctcttgagtccctccttagttcctgagtgctttggaatcgtttaaaactcacaattgcatcttcttcccaaatagggtgaggagcaatctgtgggaagtcagtgcacagtagagttcagtcttccaacgctgaaaatttgccaactttcacccacactgtggagatgagaaagcagctgtgggcagacagtagagtaagctgtggggtctctggaacatgttacgcttacggatgttccattgttcccatgagattttgtactttgtctgttttatccaggtttgtttccataatatacgaaggagacagccaaaaccattttatgtagttttcctactttgttttgatttatttgttattatttacagtattatctccaataacaacaatggaatttcctttcctactaatctggcctgtttccattttgcctgtttattttaatttcctttttttggactgaaatctctacatgactctgatttgtttatttccttgcgtgtatgtgtcagcatcatttattagtgtgtccactcagaggaactttgttcattaattatgtaggttttgtttcctggttcctaatgggagggtattaagtgctctatgtttctaagtacttcacgatggttttggttatcagtttcttcatcactgctctctgcaagtagatgggcttactctccatggcttacagatggagcatgggaagccccagagcagagaagtaactcctctgcagatgatgattttcttaaatccgctgacccgtcacgcctgccactcgtatagatttcaatttccacttacttttatttgggtagtgggttaagtgagcataacacctgtgttttgcagacgtgattccttgaagacatttccatgaaaaccagcctgttgttaacgaatgagcaatatcgtcttgcattataagctgcttggggggtgtgtgatgaatgttagacttatcccttttttgtgaagaacttacagcccactaagtcaataaaaaagttaaaaggaagaggtaacctgacttttacatctgttacttgaatatataagatctgctgcctccttttcaatggattgtcatgatttactaaatgattgaattaatgattcataaaacatttatttagtacttactctgtgtgtgatactatctctagtctcaagatgcttataagactagaaggcgaaaatagaattgaaagcaaataaatataataaaatgttacaggtgacatgatagaagtttgtctagagtacatagaataacaaaggagggaggcctgtattctcttgggatggggattggagagaaggtgtcacaaacaaaggctataggcaccagatgtatctggggtccatagatactttcaaatggctgaaacagtggctgaggaggcagcagtgcatgcatgaggtgggagaagggaggtggagaaagccagacacaaagatccttggatgctgtgtgaaggaatttgggttttattctttaggaaaagttttaggtagatggaacatcagtaacagttttgctttttagaaaaattacaccaagaatagactcaaggagacttgaatggaggcaaggagactcttctgataatatggggctgagccaggcaagatatgatgagattctgagcaagccagtggtggatggaaagatgtcaaagaagtagaccttgtaaaattggtatcaatttttaaataatatcttacagtaactgttagcgaaaccaaggcccaagaaagtgcatagccagtgaatatcaaagggatcttcctctgccttcattgcagtttagaaacacaattattgtggcatttcagacactacgttgtaatacatcatattgttaatacttgtttacaatctttctgtcctgaggctctaagcttcttaaggttaacagccaaactactgaattatttgtgtatgcctagcatggagcctcatatacacaagtgcataatagatgtttgaagagtaaaactcttgacatcatagccagtgcttcttccacatggagcacttggcatgaaaatatgaaaacatcactcaggtttgcctgacagccacccatttccatcactccccctgagagcaccaaagccaagtgatgagcaggtataacaggcagatgatggcttgcactttgctttaaaatttgtatcagtttgccattatcagaatgcattcttacctcccaaagcctgcattaaaataccaataatgaatatttagaatataaaagtggccataaaagttgatgcctattatgatactgtctttaatggtctcactagtcagaagtcaagcatgataatttgcttcgatgtctcttttaatgttacccattgttttaacctggatcacactttattcttccacacagatccgtaatgcctcctgcctgcctctttcaagatggaggtgaaacctgtgggagaacctactcaagaggtgtctaaattcaaactttccaccaaggtagaaagcacgggacactggctggtggaagatcatgttcgaatatgggaagttttaaagacagaggaggtaagatgactctaaatgacacagttggtgaaatgttggatttgtttatacctgagaccataattcttcgtgtagccagcaccacaggccagcttggcaaatctttattcaggggctgtaggcacagccatgactggagaacaagtaagtcaggagcatgtcctttgcacattaatgactacacagtgattcaggccaaggaggctgcactgaaagccagcgcttaaaaaatgatgatctaaggctcatatgcatataatctgcactttagcctcaggtatcagcagtgtagctgtgggtatcccgctagctacattctttctcaaggctgcccttctgtgacttccctctctcaagcctattgttgttgaagtttcatttgacttatataaaatgctgatatttgtgtgcatatttgtggggggtgtgtgtgtgagagagagaaagagagagaggggacggggagagagagagagagagatgctattattctttcaatggaaattataaattaaagcttttatttttattatgcgtttgaggtaaaatacatattggcaagatattgaaaaccatttccatataggcatgaagaggtataaaaggaagattggaaaagagaatggagttattaaccagatcatggaaaggcctaatttccctgagcttgggttgtgaccatcttttcagctcagcaaataaaattaaagctagaggtttttatgtttttgttttttttggagacaggatcttgctcttctgtccaggctagagtgcagtggcacagtcatagcttactgctgcctggaactcctgggctcaagtgatcctcctgtctcaggctcccaagtaactaggactacaggtcacacaacaccacacctggataatttttaaattttttgtaaagatgagactctcgctatgttgcccaggctggtcttgaagtcctagcctcaagcaatcctcctgcctctgccttccaaagcactgggattacaggtgtgagtgactgtgcccagccccaaaagctagaggttttaatacatgggaaagagcatctcagagagaggtagcaaagcaacaactaagatagcatagaaacgtaatagggaaaacagagaacactttgtcaatggtattttggctaccagaaagaccagcagctgttttctgagaggcttacctgggtgatattcattatcttgggtagttgtctagggtctggtccttagcttacatgcttggaaattttattttctcatgtatccaacagaactttctggggcaaactcacatgaattaagtttatgcaactaatatataaaaagaaaatggcaattccttaattgataaagacaaatagaagagttttatcttctggaatactcaatttaaaatgtttagcacacattctccttgtaggcaaacctaatgggaaatcaaataatgctgagaaagttgattcctaaggatggaatcataacaagtggaaatatataaattccttgtttgacagcatgaggctaagtatattggtatggctctttggttccaagtaacagaaattgactaaattaaggagaatgagaaattgctggaggatgttgagaagcttacagaattggtgagaagtttggaggactaggcttggaaataagacaggaaccaagtcagtagaaactgctcagggtgccaatcctggcacaaattctaaactggtcccttcccctccatattctcatattctgctcaggatgcaaagctgtgggagagaggagctcattgccaagtttagttgcatgcctttcttttggttattctgtgaagagaaagaggaatcttccatgggaaattattataccaactcctcactacagttgtgtttaaaattcaaattcctaatattgacacattatgacaattccaatccaaggaagtaacctaacaactagttttgaacatgtaaaatccagcagaagcaaatacaagccttctctatagggatatacttgcacaacagacttttttttttttttaaagaaataaactccacaggtggtagatgaagtctttgtgtatcttacctaacaggtccaagataagatgagatgagtgttgtgctgagggcacaaaatttaaggaagcactcactcttaggtttatgccctgtacttgcacaaaattgagagtgagtgtatccttaaattttgcaccctaggcttgatgcttgtctcactccagtcctggccctgtcataaatctgaatttggtgtttatcatttttatgcatatttcagtatttatactacatgcatgtggatctatatattcaatatacagtattgatttacatcttgtaaattttatataagccttgtactgtacatctacttctacagcttgtttttttgtttctatttttatgctgacatatgtagtttcactttattcatgtttaactgctgtttatattattttaatatagtcaaatttatttcttcattctcttgttgattaacttttagttttctttcaatacaattggcagtataatacatttttcctcgtgaacatatgctagagttttttctagcatagacacctggaagtggcatgctgagttgtaaagtatgaatacctttagttttgctagatattactagatcagctctgaaatgaggccatgagtttgtatctctgttagcagcatatgaaagttcaaccattctatatcctcacctgttattggtattgacagacctttaaatattggccagtctgtttgttttgaaatgggaccttgttgtaacacaaatttccctgaattcttgtggcattgagcatctgttcacatggatattggccatttagttttctgtgaattatctgttcttatcctttgcttgtttcttttcattgggtcatttgtctttccttgttgatttctggaaactaatgttttgtttactaaacaatcctttttattgatttcatgcactaaaacaatattttcccactcctaaatttttgttttaaattttaatttggtaaaatttatgtcttcttttctccttatggtttgtgttttttctgctttaagaaattatttctgacctcatgatgataaagatactctcctgtgtttcctaaaagttctaaaagttctaaatgtttgcttttatttgcttagtatttatttcacaatctgaaatagggatatgtgttttttccatatggataattaattatctagtgtcacttttgaatgttattgtttcttcttcagtttataatgctatttttcatgtatcatgtttctatagatatcctgtctgtggatatgatactcatttaactattctagctctaaaaaaaagccccgagtatccagtagggaatgtttctctgctgagctattgatcttcaagattatcttggttgtttttggaaactgcattttccatatggatttaggatgagcttgttcagttctgaagatatgaagaaaaattaagcagaaacttgttgggaatttgatttggatttcagtaaatttgttgactgatttggagagtatcaacatttttatattcaatggctatcttgtcttctttttgactttaaaggttatgctttaatatttcatccttaatgtctcaccaatatttgatcccacattcttttgctgtaggattttgataactaaggctaaagaagttccttcaattcatttttttttttttgctaagtgcttattttttaacattatagtatttgatacctacaaaataatacacatgcaagttatggattataatattgtggaatcacaaatacttgtgagtccacaaccaacttaagaaatagtttgttgagtctatatgtgaactgtttcacctactatctctttgatttctttccctgcaaaggtacccatcttcctgaaagttgtgtttaatcatccttttgctttttaaaaagtctttactgcatatgtgtatcctcaaacaatactgttgagttatacacacacacacatgcacacacatatatacacctacatatgtatgtatatataaacacatatatatttatatgtatggtgtctttggtgactcacttcttttactcaacattatgtttataaaatttttaagattcagccacaaaaatatatatagtagtacttcattaattttcactattgtacaatatgccattgtgtggttatatcatgattaattattcatcgttatgtggatgaacatttaagttatttatagttttttgccatgatgaacaatgctgatatgaacatagtatacatgtattttttttttttttttagttttcttatatatttttttaatatactttaagttctgggatacatgtacagaacatgcaggtttgttatacaggtatacatatgccatggtggttagctgcacccatcaacctgtcacctacattaggtagttctcctaatgttatctctccccttgccccccatcccccaacaggcctaggtgtgtgatgttcccctccctgtgtccatgtgttctcaagttctcattgttcaactcccacttatgagtgagaacatgcagtgtttggttttctgttcctgtgttagtttgctgagaatgatggtttccagcttcatccatgtccctgcaaaggacatgaactcatcttttttttatggctgcattgtattccatggtgtatatgtgccacattttctttttccagtctaccattgatgggcatttgggttggttccaagtctttgctattgtgaatagtgctgcaataaacatacatgtgcatgtgtctttatagtataatgatttatgatcctttgggtatataccaagtaatgggattgctgggtcaaatggtatttctggttctagatccttgaggaatcaccacgctgtcttccacaatggttgaactaatttacacttccaccaacagtgtaaaagcattcctgtttctccacatcctctccagaatctgttgtttcctgactttttattgatggccattctaactggtgtgagatggtatctcattgtatacaatgacccctgatgatgagcgttttttcatgttttttggccgcataaatgtcttcttttgagaagtatctgtttatgtcctttgctcaatttttgatggggttgtttgtttttccttgtaaatttatttaggttccttgtagattctggatattagacctttgtcagacggagagattgcaaaactttcctcccactttgtaggttgcctgttcactctgatgatagattcttttgctgtgcagaagctctacatttattgatttgcatatgttgaaccagtcttgcattccagggatgaagccaacttgattgtgatggataagctttttgatgtgttgctggattcggtttgccagtattttattgaggattttcacatcgatgttcatcagggatattggcctgaagttttctttttttgttgtgtctctgccaggtgttggtatcagggtaaggctggcctcataaaatgagttagggaggagtccctctttttctatgatttggaatagtttcagaaggaatggtgccagctcctctttgtacctctggtggaattaggttgtgaatccatctggatctgggctttttttgattggtaggttattaattactgcctcaatttcagaacttgttattggtctattcaaggagttgacttcttctgatttagtcttgagagggtgtatgtgtccaggaatttcttctagattttctagtttatttgtgtagaggtttttataatattctctgatggtagtttgtatttctgtgggatcagtggtgatatcccctttatcattttttattgtgtctatttgatccttttctcttttcgtctttattagtctggctagtggtctatctattttgctaatcttttcaaaaaaccagctcctggattcattgagtttttgtgtctctaactccttgagttctgctctgatcttagttatttcttgtcttctactagtcttctacgagcttttgaatttgtttgcttctctagttctttttttttttttttttttttttttttttgagacggagtctcgctctgttgccccagctggagtgcagtggcacgatctcggctcactgcaagctctgcctcctgggttcacaccattctcctgcctcagcctctggagtagctgggactacaggtgcccgccaccacgtccagctaattttttatatttttagtagagttgggggtctcactgtgttagccaggatggtctcgatctcctgacctcgtgatctgcctgcctcggcctgccaaagtgctgggattacaggcgtgagccaccttttatttgtaatgttagtatgttgattttagatctttcctgctttctcccgtgggcatttagtgctataaatttccctctaaacactgctttaaatgtgtcccagagattctgatacattgtatctttgttctcactggtttcaaaggacttatttatttctgcctttatttggttatttacccagtaatcattcagaagcaagttgttcagtttccatgtagttgtgtggtttttagtgagtttcttaatcttgagttctaatttgattgcactgtggtctaagagaccatttgttatgatttcaattcttttacatttgctgaggaatgttttacttccaattatgtcgtcaattttagaataagtgctatgtggtactgagaagaatgtatattttgtttatttggggtggagagttctgcagatgtctattaggtccgcttggtccagagctgagttcaagtcctgaatatccttgttaattttctgtctcattgatctgtctaatactgacagtgggttgttaaatctcccactgttattttgtgggagtctaagtctcattgtaggtctctaagaacttgctttatgaatctgggtgctcctacattggttgcatatatatttaggatagccatctcttcttgttgcatcgatccctttaccattatgtaatgcccttctttgtgttttttgttctttgttggtttaaagtctgttttattagagactaggattgcaacccctatgtgtgtctttacatgtgagatgggtctcctgaatacagcacacctataggtcctgactctttatccaattttccagtctgtgtcttttaattggggcatttagtccatttacatttaaggttaatattgttatgtgtcaatttgatcctgtcgtcatgatgctagctggtaattttgcacgttagttgatgcggtttctccatagtgtcgttggtctttatattttggtatgtttttgcagtggctggtacaggtttttcctttccatatttactgcttccttcaggagctcttgtaagggaggcctggtggtgacaaaatccctcagcatttgcttgtctgtaaaggactgtatttctctttcactgatgagcttagtttggctggatatgaaattctgggttgaaaattcttttccttaaaaatgttgaatattggtccccactctcttctggattctagtgtttctacagagagatccactgtcagtctgatgggcttccctttgagggtaacctgacctttctctctggctgcccttaaatttttttcttcatttcaaccttggtgaatctgatgattatgtgtcttggggttgctcctcttgaggagcatcttagtggtgctctctgcatttcctgaatttgaatgttggcctgtcttgctaggttggggaaattctcctggataatatcctgaagtgtgttttccaacttggttccattctccccatcgctttcaggtacaccaatcaaacgtaggtttggtcttttcacatagttccatattctttggaggctttgttcattccttttcattcttttttctctaatcttgtcttcactctttatttcattaagttgatcttcaatctctaatatcctttcttctgctttattgattcagctattgatacttgtgtatgcttcatgaaattcttgtgctgtgtttttcagctctatcaggtcatttatgttcttctctaaattggttattctagttagcagttcctgtaacctttttgaaggttcttagcttccttgcattgggttagaacatgcccctttagctggaggaatttgttattacccaccttctgaagtctacttctgtcaattcattaaactcattctccatccagttttgttcccttgctggtgaggagttgtgatcttttggaggagaagaggcattctggtttttggaatttcagcatttttgggctggcttctccttatcttcttggatttatctacctttgatctttgatgctgatgacctttggatggggtttttgcgtgggcatcctatttgttgatgttgatgttatttctttctctttgttaattttccttctaacagtcaggtccctcttctgcaggtcttctggagtttgctggaggttcactctagactctgtttgtctgggtatcaccagtggaggctgcaaaatagcaaaagttgctgcctgctccttgctctggaagcttcgtcccagaggggcacctgccaggtgccagccagagctctcctgtatgaggtgtctgtcatcccctgctgggaggtgtctcccagttaggaggcatgggggacagggacccacttgaggaggcaggctgtcccttagtggagcttgagcattgtgctgggagatctgctgctctcttcagagctggcaggcaggaatgtttaagtctgccgaagctgcacccacagctgccccttcccccaggtgctctgtcccagggagatgggagttttttctatacacccctgactggggctgctgcctttctttcagagataccctgcccagagaggaggaatctggagaggcagtctggctacagcagctttcctgagttgcggtggtttccacccagtccgaacttcccaatggctttgtttacactgcgaggggaaaagtgcctattcaagcctcagtaatggtggatgcaagctcgagggtcccaggttgacttcagactgctgtgctggcagtgataatttcaagccagtggatcttagcttgctggggtctgtaggggtttgacctgctgagtgagaccacttggcttcctggcttcagcttgctttaaaggggagtgaatggttctgtctcgctggggttccaggcaccactagggtatgaaaaaaaactcctgcagctagctcagtgtctgcccaaatggctgcccagttttgtgcttgaaacccagggccctggtggtgtaggcacctaagggaatttcctggcctgtgggttgcaaaaactgtgggaaaagcttagtatctgggccagagagcaccatccctcatggcacagtccttcacagctttccttggctaggggagggagttccctgaccccttgcacttcccaggtgagctgacgccccaccctgcttatgcttgctctccatgggctgtattcactgcctgaccagtcccagtgagatgaactgggtacctcagttggaaatgcagaactcacccaccttctgcattggtcttgttgggagctgcagactggagctgttcctattcggccatcttgccagatccccacatactatacatatcttatttttgcccatatgtaagagtttttccaggttaatagctattagatgaattttgagttgatatgtgcaagttctcttcttcaagttattgccaaactgttttccaaaatggtggtaccaatttatgctctcatccacagtgcataagagtttcccctattccctatccttgtcaattcttggaattgtcagatttcttaattttttttttttgagatggagtctcactctgtcaccaggctggagtgcagtggcacaatttgggctcactgcaacttccgcctcctggtttcaagcgattctcctgcctcagcctcctgagtagctgggactacaggtgcacgccaccacgcccagctaatttttgtatttttagtacagacggggtctcaccatgttggccaggatggtctcgatctcttgaccttgtgatccgcccacctcggcctcccaaagtgctgggattacaggtgtgagccactgtgcccagcccagatttcttaattttttaaatctagatgatataaaatagaatctcattctttgctcatcaattctttatgcatctcagctcgagaacacttttttttttcctttgtacttattctgagggtctaacagtaacacatctctttctctctttctctctctctctctctctctctctctctctttcccctttcctctctttggccttaagatgtctttattttgtgtgcttctcagagtgatagtttagatgactatagaattatagttctttgagtacattggaaattttccattgtcctctgccttccattgcactggaaggggagctagcataaagtttaacttgtattattttgaatgtaacatcttttctctataactgtttagatcatctctacattttttgctgtcctgaagtttcattcttctgtttttccatgtgggtttccttttatttaacattttggggtacgagggcttctcaaatagatgaattgatgtctttcatccgtctggaaatatctccaatttttttcttttgaaattttacctcattctccttttgtaactctagcaagatttatgtttgcttctctcactctctgcttatgtcccttaacctctcttttagagttactatctttttcctctctgagttgcattcttattaatcttaggtctgccttccaattccgtaattctctcttcagctttaatctgtcctttaactcaatcattgatttttaaatttcacttattgtattatttacttctagaagttttgttttgttctttaaaaatcttctagtcattttttcaatgtcttgcttcctatttatatttttattttttcaagacatatttgtcaagaactgtgaaggctatgagattttaattttttaaaatccacagttttgtggatgttgaaagaagacatgagactcttggctaagagcaaaagactttattactcacagcaagagcagcagccagagtgtcaacatgtttgttttggttttctatgttccaattcctagaaatgggcctagatagatacctgcacaggaagggaacattgaccttgggaaacttgccattttatagtaggtaataaacaagctggcattttgtttaagggggaagtattagctcatctctcaagttttcttgctacaagcccaatcctgaaaaataatctgggtaaagatcagccagggccttgaatttttggcatatatagcaagacatgtaggaacaagagagatccatgaagtagtgttgcctaacaatattaaatatagtgattttgtattctgagtgtggtaattctaaaaactgtgggtctcagtgtactatctgttgtttcttttggctcttgaacatggtgttttgtttctttgtgagttttgtgatttttgacagtgggttcattttttttttttcttggaaagaaggaaattttctccagagagaatttgcatttgtttctgggagcactaccaacgggaaactacttgaaaataaattcttatcttgatgtttttcagaccacttaatgtgtctacaggctagaaatctacagatgggcgtgcttgtggtagtaaattctaaggagaaaatgactccccctctctacccctcctcagcatcatatataaagatagtcaactttccttgtattgtcacagaagatatagtattactagctcaccttgatgctgagggaatcacattttagggtctcagttttatgcagtggggatttcctgttagattctctcccataagctaaccttgggctttgtatattgttccctacttgctttaaggtaacaagtcctatgttggttagagtaacattaatgctgtaacaaatacagtataaaatttaagtagcttaacataataaaagtttatttctcaatcatataatagtccaatttaggtgtttctggtgggagtgccccttttctccatgtgataatttagggaccaaggctactttcttcttgaagctccaccatcctctgggacctgggaatcttttgtattcacctggcaattcacaaaaaaagaggttgaagaagacacacccaattcttaactctctttgaccagacatgcattgtattagtttaccttctatgactgagaattagtcctgttgttccatacagatgtgagggatgtgtgatggggagatgtaatctctggctgagctgctacttaccagtgatgactcaatactatggaaagtgaaatacaaattgaattttggtgggcagttaagtgtcacagaaaacaaagtttaaatttacctggtttggccaatgacgtctgaatggaagctgacttcaatgcctatctgtgggttctgctttcatttaccttttggcttttaagagttcttaattttttgccagcctgtcatgtattaaaaaagatattttagttttattttatcaagtttttgtttgtttgtttgtttgttttagttatttgtagtgggagagtgaactagggtatttagtccactgtactgctggaactgagtcctacacactcctgtgagttatttagaaatgtgatcttaaaagttgaaagtctatttttttaaacttaccttttgaaaattacttcacttggtcagaaagtggcatctagataatgttgaatttctattttttggccatatttagttaattttttggccatatttagttaagtacctgcttgcacatgaatattcgtaactgacatcttgcaatcatttaaaagttttatgtagtcacaaatcagtttgtcaagtatatttaaaatgaaaatattattttcattttcaatgtagtgattaactgtaactattctatgcctttaaaattcaaatatttaaaatttaaatgataaataatacctatatgtagtagaaaataatgaaatctttattaaagggttaagtatgacaaatatctttatataatttcagtacctttttaaaaaaaaagagcaaggaagcaatgggagaattggacatgttttgtggtgatgtgttcaattttttgattggtgattacatgggtgtacgtatttgtcaaaactcattcaactatacatttaaaatggacatattttattatatgtaaatgatacctcaacaaagttgatcttaaaaaacggacaatgggatgagggaatagaattaaataaataaatcagtcattgccatacagtgtgctgtaataagtgtccacaggtatttcgagagcttagagcatgtaatccagcatgagtatgggcactcataggtgtgcatgtcaaggaaaggaagcttctcactgagctgatagttgagttcattctttttttttttttttttgacacagagttttgctcttgttgcccaggctggagtgcaatggcgcaatctcggctcactgcaacctctgcctcccgggttcaagcgagtctcctgcctcagtctcctgagtagctgggattacaggtgcctgccaccatgcccagctagttttttgtatttttagtaaagacggggtttcaccatgttggccaggctggtcttgaactcctgccctcaggtgaaccacccgtctcggcctcccaaagtgctgggaataaaggtgtgagccactgcgcctggcctgagttcatttttttttttttctttgagatggagtcttgctctgtcgtccaggctggagtgcaactttgacctccctggttcgcttaaaggaaaggtagaaactagcctggcaaatggaatttttgaaggggaattggatcaaatatttctggatcagggaaaactgtaaaggggagtgttagagagaatgtcctaccatttagagcatctgtagcagaagaggaatggcaagagatgaagccaagaggaaacaaataatgaaagtcttcacgtctcttacttagaaacttaggaagtatcctgtgggcactgtgcagtcaatgaaaggtttttggcaggctagtgacatgttcagatttgtttttagaaatgctagtctgtcagacatgtttaggatggccgaaaatacttcaaaacctctctagcccagattgctgtctctcttctctgtccacactatgctagccagtgctcaagtagtgattatttggggttgttctttttttcatgatagtaattcttcctctccaactagactgtctgtccttcagaccaggcctcttagtcttcttctttttaaaaaatttatattcccatattgataggtcacccccttagtcttaattctacttcacttatgactcccaaagcactggtactactagacacaggttgaaataaatatttgatgattgactgatgaattattttcattatttaatggtaataccctgtttctctaaattgtaacatcaagcagaatgttgtcatctttgggtactaaggtgattcatttgactcaccattggataacacttagttgggtggtttgtttgtttttttttttttgtattgctgattgaatttgcacggagtcatccactatgcactggacttatctatgttcaatgttttacaagaataccacaacgatatgcaatgttctctatggctatcgaacagagatgttctctacgtgaaattaaactggcgaatgtctgtatggagactggacatatgacctcttctctatccagctcaggaatggggcttcacattgtaaaatcacattcttggaggaggaaatagtaagtgttcatcatgcatgctttggagattaaatcatacacatctgagagacaggaagagagaagtttttaaaaactggatggcaatttaggcaagcagtgggagtgtattgtattaaactgtgaaaagccagctatttgctgaattgtggtttgatgacagagctagggtccttctttatgattctgaatgaatttctatttcactctgccacaaattttcatatgaggcaaagggatagaaatttactttctaggaagttattaatatataaaaatgctttgatatatgaatctctgagatgggtaaaatagacatatcagtagtgagaaatggaatattgagactgaataatattctgttgggtttacaagaaaaagaaaatatcatttattgagcatctattctgtgtcaggaactgcacttggtgctttcatatttattaatatatttgtcacagccataggtacattttcattttactcataaggattatgaagattagaggttaaggcacatgctcaaatatacatagctgtttggtggcagagtaagattgaaattcatttgtctctcatttgtctttgttctataatctcctcatgaagcaaactaccaaaattgttaaatcactctaattttacatttagttttcttgtccagaccataaccattcctggccagggcatcaacttcagctcaataactggtaccaatcttgctctgttagaccttggctctgcaatgcccatgtgaacaaataccagtgtgcccattgagtcataatcttcttccattcctcaaagtgctggctcagttggtgtggctaggcttctatctcagttctcctatatatcatctgtcttagccagttggactgccacaatgaaatagcacagactgggtggcttataaacgatagaattttttttttttttttgagacggagtctcgctctgtcgcccaggctggagtgcagtggcacgatcttggttcactgcaagctctgcctcctgggttcacaccattctcctgcctcagcctccagagtagctgggactacgggcgcctgccaccatgcctggctaactttatatatattttagtagagacggggtttcaccgtgttagccaggatggtctcgatctcctgaccttgtgatccacccgccttggcctcccaaagtgctaggattacaggcatgagccaccgtgcccagccaacaatagaaatttctctctcacagctctggaggctgggagtctgacatcaggatgccagcatgtttgggttctggtgaggttccttctctgagttacagatggtgtcttctcaatgggtcctcatgtggcagaaaaagttggagagctctttggggtcccttttataagggcatgaatcccattcatgaagactctaccctcatgaccttattgcctccccaaagctctgcctcctaatatcatcacactgagggggttctgttttcaacctaacaaagtttgggaacacaaacattcagtccatagtaggacccagtttctcagagagactgtacctatttaaatggtgcccttaactccatcctatttaaatagaacttagaactctgttaggctccatgtagctctgtcttctgcataattgagctctgttccacttaccccaagctattaattggggtctaattgtaaacagtctgtttggaacctggctatttttacccaatccctgaactcctgttgctttcttggatatgaaagcttgccagaatcacatcagagttttcctatgcccttgttttgtgttccttctgagcttggttagtcacgtgcagccataagagatacaagagaggctcaggaaaaaacaaaggttattacacttgcaggtcctagagagaggagatattctgcatgggaagacacgattgtggtcatgaggcagaagacaagagtgagtgggaagcttagattacttctgtattggggtttttgaggaaaaggcatgccacggcagggagaatgtttgggattggttagtttgaacacttttggtgggttttctgctataggagtagtttctagttgcctagtacctggccctgggatgattaaggcagataaatactgtctcctgaagtatccaggccaaacagaggagataaggcttttgcttggttaatttgcacatcaaaggtatgctctctgacttttgttatctttaagaattagctagcccagggaaggcagtctctcccagttgtaaagtttttaaagacatcaaaacatcataatatacagaaaattaaaaaatatttacaatacagtccttgggacacatcttaccaaacagcctgctactaccatgggacacatacctctagtcagggaagtctctccagctccagtttgtcaactgtcttattcttttccattggcccttgttgccagtctcaagattccttgtgattaagaccacctgaatatgacatgatgcatttaataagtttcttagtctaaactaaaggtggatactgaggatattaaagctttcattatggttaaatttcactgttggtattagaatgtgctcaagtatcacctcttccaggaagacatccttgatttttctggtcagggttagtgaccctcctgtgtggtactgtaatatctctgcatatctatcttataagactcatcacattaatggtacacacatacctcgtggatacctggtttgtttccagaccacctcagtaaagcaaatattgcacaaagtaagtcacataaatttttttttgttttcccagtgcatataaaagtgatgtctacattatactgtaggctattaagtgtgcaagagcattatatctaaaaagtacatatcttaatttaaaaatactgtatttctaaaaaatgctaatgatcatttgagccttcagcaagtcataatctttttgctggcagagggtcttgcctcaatgttgatggctgctggctgatcagagtggttggctgctgaaggttgcagtggctgtgtttcttaaaataagacattaatgaagtttgtcatatccattgactcttcttttcttgaaagatttctctgtagcatgcaatgttgtttgatagcattttactcacagtagaacttctttcaaaaccaaagtcaggctgagcatggtggctcccaccagtcatcccagcgctgtgggaggctgaggtaggaggattgcttgaggccaggaatttgagactagcctgggccatatagcaagatccagtctctgcaaaaaaaaaaaaaaaaaaaaaaaaacaaacctgggtgtggtggtgtgtgcatgtagtcccagctactcaggaggctgaggtgagaggcttgcatgaacctcagcaatcctcactcaggaggctgtagtgaggtatgattgcaccactgcactccagcctgagcaagagagcaagaccctatctttaaaaaacaaacaaaaaatgaagtcagtgctcccaaaccctgctgctactttatcaactaagtttatgtaatatctaaatcctttgttgtcatttcaccacattcgcagcccattcctcaggagtagattccatctcatctcaagaaaccacagtctttgcttatctataagaagtcactcgttgtccattcaagcttactgtgagattgcagcaatttagcctatctttgggctccacttctaattctagttctcttgctatttccattgcactggcagttgcttcatccattgaagtcttgcacccctcaaagtcattcatgagggttgaaatcaacctcttttaaacttctgttaatgttgatattttgaccttctctcatgaattatgaatgttcttaatgacatctagaatggtgaatcctttccaaaagattttcaatttactttcctagatccatcagaggaatcattatctatggcagctatagccttatgaaatatatttcttaactaatcaaacttgaaagacaaaattactctctgacctatgaaatgatattgtgttatgaaatgctgtgaaatggatattgtgttagcaggcatgaaaacaacaatctccttgcacatctctggctcttgggtgaccagccacattgtcaatgagcagtaatattttgaaaggaatatctttttttctaagcagtagtctcaatagtgggcttaaaatattcagtaagctgtatatgctgtaaatagatgtgctatcatctaggctttattgctccatttatagagcacagccagaatagatgtagcataattcctaagggctctaggattttcagaatggtgagtatttgctttaacttaaagtaagcagctgcattagcccctagcaagagaatcaacctcttctttgaagctttgaagtcaggcattgacttttcctctctagctatgatagtccaaaacggcatcttcttccaatataagactattttgtctacattgaaaatctgttgtttagtgtagacaccttcatcaatgatcttaactagatcttctggataactttctcttgctgtagcttctgtatcagcatttactgcttcaccttgcacttttaagttatggagatgtcttcttctcttaaacatcatgaaccaaccgctgcaagcttcaaacttttcttctgtagcttcttcacctctcacagccttcatagaactgaagaaagttagggctttgctctggattaggccttgttaaagggaattttgtggctagtttgatcttctgccagaccactaaaactttctgcatatcagcattaaggctgttttgctttatcattcatctactcactggagtagcattttaaatttccttcaagaacttttcctttgcattaacagcttggctaaccatttggcacaagaggcttagcttttggcctgtctcagcttttgacatgccttcctcactaagtgtaatcatttctaggttttgatttaaagcaagagatgtgtaactcttcctttcatttgaacacttagaggccattgtagggttattaattggcctgatttcaatattgtcatgtctcagggaatagaaaggcatgaggagagggagagagacaagggaacagccagtcagtggagcagtgagaacacacacagctttgatcaatttttttccagcctacatcatgctttgaatacataatagtaatttaaaagtttgaaatattgcgagaaaattaccaaaatgtccagagacatgaagtgatcacatactgttgaaaaaatggcaagacctgcttgatgcggggttgccacaaaccttcaatttattatgcagccaacaaacatatgaaaagaagctcatcatcactggtcattagagaaatacaaatcaaaaccacaatgagatgccttctcacaccagttagaatgaccatcattaaaaagtcaagaaacaacagatgctggagagggtgtggagaaataggaatgcttttacactgttggtgggagtgtaaattagttcaaccattgtggaagacagtatggcaattcctcaaggatctagaaccagaaatgccatttgacccagaaatcccattactgggtataaacccaaaggatcataaatcattctactataaagatacatgcacatgtatgtttatcatggcactgttcacaatagcaaagacctgaaaccaatccaaatgcccatcaatgatagactggataaagaaaatgtgtcacacatataccatggaatactatgcagccataaaaaagatgagttcatgtcctttgcagggacatggatgaagctggaagccatcattctaagcaaactaacacaagaacagaaaaccagacaccacatattctcactcataagtgggagctgaacaatgagaacacagggacacagggaggggaacatcacacactgggacctgtcaggacatggggactaggggagaaatagcattaggagaaatacctaatgtagatgacgggttgatgggtgcagtaaaccactatggcacatgtatacctatataacaaacctgcacgttctgcacatgtaccccagaacttaaaatatatatatataaaaaaacacagtatctactaagtgctataaagtgaagcacaagaaaacaagctgcctatacttttatatttacatattgttgtctctcaaactaaaatgtaagctcctcaagggcagggcctctgtcataatccatctttatgtgcccaatattattcacagtatctggcacatagtgagaacctaacaagtacttattaaatagagaaaatgtgtagagggactaagaggttggtctccagagacagactggccatgatgtgcaaattccttaatctgtatttccgtttctttatctataaagtgggtacactaataggattgttatgagaattaattgagttataatatgtaaattgcttagaatatagcttggtacataataagcaatagatgtagacttttattgttattgagtgaatcagtggggaaagagtacaaaatgttacaccacatgggcccaccaattgtacaatagttgcttttgactcctgctgcctgaattcaagatttccctcacattctggaaagccccacactccaggatcctttgtttttaagtgcctgcagaatttgtactgggtgacacagttgtttggctccaatgagactaccctgctaatatttgtaaagggtgacctttcacaaaggaagacaattggcctgaactaaatagcattgtgttgagatacaaaaattatttgcaggggagaccagatatgggtgtattattaccacaacaccaggacttcagtccagggttctcctgctcaccacacagaaagccaatcactgagataatgagcattgccagggaagaagggtttgagtgcttcagccaaggagatgagagaccagtctcaaatctgtctcctcaactgcctaaaattaggggctcatgtggcagggaagaaatgtaaccatgtatgggaaaacaggaatcagggaggagtaaggaagaggaactgatcaataggaagtagatggtcagtgggcagttattatgggtgaggggtctggcatcccattgtccagatgtggtgatctggtaagtttcagttccttgatactatctgggagccctaatggtttcctgagaaaggaactcagataatacaaatataagtttttcaagttttaatactgagagggtcaatttctatatttattcaaaagaaaccataaacatcacttctatgggacaattgggctggttccagtcctgatctttctatttatcagttcctcaatcatggagaatatggttgtcgatctttcgggctgcttcatgctaaaaagggggcattgtgagcagctccataccatgggtaaccacgtggccacccaggaatcaaacgttaatttaataccatagttttcttctgtgatacaatctttatgtctccaatccactacttccaccaaagacaaatcatagcaggactaacctacctgaaaaataagcatcagtcccactatacttggcctgattacccatataaagtgcagcaagaatcattgtccatataggctcttctacattggctttgctggaacctctcacaaggaatcagattcaacctccaaaggcctctcaagcctagccaaggatccatctgtgtctacagatatttacatgaattgggtgaactcctctctttccaaggccccaaaagaacttgtggttcctgggcctgccaggaaggtgactctctacttaccacaggccaggaaccctgcaaaggaactgcatagacaaggtatgaggcatctttctaaggggttctcattggctctataaaatcaatgtgaattcctcaaagctgtgtgctcatatcccaaaacatgccattttagtccaagtcctagaaaataaccagtgcctccaattgtttccaaatataagagaaaacagattcttactgatcttgcaaacaaccacattgcaatgaattaagaacattcacaaagtttctgaattctggataaatctggcagagagggagaaatatgcctcatttctgtatactcaattgttaaaggctataaacagctcaaaagaaaaaaattctgaagactctgagaaacaaaacaaaaagaatcagtaatgtttcaaacaaaaaagagccatgaaaattatttcaatcctcctgtagttcaatccatgcaatcagctcttgttctgctttatattaggttagcagtctttatgaacacatcagcctttcaattagtgttctggaagttttctctctggtccaatggcacaatctccaaagttatcagaaacctgcaatcaggagtccttttcatgaactctcccaaggaagccctgggttgtagctgattataagctgctttttgagaagaatcaaagcaaaacaacaattgtggatgataaaaatcttaggatagctatagtcaaagacacaattgacaagaaagtttgattatttctgtggcatccaacaatttaacataaaaatcataatttttactaataacatattgagacatatcagaatttcaggaatctcatacaatcctagaacatgtctatataaatataacccaaagaaataatgctaaatgatgagttaatgggtgcagcacaccaacatggcacatgtatacatatgtaacaaacctgcacgttgtgcatatgtaccctaaaacttaaagtataataataataaaattaaaaaaaaaaaagaaagttaaacaccatcttggccaggtgtggtggctcacacctgtaatcccagcactttggtaggccgaggcgggcggatcatgaggtcaggagttcgagaccagcctggctaacatggttaccactagaatcttcaaaccagtacaacacttgtacatactttgttttcaagtacacacatgaaggcccaacaatgataaggtttgggatcaaaaatcactagaatgtctcactttttttttttactactacttaattcaagtgactgtcacttaatatgaataatggtaaacacagctaaagtaatttgagagaaactccagtcaatataattttctaaaggacaaggtcaatctttcctgaacattaaaactttgtacccatatcaagtttttcctcattttctaaaggaaaagatctgaaaccaactcaaattattgactaaattgaattaccttggaaataaacaccatttaaacatatccactcccatctacttttccaaataacaaaatattgtactatttctgttcagaacttataaaagtaagtcttttaattttgtccaagagctttataaactcttatagatcattaaaggaaagcataaccaatgctaatgatcctatagatcattagaggagagcaaaaccaatccaagtttaaaaggctggtgtgctctatcatttttttttttgaggcttgacaaaggtagcttaggaattttagatagatagagcaaatgatgaatgttggaaaaacatgggaaaccaaatggctatccatagaaccaaatgcaagcttttcattaggaactgaaaactcatggctgggtatagtggctcacccctgtaatcctagcactttggaaagccaaggtgggaggattgcttgagaccaggagtttgagaccagcctgggcaatataatgagaacttgtgtctactaaaaattaaaaaaaaaattagccagatgtggtagcatgcatttatagtcccagctactcgggaggctgcagtgggaagatagcttgagcccaggagtttgaagttgcagtgagctatgatcatggcattgccctccagtctattcagcctgggcagcagagcaagaccctgtctcaaaaaaaaaaaaaaaaaagaaactaaagaacatcaatgtatatataagtaatatgtatatataagtaaaacccaaaggagaacaaacagcaaataaatgaaaattaaaagcaaaaacagataaataggaagccccaaatttttctcttactcagataaccttggaggctacagtgttacccacagcctaaaatacaaaagcacgtgacggatattttgctcctgatatgcaaatgaatgttcttaagtccaccaacgcccctatacattttgtgcaattaagaaattcacttcagggatgtgaccagttaagtactttagtgctagtactatctatgcagaatagaaaatatagtgtgaaacaaatcagtgcaagcatttagtgaaatttggctccatgctaaatctggcttcgtgctcaacaatattaaaaaagaattgctggccgggtatggtggctcacacctgtaatcccagcactttgtgaggccgaggtgggcagatcacctgaggtcagaagttggagaccagcctggccaacatagtgaaaccccatctctactaaaaatacaaaaattagctgggtgtggtggtgtacacctggaatcccagctactcaggaggccaaggcaggagaatcgcttgaacccaggaggcagaagttgcagtgagctgagacagtgccactgcactgcagcctggatggcagagtgagactccgtctcaaagaaaaaaaaaattgcccaactgccatgtatttctttaaaatatttcttgttttactttatcaagactaagagctttaactatgagcaatgttaattagcccaatatctcaaattttctctcaggttttaaagaatattttactgtctaaacttccgtcttctctgtatgtgcatgaaggtagacacacagagaaacagaaaaaaaaaaaactacatatgacttacacagaacaacagaaggaccatgcatggactttctgttttgtcttaaattctctttatttttaaatagccagttattttattttaggacaaaaatttaccgttccaagattctttctcatacaaaattcttttttactttataaccttttttaaaaaaccgaaaatacatcttcatatccataactttcttcacatctctctcccctacttaccagttctattctaccttatttcataaataaccttttcaagcccataatttgaactaacctttagataactttttttttttttttttttttttggagacagggcctttgctctgttgtgcagtctgaagtgcagtggtgtgatcacagctcactgcagccttgacctcctggactcaagcaatcctcccaacttagcctcccgagtagctgggactacaggcatgtgccaccacacctggctaattaggaaaaaaaaaattgtagagatgaggtcttactatggtgcccaggctggtctcaaacccatgggttcaacttatcctcctgccttggcctcccaaagtgctgggattataggcatgagccagccagtaacttctgaattaaacaaaattattctttttctcagcaattttatatacggaattacatattacatattaactacaattcttattcttagtatccttaagttttagtgaaaacctaggaagcaagaatcctgaactgtcatataagatattagcattttatagataaggaccattccacaatttttggaaatatgtttccctgtatcataaccttttcttaattgggaattacctagacatctaatgaacatcaaaaatgattttaagattttaaattacatcatgccatttctatttcattcagttttttcatttttaacagttttacctagattacttatgagaactgagatattagacaaagctagttgtcatttccttgttaacaattttgtaacctgtgaatagcagtaaggtccttaaagttaactacatgggtattttcaccaatactcagaagactcagctatattcattaaaccaacaacattaaattagtcttatttggcaaaaattgcacaaagatcattttgttttggctgagtttatagctttataatcttctgtgccaaaccctgacacctcaaaatatctacagagacaaatacaaaacccagacaaaaatgtatgctgacaattccaaagtcacatctacttttatcttaccaataattttaaagctagattgcttattaaagatttacataagtcacatgaacttgaaacatgcttggatagatttaattatgagctttcttttatttataagccaatttggtagacacaacatataacataataaatgttacacaatacataaacatgtaaacatgatacacaaacataaagctccaatagcttttactttggaactctgtagccatgagatagtaatacaaactcaccagtttacaaacacgttcacgtggctacactttgtttaccctgataggtaatctaatgaaggctgagacccaaaattttgggtaaggtcgtttccatggcagtttgatttttaaaggccaaacctcctcatactccaaagaacactgaggtcaaacagcaccataaaacatcatgtattaaccaggcccgacccagcttagaacagcagcataaaagtctggatacatgaaattccatcccactttttctttaaacatcaaaatgaggcccatggaaaggccacacttctctagattgcaaagaatattggggcaaaatagtattacaaaagatcagtttataaaattctgatttcccatgactttattaacacacatatgtagacaatcatcaaaacaccatccaactgctgcagcaacaagccccaagcatgtccagactgaaacagtccaggtgcttttctctctcaattggttgggcttgtttaacctgcaaaaggaaactccttcagaattcccctaattgagaggagcagatcctgctgtctgttacccacgaaagacatcatctgtccagatgcagatgacaaatttcaaaggctgttcttcctaggtgatcaggaatgaagttggagccagcagtgatagtaccagagagacagagagagagagactgaaacccatctctggccaaaaaaggggttaggcagctgcctaggagggcttctgaaactcctggcccatgcattcccaataagggaaccaaaatctgttaccaaaacaccaggggttcagtctaggtcatgctgctcaccacacagaaagccaattactgaaatattgccagggaagaaggctttaattgggtgcttcgcttgaggggagaggagaccagtctcaaatccgtctcctcaactaaaattaggggtttatgtggcaaggaagaaatgtaaccatatgtgggaaaacaggaattagggagggaaaaggagtagttgggcaacaggaaataggaagtcaggcgatcatgacgggtgaggggtgtggcatctcattgtccagatgtgttgatctggtaagtttcagttccttgatactttctgggaggtcttatggttggtttcctgagaaaggaacccagatcagacaaactttttcaaattttaagcctggaagcttcaattctatgcttagtcaaaagaaaccataaagatcagttctatgagacaattgggctggtttcagtgttagaaccactcatctctactccctccctcccctgtggatgaggtggtaccatactgcagtaagcattgtgcttctcagaggaagtgttcctgaacccaagtggaaggctgggttataaaccttaccttatcctggctgctcagctgatggttatttgaatgggaaaaggcaaaacttctccaagaggataaaatgagataggacttatttctagagtgcttggtcctgtaaaaatctactggacatttgcagccaatttagccctctctgtttggctccgaggcctagaatgagtcctgctttcactataccagacatgaacatttctttacattttagtgtagagagctaaggaaactccagtggaatttagtaaacaaagaaaaaaaaaaaacaagaaaaaaaatgaccagttttttcagggcctggaaattattcattcttggggccttaggtctctaagaaaaagtttgcaaagcagttgttttagcctattgtttcccaaaatatgttcactgtctcctttttattcctttgaaaacttgggagtctcctttttattcctttgaaaactccgtatgtcaagagaagcttgacatcaggcaataaacaggtaggggatggggtaagaacttaaacgctgaaatgtttcccatgaaagggaatagaagcatcttctgttctttaaactcatccttccttttgatacgtgagtgctgggaagggaagagcgtggttcctttaaatgatatggaagcgggaagggaagtgttggatagcggaggacatggtccctggctagggctccacccccacggacctaggtgaggacaggcacttgtgccttcactcctaaatgttgcgtttcccaacaccaccctggcctgccatgcccccatcctgggcctataaaaacccgagaccctagcaaggcagagacagaagtggctggacgtggagcagagcagataggcggaggaagacacaagtggctggacggtgagaggacacggaggggaacacgccggcggaagagcattttgacagacacaggcactcaagcaggctattgaccagcaggtttaggcggagtttggccagggcagtcggaggagagcgcccgctgcccagcggcccaactccagggataaaccatctcccttctggctcccccatcggtggacagctgcttccactcaataaaactttgcacttattctccaagcccacgattcttccaaggcaggaacctgggatacagaaagccgtctgttcttgtgacaaggtggagggtctgattgagctggttaacacaagccgcctatagatggcaaactaagagagcaccttgtaacacacgcccactggggcttcaggaactgtaaactctgctgtggggtgcccaagtctgtatgctcccctagaggtttgagcagcaggacactgaagaagcgagccacacctccgtcacgtcctgggagggggacaagggaacctttcctatttcactttaagcgggcagaaatgagaaagaaatgacattttttaaatttttccttagctaacaaatgtagggtgtctgggaaagttagtagttcttcctacagtagtagaaattgaaaaaccttcactggaaactctactcccatgtcctggcatctgagaaagttacctgctttacttgatgggaaaccttggtctacaggaaagtttgctgatgaagaaaatttcagaaagggggagattttggggttggcaggctcctgtgtaggaaacagttaacattctttaaaaaaaatttcactctgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgtgccactgcagtccgcagtccggcctgggcgacagagcaagactccgtctcaaaaaaaaaaaaaaaaaaaaaaaaaaaaaaaaaatttcactctgatatctataatcccaatgcctttgtacattatattgttctctcacaacacctagctcttactcatccttcagactctggaaattttccctgatctctctgcagaccacattatgtgcccttatcatttttttccttcctccctcccttctttccttctttctctcctttattttttcctttctttctgcatttcctttatgtacacttatcacattatatggcagttatttgttttatattcttttctagtagactatgagcttctaacacaaggaactgcacctatcctgttcaatttataccactgcaatgttgagatgtttgttgaatgaatggattaattaatgaacaaataaaggaatggacatataaccatctttgcctgtttgtgtttcgccctgagatgagcatgtgagtgacaggatttctgggaattagtggtgttttctctgatgtaatagaagagcagacccaaggctcagaatggcacgttttattctgtgacttgtacttgccaacaataggaaccattataattttactggatttctgagaatcagcaacatatgtgtgtagtaaaaataatgacaacaaaagcaaatagcctgatgaaaagagtccttagcatgcaggagtcttcccactctgatttacccttgtggtcaggtcacgcttccaaactaactcattgttgcctcaaaacattcatcttaagtagtatggatacaatgcaagaacaaatctgaatttcttcaaagtaaaaatgttgatcaaggaataaaaaaatggcaaacaaagagacttgaaacattgtgatggaagaatcatactgtatcaaggtgggaggggaagttatttttaaggaataattgagggtggtagagacttgggaaagaaaaaaaaaaagccaggatttcacatgggagtgcagacaaattataatttactaagagaagttcaaactgctgacagtattgtcacaacaaaagtgagtgattgccatatgcacagaacttaccggaagaagtgtagcaagccccttgatacaaagtatgcatatgaggacaagtaatccttttggacagggaacatggtgtcttccattttctgaagggatgcagggaccacagggaagaaagtgcagaggcttcactgtcccagacctgaactacagaaccaagcaggtgctggccactaagcagacataagaatgtgaactgagaactgagaagacatataaataaatgtttcctaattttttgtttgttttgttatgaaagcaaaaagggcactgcagaaatgataagggacagatgatttttaaacatctagtctcgttataaaatcttgtcacaccacaatcacaatgactgtgggactgggagaaacttgtcatttgccatctttaactgaaagcgatccaatagtcccatagacagttcttatggataaacatagaaattaacccttctggtcttaaagcttgaaacttacatttgttatttcttttttccttttttttttttttttttttgagatggagtcttgctgtgtttcccaggctggagtgcactggcatgatctcggttcacacaacctctgcctcctgggtttaagtgattcttctgcttcagcctcccgagtagctgggagtacaggcgcatgccaccatgcccggctaatttttgtatctttagtagagacggggtgtcaccaaattggccaggctggtctcaaactcctgacctcgtaatccgcccgcctcaggctcccaaagtactgggattacagatgtgagccaccacgcctggcctacatttgttatttctgagttcctcaggagaggacctccagtcttctcagaaggtatcaaataactgaaactcaccagatcacagcatccagacaatgagacgtcaggcccttcattcattatgattgcttccttacccctcctgactttgttttctcatacattattacattttttccttgctatataaacccctaattttagtccctcaggtagatggatttaagactgatttcccatctcctcagctgcagcacccgattaaagccttcttccttggcaatactcactgtctcagtgattgactttctgtgctgtgagcaacagaatctagactgaacccctggtgtttcggtaacatattccatcttctaatgctatttcttctatatgccttaatggttacatgtttcttgtacagtagagaaacttctatggtgtatatcaccacttaacttcttattttttcagctaaattaaccagaatgcttgtgaatgcagtgcactgatttaattttctgcacacttatgagatagtagcacacagcccataggaagcacttaattgatgtttgttaaatgaatggatgagtaacttatgtgaaagcacattctctggctcaagtagttcaagttacttccaaatataggcagaatttgaggatataggcaatgaagagaaaagcccatggattttggatgtaaacaatttagtttgaacatgggtctgacatttactggctatattaccttgggcaagagttaattctctaagtctcagtcttttcatctataaaatgtgtataataatatccttatgggaagattgaatatacaatttatatgaaccatttagcacaatgattggcatatagcaaggacttgatattatttccgtttttcttcactttagttaactcaggattgtcaaaaccacttgagatttggctctttgaaaatagtcttgaatagactggaagtaatatggaaaattgttaacatatgttaattccaggtggtagtaatagtaccatgattatatatatttgtgcttttctatgtctttaacagttctaaaaattaaacacataaaaaacaaagcattaaataaaatgacagatattattaaataaaacatcaaaaataaattgattcctacctttataaatatagaatagggaattgagtcattcagttgagttacatttgttgagtaactactataaacaagactgatgtggagcttacagttcagtggggaatacagatttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccagattttttttttaaaacatgtgatcagagcaattgaaaggaaatacaaggttgtaacagcacattatgcggcacattttacctggatttaggagattcggaaaagctaagaggaattaatgatgtgtaggagtaagtgatgtataaactggcaggcagagaatgaacaggagtgagggatggaggcggggagtgtcccatggacaagaaaaagcacatactagagactacagggaatggagaatgaagaatagttcaatatggatggagcatagggttcaagatagaaggtgggggacagacaaggcttgcgaagagggcaggggtctgatcatgaaaggccatgaagctttgtacctcctggggagagttcatccacaaaaacatgacccccatctgtcactgttagcgaggtctccattttttgtactaatgttgtggtgcttaggaagcaataattcagtgcttgaagtctgatggaatgctgtggtttctggggagcccagaatcatggtgctgctatttttaatggacagaaacttactgtatttcaagtgaataaaatgagcatagaggttttgtctcctacacattttcaacctaaggacttttatagatggatcgaagctgtcctgagccaaagtgtatcagttctgcctaccatcagcagaagatattagcagtggtttgtttaatttctttttggactttcagagaaacagacttgaagatagcctttgggaagctaacttgtaagtacataagctttgtaatacaaagttaactttatcttaattttcgtatactgctgacattttcttgcatcagatggattatgtttgtgtcccggatcttgaggttagccagagtttgtaaaactaataaataattttacaatctggaagatttttcttttaacaaaaccaatggcatgtgtccattatcctatggagctaggacaacttgagtttggtttggagaatctagaacacagttgctctggggcagggatgaaggaggattacattctaatgacagtcatttgcaatgtctcatcgtgttcaaacataggacgattacacaaggtttcataatggaaaataagcggtccagataattcagaatacacaaaccatttggtgaccttgcctgtgactcctcagggagggagctcataggaaaactgatgatctgagattgtgatttgcccaaagttgcagaataacattatactctaattcccaactgttgctctatggacttggtttttacaattatctaagattttcaaagactctaagctttgcaaactctaattacatgacaaagttcctggccattagcttttaattttagagtatactttttattgtcgtttgagttttatgtactttttattgtcatttgaattctgcatgatgatagtcttcctttccttcactccctaccctgatcttcctttctccccaaccctattgatactgagaaaattaacatctcatttggaagtgggatgtttgaagggatagattatctttacagtttgtttcatgtgtccaagaaaatttttaagctgcagctcggggtagcatttttctttcctccagctctgtatttttttcttatttaatgtgatcagtagttcaaagcaggatctatttatttttggctcactttccacctcactggttgtgacttttagatgtgtatgtggattttgttctcacaggaagatctaaggagaccctgttataagcatgggttaaccgccataaggcacagctggtgcaaatcagcatgatgcagcatagcttagggttattggcagcgcttgtgtttagaattatacagtaaagaagaaaaggggctctgtactataggataggaaagaaggaaaaatctagcgggggagaagggaggatatcaaacataaacaggagagggaagacataaaagagtaggggttttcctagtgacctcataaacaagtagtatggggaaaactgtatactatgtaaagttttactaaataaaatgatgtttatatataatcctttatggtttcagggatttgggacaccttattttatatgatatgtttctgtcctttatgggggtaaacagagaaactgtggggaggcttgatagcccatggagaactgggagggttctttaaagaagttggggagaatggaaaatctaggatgggaaaaagggtctggattctatattccaaattctctgtcctcagtctgatttgatgtatgtcatctatggttcagctacatgtctcaggttttggatcaaaatatacatggtcagcataagtctctctgagcagattgacatattttcccagatcattacaaaagagggctcatcctttagggaattgtctgcatctttcctgaggcctggattcagtgctcctttgaagacaaatgggccgtgataggtggagcagtttctgtaagagatggtcctgtgccaaccccctggcagaattgtacacctggcactggtacaactggtgctccgcttagacttttctctcagtctttcatggacacctattaggtggctgggaggaagaaagaaggggaaacttcctcctcccctggaggacagactgctatcagtaaggaagctgtgtagctgttcattagaagtggtgattcttatttggagcattgcaaaatttcaaaattttcccttccttccttccttccttccttccttccttccttccttccttccttccttccttccttccttccttccctccctcccaccttccttcctcttctttctttcttatagtcttgctttgtcgtccaggctggaatgcaatgtcacccaggctggatcttggctcactgcaacctctgcctcctgggttcaagaaattctcctgcctcagcctccttagtagctgggatttcaggcatgtgccacctcgcccagctaatttttgtatatttagtaaagatgaagtttcaccatgttggccaggctggtcttgaactcctgacctcaagtgatctacccacctcagcctcccaaagttgctgggattacaggcatgagccaccgtgcctggccaaaatttctttttattatcttgagatcaagacgtgctcaggtttcacgatgagtgtgtaagatgactctcgatgctaattctaggacagtgtgtgaggtagcccccacagttaattctgggtcaaggtgagtgtgtgagatagccccaaagtttgctctaggtctgggtttgtggattgtgttggaaactttaaaaaacaaggacttgtgtagaagtttgaggaaagatagtttgtaaatttgtatctttttttttttgaatgataggaaagcatcagtgttgagttctgcaagccaattgaaaacagaaggtattttatgcatagtgtgtgggtgaagaatgtatttgtgaaggaggaaatgggtcaattgaaataactatcaattcataaaagagaaaatcagtatctaattagcatgaagaatgctcagatcaaatagtgtctaaaatgttgattcagtttagttttatataaaatacttagtgagatataaaggatatagaatttgataaaactcaccttgattccagtttcctccctgggagaatacctgtgaatgggtgcaacattcttaatgtgctgggtgacttgattttttgcaaataattattttggtggaaatgtgggttcataatgtttctaatatgctttgcgtcatttttcaggagcatgataaatttgaactgttacatctattttactttggagcagtcctccttgtcgtcaagggcatccatttttgaaacagctgtttggattgagggatacaggatgtggccataaagtagatcaaagttaattggccctcagggtaaacaagctcatgaccttggcctcattagccctgtgctgtaactagctgaagtaacctgccctgggcaggaagtttgcttccctgaagaagcttcagcatttagaaattatccaataagtcttctcattttgccaacctgccctcttctgccccagcactgaatgcttggatggtgagtgagaagagggggagattcagtgctttatgggattaccatcaggtaggaaaaaaaatgttaaagtcatgcttattttataggatttgtatacaggcttgaggataggttttggccaatagaaagcctctacatgtgtcacaacaaaaggtgtatgataggtgatactttcagcgcggtggactcttttgagtctcagttttgccttacctcttcatactgtctggataaataatgaaatatgccacaatagccctgaccatgaaatggattaatgaagctgcagttcaagactgtacacaagagtaaaagacatttttcctttcccaggcccaagaaaacaaaggagtcatgctgttccgtggcaatggagccaccagcagctcctgaaggccagttctctgcagctggtttatattcctcacacttcagggcctattgctaagtaggtttgtcaacatttcctccaagcacctcttttctagcctttccattggccagagggatggggcagggataagagtgatccttccgactttatggatagctaggacattttggttcttcatactctcaggcatggactagttcctcttatcaaaatctcttttctgaagtaaaataagtagaaaaaaatcaaattcaattgaaaacccagatgaagcaattattactcttcttttttccacttccttctccttcctaacacacacagtaaacatttttttggagagatcaatttcttctatgtagactggaatacttcccccttaccttagctggctgaaagtattatggattgctctgctaagaactctctttttcttccctctttggccacatacccagttgctattgaaaacactaacttagaaacccattaaaatagttatggaatatttattaagttttttaatactgtggagtataagaaacctaaactaggccccggtttttctcccaaatgccactccactctgttaagctatttctccaccccatctgatccatttactgaaagttaaccactgttaaccatttctcgagattctttacagaagaaaaaaatcatgcatgtacctgaatgtatatatgtacccatctctacatatatgtgtgtgttttaacatataaggtatcatagtgtacatgtcattctatacctggcatttttcctttaatgatgtgtcttagaaatcttttcatgttggcacacacagatccatctcattctaactacacagtaatccattacatggatgtgccattttcatttaacagtctctatactgatggacatattgatgtatttttaaaaccacaacaaactgtgctctaaaaaggttatgcccatttgcactctcaagagtataaaaatccattttgaatagatagaaaaataatattttcccagactcatgtagctggtttctgattttattcctaaagtgttttctgtgttctagtttatgaacacctgatacataaataagtgatgttcctatctagctcttaagctaatcaatagaataaatcttctttcacaccttacaagttaatgttcaccctgtgcttggccagaaaaggatgtgggttctatgaggattgtccaccgatggcactctgtccccagatacctgccacaaagataccagggctccaattccagaaaacatagcccaggaaacaggactttactattccatctccacccagacacgtggtattttgagaggttattgccaactctgctgcctttacacagacccatcaaatttgtgaggcaagatagaatcttttttgctacttctaaaggaaactcagtgcgttcatcagggaaatggagctcattacatggacagggaagctgggaggaataaccacttaaaagcactttgaagcgtgttcaatcacagttaaatgcttcttcataaaacttgatttttgaggtctgtttggcatcatagaacttgcaactattgtgtcttcataactcatggcctgggatttggcactacatatttttatggctgaacaggaatagtataatacacatgagagctactcagatatctaatattacagaataatgcagaagacagaatagatattgtggtgggtggattataattattttatttttgttggtaatgtgctctaggtaccatgcagggatttggtgagattgctgtcatattttctaaagtatctggaattcctaagaggaaagctggaaaatgagtgcaaagtaatgatgcacagtctccttaactctcctagtgccatgggggtgtagacaatggcaaaatgagagggtagtcagacgtccatgtgtagatctcactgctttacagggaacaagaggctgagtattgtactggatgcaagaatcaactttgcccaccttaatcataaacagaaatatctagttctccggcctgaaccttttccactggtactgaatttctaaagataactgaatttctaaaagataaccgggggagggtagagctgcattcccaggatccttgagtttcctatcaatgaggaaagctgctgcttatttgtggacccagtgggtgccaaaaggaagaactgaagggatttctactgggttactgaatttattccagctccgttttggggaactctcaaaccttggggtgaggagtgggggttcccagatgaattcaacaagagagagagggagggggagatgggaagagataagttcaaatagacaggcaaagggaagaaaataaggaacacacacacatacatatatataatgatacttagattggcacaaaagtaactgtggttttgcattgaaagtatagcaaaaaccacaattacttttgcaccaatccaatattattacctaaggactcacagagatttccttaagtccatagggacaggagcccttgccctccatgcttcaggaatgatttgattaaggatactaaacaggcatgtgacaatgtgagcttgctcaataataatccttgatggactattactcattttgtgaaattgagccaagtctctctttcctgctccccctttctccttatttccctttcccccagctactttgctttgctaagtaatcagacatggatcttattcccaagatatttatattcttagggaaataagacatttaaaataaggaagaatgcaataaaatctataatggaaacccagctaatgagccacaggagttcagaggagggagatgtaaccagttggagtggggaggagattatggattgtcatatttttgaatttaatatttattgtgaatgcctaagttaaataggaatggaatgggaaaaagacttttccagggtgtggagttgtcaggaataaatcagggaggtctgcagtcttggggcatgaatagcatacaatgatgagattattctgagtggagtgaagggtacacaagcatattaaggaagaagtttcaatggtgtggtggggctctaatctgcagggccttgaatgttcattgtcatagctacagataattgttagaaatagcctggtttgctgcaaaagacagggcaaactgggagggaccagatctgccctcgaggattgatcaggaactgtgaggaagtctaggctggcagacaaggcattagaagagatgtgcagaagaatatggcgatagatgacaagcggtcacccagacaagttggtactgagaggtaggagacaagtctcaaggagggaaggtgcctgatactgggaaatacaggaacaggtggcacttagaagtgtaatcaagactgagggaataagaaagtctgtcagcagttagcaggctccagccgctatgctcaggttcatgggcagacttccaagctctgggaggaaacagcagaatggaaagcaagaagctgggccccagccccagagggaccaggcagatttccaagccaggagtcagacctggaacatgggcctgactagcagtaagaatggttcaatactccattccagagtgctgagccaaagtcttttaatgccttctgcttaaggttatgactgaccttcgacgctgggtttacaggtgggagcagagcggtccagctgtttggaggggaggatgcagatactggagaaacagtcagggttcactgctggctaaagagtctaggccttatttagtgggcaaaaggagaacaatggaaaaattaaaacagaggaatatcttaattggagctgtatttcaggaagatcaatttgatcctagtgtgtaaaaggaaccagagttaagtgagtcctcacctgtaacaaatttcggccattctccttcctaagcacttctccagtgtgttcacttctctgcaggcccccttctaatactgtggcataaactatatgagtaaaattcatacaattaataaactaataaaacattaatttcacgtgtttcttttcattcttttcatgtggcttctggaaaaagttaaaatttataagcggctcacattatttttcagtggggcagtgctgctctaatcctttctccatattgcggttagaactttttaaaatgcaagtcttctcatgtagctctactgcatgaaatctccccataatctccattgccccaggataaagtctaaattccttagcatggcccccaccctctttgtcatctggccttagcccatctcccattgcactaatccttcaggtgtatcaaactattttcggtccacccgtgaaattactttgtattctttggcatccatgcctttgctcctgccattccttcgcttgaactgaatatttctcccctttttcatgtgttaacttttgcctcctattaaggtctcagctgtaggcatacctgactccttgactgtggattaggtgcttctccttgatgctaagggccacatcctgtgcctgctctactatagcatttctcgcattatttttgaggtcctattatctttatcctctacctagactgcatgttctttgaaaataggaactctgtattgatctttatgtcatgtccagcacccagcacagtacctggagcataatagctgcttgcatgattgtatgaatgaatgaatggggcagatgtgctaggtgaaatgaacctgaaccagcatagtggcattgggaatgaaaaggataagacactcatcaagaacgtaatttgtgagtgctggcaaccatgtaaattgacctctaattactggttgggtatcctttattcaaaatgcttttggccaggtacagtggcttacacctgtaatcctaacactttgggaggataaggctagaggatctctggaggccaggagtttgagaccagcctgggcaacagagtgtgaccccatctctacagaaaacttagctggggatggtggtgtgtgcctgtagacacagctacttgggaggttaaggcaggaggatcgcttgagcccaggagtttgatgctgcagcgagctgtgattgcactactctactccagcctgggcaacagagccagaccctttcaatcaatcaatcaatcaatgaaacaaaatatggaaaatgcttttgtctaggcacagtggctcacacctgtaatcccagcactttgagaggccaaggcaggaggattacttgagcccagaagtttgagaccagcctgggcaacatagcaagatcccatctctaaaaaaatattttaaaaattaactgagcatcgggatgtatgcctgtaattctagttattcaggagactgaggtgggaaggtcttttgagtccaggaatttgaggatacagtgaactatgccactgaactccaacctgggtgacagactaaaatcctgtctctaaacaaacaaacaacacacaaaaaaactgcttgagaccagaaatgtttcagatttcagatttttaaaatattttggaatatttgcattataccagttgaacatccctaatcctaaaatctgaaatctaaaatgttccaatgagcattccctttgagtgtcacattggcactcaaaaagtttcagattttgtagcaatttgggtgccagaatagggatgctcaatctctactaatgagtatgaagaactaatgcaattcataaaatgccctaagtcctaaataatattaaaaatagcaatgatgtggacaaatgttctaaggaaaaaagaaacattctttttaaagtattctgatacttggagtcaaaagacaggtttaagactttggtccagcatttatgttgtctgtagtcttgatatttcagttttttaggtcataaaatggagacagtaatacctctacatttggggctcattgtgagtattaggggaatatatgtagaagcatcttgcaaattgaaaagtgacagaaaacactagttattgccaatacaaaaatatttatacctgcaagtaggtgataaacatgctgtagtgattaaattgtacataatcgggacctgctcaaataatgtaaatctcaaacaaaccatcctagcacagaggaacgtggacaatttacactttgtcacatgacattccatcaatacaactcatggaatgagctaatgagagagtgagcaagaggtggcttgattgggcgccctccttcccagtgcccggtctgtgatggcctcacatttgacctctaactgtggctcacactattcactctgcttgcattgctctcttcttcactcctgcattgcttcactaaaccccagccctaccaccttaaaactctactcacattttaagtctccttcaggatgccttaatggggtacgagttctttgtctgaaggctcacagcattcagtacttctaaagttgtcttttttcctctctcaagagagatcccaatatcgtcttctcttccatttcctggtcaaggatagcactaacacctaagtatttccaaggtgggaattgaaagaggcctttccatccagcctgtattcctgtccccagacatgtgccagacctgtgctaggatggctgaattaaatggaacaaatgataacattagcatttgaatttggaatttagggtcaggatggttccatagaagctgctatagtttggatgtttgtcccctccaaacttcatgttgaaatttgatccctagtgttggaggtgaggcttaacagggggtgtttgggtcatgggggcagatctcttgtgaatggcttagtgtcatccttgctgtagtgagtgagttcttgctttattagttcccacaagagctgattgttaaaaaaaacaaaaacaaaaaaaaaagagcctggcacctccccgctgtctctcttgcttcctctctcaccacgtgatctcttacagctccccttcaccttccactatgagtggaagtagcctgaagccctcagcagatgcagatgctggtggtgcatctgcagagccatgagtcaaataagccttttcttcataaattacccagtctcaggtattcctttatagcaacacaaaatggactaggaaagaagcccacactcacttgcttcccttttacctgcttactttgttcattcccttgtttgtctcctgtactagtcagggttcactacagatacagaaataataggaatatatttaattgggaattggcttacatgatcatggaggctgagaagtcacatatctgctgtctgcaaccagcagcgaaattcagtctaagggcctgtgaatcaggagagccaatgatgtaaatcccagtccaagcacattaaaagatgagatgagatgtcccagctcaagcagtgaggcagggaaaaatgggacaaattcctccctcctctcttctgttctattcagtctctcaatggattagatgatatccacttccattggggagagcaatctattttacagaatttactgattcaaatgctgacctaaatccagagacatacctagaaacaatgcttaatctggacactcattggctcagtcaagttgacacataaaattaaccatcacacctcccttactttagatccaggagcagtatgtatcatttagtactttatgcacagtacatgttctgttgaggtcactaaaatagttatttatttacctggcccttgacagaggattatttgaaggattatgggattacataaaataaaacaaaaacaagggacatacacacagtatattatactattaaaacaaattagtgctcaagaagagaagatgtagtgctattcttatttaggaaaaatatacagtattagcctatttgacatgtgtgtgaactaggggggcacgtccaggattctttttaatctgtgctccctctaactctccaattctgtcttctctgcctagattgctctcttcccctacccaccccttccactacaacttctgattaattctgcctcatcttttggatgtcacctaagagattgttttctttgggaagtctttcttgaattctatgggcttagcctgtatactgtaataggaggttttctctcaacatttatcatatggtagtgtaagtgctttgtctgtttctccctctaatccattagcaccatgaggcaggtaccatgtctgtcatgtagaaagttagttctaccagctgggcatggtggctcatgcctataatcccagcactttgggaggccgaggcgggtggatcacctgagatcaggagttcgagagcagcctggccaacatagtgaaatcctgtctctactaaaaatacaaaaaaaaaagttagctgggcatggtggcaggtgcctgtaatcccagctacttgggaggctaaggcaggagaattgctcgaacccgggaggtggaggttgtagtgagccgagattgtgccattgcactccagcctgggcaacgagtgaaactctgtctcaaaaaacaaaaaacaaaaaaacaaaaaacaataacaaaaacaaaaaggaagctctaccatgtgtagcacagtgtctggtatatagtggtcacaaaataaatattcattacataataagtaggcaaaagccagagcaatttggaatcagagtatatcagagtaagtcttagtatattattataagcaaggctttggctaaatggctcctttacctctactgatttctgctctatttaaccaggtatattaattggaatataggtttggctgcttgtcacagatctatgccagtttaaacaagaaggaattttctttgtcacaaaacaatccagagataggcagtcatggacaggtatggcagctttgttctttaggatattaggttggtcaaatgtaattgtggtttttgccattaaaagtgatagcaaaaaccgcaattacatttgcaccaacctaatagtcagaagcaggcttttacttattttttttttgagacggagtctcactcttgcccaggctggagtgcagtggcatgatcttggctcactgcagcctccacctcccgggttcaagcgattctcctgcctcagcctcccgagtagctgggattacaggcacccgccaccacacccagctaattttttttttaattttttggtagaggtggggtttcaccatgttggtcatagctggtctcgaactcctgacatcaagtgatgcacctgcctcagcctcccaaagtgttgggattagaggcgtgagccactgtgcctgggctccaggctttttctatcttgatgctccaatatcctatgatgatgccctcgttcccatggttcacagccatgacacaatcccagtaggtccacttttgtcctggaatccttggaacctacacccaaagccagtttaatttcttttgggtacctgaactgatttgaggaccttctggaccatgtaaggcagcttgagtctggtatggatttatagaattaatcaagttgaacaatttctcactgcttgtctaatccatgccttaccctcaagccttctcaagtgggaaagactaataacttagccttagttgggtatgtatgacaagaatgccagctggttcttatgccaaggtcaagcagccttcaaacagggtggtatggtttcctgaggcacaggatacaataagttaacagaagggcattctaacaagttataaaagagaaattgcttggaacaatgttaactatattatctagttagctatcaggaaaagtatagtacttatttggctataaggttgccacaaaataccattgcaccattatttctttacaatgcctttctgttgggtttatgttattctggaaataagtcattaattcttattacagaagtttgaaatgaaggccagcccactctatcagttctcccctcccacgatatatacacacatagcacagatagcacatgtatgtgtacacacacacacacacacacaatctctggagggaaggagagaagagagaggaaaatgggagaagaatcagggtaggggtgagagctgggtgcagctttctagagcattagctattcactcatctagaagacgctgaataaacaaaagtaactactccttcccttccccctccccaaactaaacattttcattctgtagacctcactttgtgtcctagacaaaacaggatcagtgtgggtcattatgagatgattctgccagtttaataggaaaataacaaaaagcaaagatctgtctaaatttgttcttggcaaaggcaacatatgagatattatctgatttttaaaaagacgttatctaattgatatacaatccacagttgattttctaaagtggtaaaattcacttttctttgtgttttggtgtgtctctgtgtgagtagttatatttgtagaattttggttaatttttgttacaattatatttccattatatatgtttttcttttctttccaccttctcaaaagttctcctttaaagcagaaactttccattcttggtttcatccaaaagacaaatatttctgggaaaacactgtgtttaagctattcagcaattctagtgttatgtaactgaccacactaagacttccaattaactttggttgtgttttattgaagagtgtcatagaacagaataactggtgataattttttaaaacttttctatgtttttaaacagggaaagctctcttaaaatatatgcagcatcttttgataagtgtggaaggtaaatctcctgtctgaagtattctaaagtccattgactgtattccaagactgatgctaatctgtctgacattgaggcattaattttcataactcaagttcttcttgctcttctttccctcttgctcgtttccctgattatttttgtttttccttcttcaatgatgagtgcatcttgagactctttttagactgcttctcttcaaaataagaatcatgtgaattcatggtttcaaataatttcccatgtatatgtatgtactaacttagaagtcgctttcttcatttttaatctttatctctcctttctaccactcttcaatatatccaatttctttatccccagaactgagctgatattttttccaaaagcctcataccttcccattttctctttatttttatgtcctcaccacaatcccagtggtctagtcttaaaaccttgcagttttgtggggttttttttttgtttgttttgctttactctgtcatttacttgcaacatgctgcctattatcaagttgtgatgtttatttttcctaaatatcactcggattcatttctttatttcaaaaccctgatattgcctcactcagcctaggtgataattatttggtgtgtacattactgtaatatcctcttttatgtcctttttctactctaagctaacctatggataagtatgagaatcgtcttgttcacagatgaggatactaattttcaccacttttattcaacgtagtagtggaagtcccagccagaacaatcaggcaaaagaaagaaataaaaggaaccaaactggaaaagaggaagtcagattctccctctttgcagacaacatgatcttatatatacataaaccaaaaaagaattcttagaactgataagagaattcagtaaagtttcaggatacaaaatcaacatacaaaaatcagttgtatctctatatgctaataataaactagctgaaaaagaaataaagcaaccccatttatgatagctacaaaaaatacctaggaataaatttactgaaggaggtgaaagatctctgcaatgaaaattacaaaacactgatgacagaaattgaagagaacacaaacaaaggaaagacattccatgctcatgtattggaagaattaatattgttaaaataataatactacccaaagcaatttatagattcaatgtaatccctaccaaaataccaatttttcttccaagaaatagaaaaaacagtcctaaaatttgtatgtaacaacaaaagagccagaatagccaaagcaaaaagaacaaagctggaggcctcacactacctgactttgaaatatactacaaacctatagtaaccaaaacagtatggtattggtttaaaaacagacatatacaccaatggaacagaatagagaaatcagaaataaatccttgtccctacagccaactggcttttgacaaaagcacaaagaacatacaatggggaaaggatacgctcttcagtaatgtgctgtgaaaactggatgttcatatgcagaagaatgaaaccagaccccatctctcaccgtgtataaaaatcaacttcaaatggattaaagacttaaacataattcctaagactataaaactactagaaatgctttaggacattagtctgggcaaagattttatggctaagacttcaaaagcacaggcaacagaaacaaaaatagataagtgggactatattaaactaaaaacctctgtacagcaaagaaaacaatccacagagtgaagagacaacctgtagaatatgagaaagtatttgcaaactattcaactgacaagggactaatatccagaatatataaggaactcaaagaactcaacaggaaaaaacaaaacaaaacaatcccattgaaaagtgggcaaaggctctgaacagacatttctcaaaaaaagacatacaatttgccaacaggtatatgaaaaaaaaatgctcaacatcactaatcatcagggaaagacaaaaaagaatgactattatcaaaaagacaaaaaataataaatgctggtgaggatgcagaggaaaagaaactctaatacagtgtaatggaagtgtaaattaggataaccattatggaaaacagcatggagtttgtaaaaaaaacaactaaagaaagaattaccatgcgatccagcaatgtcactactgggtatttatccaaaggaaaggaaatcagtatatcaaaggaaattagtatatcgaagggctacctggacctccatgtatatttcagcactattcataatagccacgatatagaatcaacctaagtgtacatcagtggatgaatgggtaaagaaaatgtggacacacacacacacacacacacacacacacacacacacgaatactattcagccataaaaaaatgaaattctgttatttgcagcaatgtggatggaactagaggtcagtatgttaagtgaaatgagccaggcacagaaagacaaatattgcatgttctcactcatgtgggagctaaaaaaaagttaatctcatggaaaagaatagaatgatgtttaccagagaggctggaaaaggtggagagggggatgaagaagaggttgcttaataggtgcaaaggtacagttggaaggattaagttttagtgtttgataacacagtaaggtgactatagttaacagtaatttattatatatttcaaaatagctaaaagattatttgaaatgttcccaacacaaataaatgttaaatgtttgaaatgatggatatcctaattaccctgatttgctcactgcacattgtatgcatttatcaaactatcacatgtacctcacaaacatgtatcaataaaaaagtcctcttgttcacactgttcatttatcttttaagaaaattttttaaaaatctgccaactggctactttattcccacctcatttacctgaactatatggtccacttctccaaacaaatatcatctctttccatctcctttcaacatgccatttggaagactcctctttcttcctccccaaacatatttctctatttcttcaaaggtggtggttaacacagccttaataaaagctgaaattacctggtcctttaagagcgagtaccacctgactcattttctcagtgtctcagggctacattgttagtctgccctgctctctttatctgtacttgctgatgtgtggctttgtaacatcatgtagtcattttctttatgccttttctctgcttttagagtacaagcaactttaaggtagagacaatatctaagatttatttatatcattcaactataattactaagtacttgctgattttgtttttttgagacagggtcttgctgcattgcccaggctggtgttgaattcctgggctcaagtgatcctcctgcctcagcctccctaagtgctgggattacaggcatgagccaccatgtccagccacacttactgagtttatagcatggtatctatctatatcaaattatttattgagcatctgctatgtgctaggcacagtgtgaggtgctagaaatacagtgatgagaaaaaactgacattacccatgctttgatagagttaacagtctaatgggagaaacgggagaaacagacatttatcaaataatcatacaattaagtgtaaaattacaactgtgatagagctacaaagagaggaatatggtactatgagagcacataataggggtatttaactgaggtgggagaggagaacagggaaggatgtcccaaagatggagaaccacatgagcaaaggctgtgtgaagggagggagccagatatgttcaagacattgaaagaagactggggtggctggagcccagagagcataggtagattagaggaaggaagctgaagaggcaggcaggggctaacctgggcaaggccctgtggcatatgaaaaggctttaggcttttatactgagcaatgaggagccactggagggatttaagaacaggaaaggatagtatggggttttgagaagatcactgtggtcactgtgtggaggataaattaaagtgggcaggaaaatcaagcttggtgtttttctatgttgtgtagcgactcagtaaatgttgctcattgactgaacagtttgtggggcttatagttcttgctgtaatctctatattatgacgtttggcttcaagctaaaaaatcttgagctactcaaaatacgggtctaatttttaacatagtctcctaagcatttgcaattcattgacctaacatgtagtagtaacagataataacaatgatgatgatagacaacattatctagtatctagagtttagtatctagtgtctagataatagaaaacattatgtatgctcctgagcactgtgctaaaggcatgatgtcaattatcttaattaattcctactataagccaatgaggaaggtgtttgtattcctatttttttttttttttttttgagatggagtctcgctctgccaccaggctggagtgcagtggcgcgatctcggctcactgcaacctctgcctcctgggttcaagcaattctcctgccccagcttcccgagtagctgggatacaggcacatgccaccacacccagctaatttttgtatttttagtagagacaggttttcaccatgttggccaggatggtctgaatcttttgaccttgtgatccacctgcctccgcctcccaaagtgctgggattacaggcgtgagcctctgtgcccggcctgtatccctattttcttagaaatacgttgtgcacgtgtaccctagaacttaaaatataattaaaaaaagaagaaataggcttagaggtgttaaagaccttgcctcagagagaagtggtgggactaggactcaaatctagttgtctctaactgcagagccttcactcttagctactttgttatagaagttctagtttatcttggttttcagtaccatttcaataccactattatgaaaaaggagattccttcagtcccacaaagagatatgatttagctaattgcccagtaactccttcctcaattttggtcaaagcctccatggcatcagctcacccagctcccattctgcagatgttttattacatgtcacacaacctggcattatttctgagttgatggttgtatgttttgatcttttcaaacatgtggacaaatttctggctggctgtccttttttcttttacagaaatatataattagatgaggtaataatgctcattagcccaagttacaaatagtatttcagtatccaacttcctccttaggagagcatcatcactgattaagaataattgccaacaattggccgggcacggtggctcacacatgtaatcctagcactttgggaggccaaggtgggtggatcactggaggtcaggagtttgagaccagcctggccaacatggcgaaaccccgtctctataaaaaatacaaaattagccgggcgtggtggtgggcacatgtgatcccagctacttgggaagctgcggcaggagaatcgcttgaacccaggagccggcagttgcagtgagctgggatggcgccacggcactccagcctgggtgagagagcaagactccatctcaaaaaaaaattattgccaacaattggtaaactattagttgaaaaatgtttgccatcatggccggaggagctctctgcctttggcctaccatctgctaagtgctatttgcttgtttcttctgtcttcattttctataccctagggcagcctcttctttagttgtaatacgtctgcctaaagtgggcttgtaatttgcttgcctaaatataaaaacgtaataacagagcattgagaatttttcactcataccttatagtatttctgtgataactaataaaatcagcttggtccctcagaaaatggaagcaacggcttactggttaaggagttttcagaggactggtcatctttaaccaaacatgactggctctttaccctttgcaaaggaaggttgaaagttcaagcaaaaagcaggtgaaaccacagttatcatagctaggaacaaccatagcagaatgcccaactgatagtggaaagctgaagatggaaagttgattggtaagcaacacaggctgcaaacctaaagaatagggagaagcatttcatagggatattggaagaaataaatagctttcatattgttggaggaaggaatcaagaaataccagatttatttgcttatgtcctccaaaaggttttatggatctataatctttattatagtttatgagtaaattattgcaaaagggcaattatcagttttgttcaaaagtccactaccagtgagtgggagaagtttcacattagtctgcttaggtagtggttataggtaagtagaggcaatttgtgctcagtagtactaaggtgtggaatggaaatcctgccctctcacttatttatttttcttcgcatggtattattattattattgccctctcaggactgctttcttctaaacttttgactgggcataggacattatagtgcagcattcagtttgaggatgacaaagccaaggccttctcatttcttaccattttatgttgatattgccatcttcaaggcaagtttttttaaaaaacaactttattgaggtatgactgagatgcagaatgctgtacatatctaatgtatacaacttgatgagtttggggataagtatattcccatgaaaccatcaccaccatcaaagccacagatatatcatcacctcccaaagcttcctccttcctcctttattattattattagtatattcttattattttgtgtgtgtatgtgaagatcacttaacataagatctaccctctcagaaaattttaagtatataatagagtattggtagctattaggcactgtgttatagacctgtagtagatccctagaaggtattcatcttgtataattgaaacttggcaccctttgaccatcaccaccacatttctcccaccccctcaccctgccaatcaccatgctactctgcttctatgagttcgactattttagattccacatgtgagaccatacagtatttgtctttctgtatttggtttatttcacttagtatgtatttcaggtccatttatgtagccacagatggcaggatttccttttttttttttttttttttttgacggagtcttgctctgtcgcccaggctgagtcttgctctgtcgcccaggctggagtgcagtggcaccatctcagctcactgcaagctccgcctcccgggtttgccattctcctgcctcagcctcccaagtagctggaattacaggcgcccgccaccatgcctggctaattttttgtatttttactacaggcagggtttcaccgtgttagccaggatggtctcgatctcccaacctcgtgatctgcctgcctcggcctcccaaagtgctgggattacaggcatgagccaccatgcctggcctccttttttaaggttgaataataattgtatctgcaatattttgactattgtgaataatgctgcaattaatatgggagcgcaggtatctctttgagatactgatttaaattcttttggataaatacccagaactaggattgctggatcatatggtagttctatttttaattttttaggaatcaccatactgttttccatagtggctgtaccaatttactttcccaacaatagcatatcagggttcctttttgtctgcatcctcaccaacacttgtttgttttttgataatggccatccccacaggtatgtgttgatatctcattctggttttgttgcattttcctgatgattagtgatattaagcatcttttcatacacctgttggccatttgtcagtcttctttggaaaattgcctgttcaagtcccctgtctcatttttaaaatcaggttggttcgtttgctgttgagttgtatgcgttccttatatattttggatattaaccgcttatcagatatatggtttgtaagacaagtttttattacatacttatttcgaagtacagtgtccattatactttcactgtccttacttttctgttatgcaatataatatcttgcccaggtaaaagtataaagaatactcaggttacaaaccaaaagcagtaaacaaatacaaaattacattaaagggaaatggtgtgaaagtagagagaggagatacatttttattcaatgcctcctatgttccaagtactctatcagatactttacatagtatatttcgtgtaatcctcatgataagcatgacaagagacaaatgagaaaaataaggctgtgagaagtgagggtcagactcttggttggcaagtcatccagagctggaatttaaactcatatgccatatgtcccatcatttacccagacacataaatatcactccatatcatcctacataagtacatgctgtcataatttttatattttttaattcttcttgcagccagagaggtagaataaaatgtagaaaaatgtggtgtcatagagaccaatgaatacataaataaatgaatgaatggggtatatatattgtatacttccatttctagacagactctattaaagaatcagcacaccagctgcttgcatttgctctttatctattggctctggtaaaactgtaaagcaagaaattttttttttctcccgtttgttgctcttccatacctctttcctcttatatgctagaacttttctgttgttactgtcagtgtacaccaaatatggcaacacaaaactattcctagaacatactaatgcttaaatatagatcttcccctatttagcagattttcgtgtgtacagtacattattgttaactataagcacaaagatctctagaacttattcatcttgcataactgaaactctgtacacactgaacaggaattcctcatctgcccctctctccagccccaggcaatcaccattctacttcctgcttctaagagtttggctattttagataccttatataagtgggatcatgtagtatttgtccttctgtaagtggcttagttcacttagagtaatgtcctcaaggttcatccatgttgttgcatatgacaggattttctttctttttaatacttaataataccacattttctttatccattcatctgttgatggacatttaggtcgcttccacctcttggctattgtgaataatgctgcaatgaacatggaagtgcaagtatcgctttcagatcttgatttattttggttaaatacccagaattgagattgctagactatatggtagttctctttaattttttgaggaaccatactgttttccatagtggctgcaccattttacattcctactaacagtgcacaagggttccaatttctccccattctcaccaacacttgttattttgtgtgtgtgtgtgtgtgtgtgtgtgtgtgtgtgtttaataatggccaccttaacaggtttgaggttacatctcattatggttttggtgtgcattttcctgatgattagtgatgttgagcactttctcatatatgtgttggtcgtttgtatgtcttcttaggaaaaatatctattcgggtgttttgcccatttttaaattgggtttttttttctattcagttgtagaagctcttaaaatattgtgggtattaaccccttattagatacatgatttgcaaatattttctcccattccataggtcatttattcactctattgattgtttcatttgctgcacagaagctttttagtttgatgtactttcacttctctaattttaattttcttgcctgtgcttttggtgtgatatccaagaaatcattgccaaggccaatataataaagctttccccctatatttttatctaagtcctttgtgttgctataaaggaatacctgagagcaggtactttataaagaaaagaagtttatttggctcatggttctgcaagctgtacacaagaagcatgacgccaacatctgcatctgttgagggcctcaagccactttagttcatggcagaaggggaaggtgaggcagcgcatgcagagatcacatggtgagagaggaggcaagagagagatgggggtcatactccttgtaacaatcagctctcactggaactaataaagtgagaactcacacaataccttgaggatggtaccaagctattaatgggggatttgcctccatgatccagacacctcccattaggccctacctccaacactggggattaaatttcaacataagattatgaggggtcaaacaaaccaaactatagcaattttctttaaggagttttatagtttcaggtcttatgtttaagtctgcaatccattttgaattgatttttgtgtatggtgtaaaataaatgtccaatttcattcttttacatgtgatctagtttttgtacaaatgttttcccagcaccatttgttggagagattatcttttccttgttgtatattcttggcatccttattgaagatcagttgaccacatatgcttgggtttatttctgggctttctgttctgttccattgatctgtgtgtctgtctttatgccggtaccataaagttttgattactgtggctttgtaatatgttttcaaatcaagaagcatgagatctccagctttactcttctttttcaagattgctttgattattcaggatccttcgtagttccatttgaattttaaggttatttttgctatttctgtcaaaaatacacttgggatttcggaagggattgcattgaatatgcagaaagttttggataatatggacattttaacatattaagtctttcaacccgtaaacacgggatgtctttctatttaggtgtatcagcaaaaaaaaaaaaaaaaaaaaacccttataaactaataaacaaattcagtcaattgcaaaataaagaattaatgtgtttctatatactaacaacaaacaatctaaaagtgaaatttacaaagcaatcccatttacaatagtatcagaataaagtaccttggaataaactgaaccaaagagatgcaagtcttgctctctaaaaactacaaaacattcctgatcttttaacaaaacttaacctatcctctcaggactctgttaggtcacgggaaggctaatgtggtaaataaacaccaactgagttataaatggcttactggtttgtcttcccacatattgaccaggagtactttaacccaaaggtacaggtaataaggtaatatggactgaactgcctactgatgaaatatttttaaatgaatattaaaaaatttgtaaactgcaacacacaattgctctatctagcataaagtctgcctctttttttgcagaacagcatttgtacaaaattacatacattgtgaggtgtaaatacaaatagttattcttggaaaacctctctgaaattttaaagtaattccatgagaagacatcatttcagatttcctagtgttgcatacataacacgcttttcactgagtctggataaatatggtttgggaggaagtacaataaggaggcagtggaatttttttggatcacttaccatgtgcttgatgatttgcatgcattatttcatttgatctctttcaaactctttcaggtagatggttgtcccattttgcagatgaggaaattaaggctcagggtagtagcattcaggttcactcactgcaaggctggatgtgaagctgtatccacttggcttgaagctagttcttttccctttacacactaggtggccagccagggaattggagtacagagaaaggtgagtagctctgaaacctgagtggggccttgtgaatttaagccgccctgtccaggaaggtttcctgggagagtgaggttgaagaaactgcttaatatccctgaaatggaaatatttcagttactgccaaatgtgtagccaaaaatcaggttaaagtagtggtgaagttaatcttacaggttgtttaactgtcctcagttgcatttcgtggtgtccaagatcacctaataggtcctctagaggtgggcctgggttcctgaggatggcttaacaagcagggaggtagggccttcacatgattttcctctggttcccagcaacattctgccctgatcatcatagaaggatttagtctatgtgtttttcgttcgtttgttttttaaattatagaacaaccacttcagcttgctaaaagggcatctcctctctatacagtgatggtgcccttaggttctggttgtatggggataacctggctgaatgacttgtagatgttctcaagtgtccacagatccttttgtttttgcttaatgtgcccttgctgtcatttattctgctctcctgggaacatcagtacacttgatttgctaaattgtcagctcatgatatatttaccattaaccaaaacccaggcttatgtcatagtatggcaattagtgggagacctatttttttttttatttgaaggtgattaaattcatttagggtgaatagtatgaaagacatgagccctaaaggtatttgcaatttgcatggaattctggcaggtgtcaagtttgactgcattatctggtatctcttgctgttgacttgttaaaactggatctaaaaaaatgtaataatcttttatccctatagcagatctttccattatgataaaactcctgctggtagtcatctgatgaagaacttttccctgtggctatgatcctactgtgtccctacagtacaggcaactcaacccatggtggctactcacaaagactcacagaacctccaggacactgtcagtcctagcaaaaccttaccctgctttgttcccttcccacccccaatggccagttactgggtaattggggtggtgaaaagcccagcgcgatttcctgttggcagtgtgctgatgcaggagagggtatagcccctgggcatggttttggaatacccgggtgtcctctgaccttatcctctgtcctaatgaaaaacttcctggcgtctagtattgcggctctcactggggtcattctgacttaattattctaaaatcaaaatagataataggcagataatggaagttttttggactttctccttccattgttttagcgaaggaagaagacacacacaaatcctccatcccacactcagttctattttggcacctggtgaccgtcaggaaaacctgataaacttgaaagtgttgtttcccaatcaccttcagaactggagaaacgctttcatgctgactttatccatgggactgaagaaagggagagtgtgctcacaagcacaaacaggaaagccttacatcacggagtggcgtggggaggagtctgctcctcgcttgctcgctcgctcgccgcgctccctttgtggcccgagtcgcgcgcaccggcggcggcgggggcagcgcggcgcgtgtctgtgcgctgcggtcgctcgggaccgggaccggggcgaggcgccgcggggctgagcccagcagacattgcgttggcctccgagcagggcgcatcatgcagcgttcgcgcaccggagagaaaactgagaatgaaattgctttggcaagctaaaatggtaacgagagctctctgccttctcccgaggcttctctggtggggaatcttctcccgctttcgctgggcgtgttttggactccctcggagtgaacggagcaatccgattccatacttgtgagctaaagctctctcactccgctttgtattcctctctctctgcgtgtcttctccctttcaaccgtacctactttctcagcaattgcctgtggtgtgtctggggcagatgcatgtcaggaggggagaactttgaaggaaaaagaactgttagtgtgggtgaaccgcggagcgcttctgcgtcccagcggctctttaacacaaacctcaggtttagctggggacatggaaatccagggggtcgctgcacagattttagtagaagctgcctgatgatgtgttgctttttctgcacttgccagattattttacggaaataaaaactttccacccccgctaactttgtgggctccaaaacaatgaggagaaaagacaagcaaaccacttcacttccaaaggagtgaggactcttggcgttttaaacacttgtttgtgtctgagtttaaaatctggtttcttcaatgaccgagccactctaaaaagtacagacttattcttttctttttttctttttctttttcttttcttttcttttttttttttttttttttttttttttttttttttttttacaaagaattatttttcctttcacttaagggggacaagttaatcaggactaatctagtttctttgtaaagaaaaagaaagacttcaaaacaaaactatttaagatatgtgagcaagtctaggagaaataactaaatggaaaagtcaggggatcctgataccacaggaagggactgcaagccaagaaaatctcagcattccctctatcaaaatgtgtcttgtattgcggattgtaatatttattttgaacagcccatcttgtgccctgagtgctgttgtaagcagcaaggcagctgggatagattgtggttagcagagaggaaaaaaatactctttttctttctctttatcccgtccctggcagagctcgattcaggactggggtgaagaggtagaggaaggagctgtttaccatgtcaccctcaaaagagtccagattcaacaggctgccaataaaggagcaagatggctaggggtgagtaaagctggcgagatggtgaactttggaatttcagtgtctgtcgttctgtgaatatcattattatttaacagaggcaggcttttttttttttcctcttttcgctttaaaaaggaaaatgctaatgaccaagtgtttgcactagctgaacaggtctctttttgtatttaatgttttcaaaagcatcttccctaggtttgtcaataattcagaacctcttagaaacatcttgaggtctttggcaaatagattgggggtggagtggcagaaaatgacacacagaatacaggcccagagagcagcactctcttagacaagagccataagcagctttgcccagaagccacccttgtctctctctgccctcccccaattgatgctgtcagcgtctgccttgctcctatatctctaggaggtacccagattgctcaggagacagagcattccaagtctgcatcctttgaggggtggtagatttcctattgtgatctcttttctatatcttgggaggaggcaaatggatgcttagtacccactactttgtgtgtagagtggtgggcctttggaaaaatgctgcttctgtaaacaggactcttttccactgagattgtaaaatattgggtgaggtcatgcaagtttgtaggtatcacctagtagatccttcaacacatcccaaataaagcgaatatgagaaatggaaagctcagcgacaggatcactacttgggcaaatgtcaaacatgtggaagaatgaagggattcttgatctggaaggagaagtagttctcagaccaggcggtgagaggcgacccaaaaagccttgagaaagaaaataatggttggctgaatagagggggtggagtgtgatttcacctggctggccttattttagccgatgggcttcagagtgttgaagatttatgcacttgcatcccatctttagcggcttggagtctctgaaaattcagaatattttgagcagcattcaaaggtggagtgtgaaggaggataggacacaaaattgcacagggcctcctgttaagagtagtggtaacgtgtgacttgtaactccagggagtttaaggcaggatggtggcccatggccggcagcaatcacttcctctgccatgagtctgctgacacaggcattcattgctttgggcttccccagctgcttcagctcaggcctttcctgctactgtactttgggccaaggtatcacccatgagggccagaaattgttaatgacatctgcaggtgtggtctggaaagataggagctttccagtgagaactagaggtcttcacttaccaagtacctaccttactcagaatatgattttaaaattaattatgtatatcactagcagacctgatagggaaagcagaactagagttctgacaagtcatcactttgtttttggtggttgtgtgtatgtattttatttaaatgtggcgtccatgtggtttggcctctagctatttcagaatgattcacaacttctgaaccagttgtcttcaaaagggtcattacatttttttggtatcaggttattcctctctttctaatgagactgactttgcttgggtgactgttttagttttcagccatatacaacattagttatgagtaagtcattggaaatggaggggttcactctgtaggccccacatctacaaactgtcatgtatttagatgctcagagttatttagtaatccccactgactgttctcttcactagacttcacttcttttcttctctctcccttctctcagtgttctcaaatttatacagagttcagagttaattcaccctggattcaacagtagatatgaaatactgagaaggaggataatgtgaaaagattggctctagttgatggaggaatctgtccccctcgcccccatttcaacaaagtgtgatttactgctaccagcctactcctttattgcaagttcctaggggctctccagctctaatctacgtgttttcttgtcttaggtgtcctgttgggaagttctgtttttgtccttgaaaattccagacttaattaaatgtgactcaacccattgagccatagcaattacaaacctttctctttagaactgagtggcttccccatgtttgttttcctgtattccagtaccctttcaaaattcttcaaagtaactagtttcagagttactagagagtggggtcaggtgaggaaattattgcaatatgacaacaaccttctgaggaaggtggtgttgtgatgatctctctctctctcttttttttttttttaacatgaggagactaatgcccagagaggttaaattgtttgccagggtcacacagctatgaagtggtaaacaccagattcaaatccagatggttggctctttgttgtgaagaatttcctgggaccttaaggctgtttccatagtagtagaaaagaacattggctcaaaagactgaggatgctttgggtgtgcttttccctaatgttgcaagactggagagatgtaactttcttttcttcatgtctagaatgataacttgagctgcaaattgagatatttgttgcgaagctatgatctcactgataaactccccattttggaggtttaaagcagggtgcattgaagatatgaagatacgtatgaggttatgtagcatgtgaggataggcatagctttgttacgtgtctgtaatgcttattccagatgcctaaaagatggaacataatttttgtattttctagtattcagatctcaaaacataattaagattcaattttggggaggagagcaaaataattacatatcctcagatgtgaagtattatacagtccaaaacatttaggtcattcttttttattttgtctgttaaattctgtgttcagttgatcttttaaagtaaaactctgtgtttggaaaactacaaccaagtatgtcccaggcccagtttacttgtacgtgcagctgcatccttgcccattgacggtgagattatattggcaactttgaaaaaccaaatattattgaaatactgacccattttccctttacaataacatctttggctgggataattttacccacctataattctcgaagaaaaatgacttcaattatgtcacaaaatttaaaaaatcttaggattggaagagacattaaagagcaattccgagcctagcacagtggctcattcttgtaatcccagcactttgagaggccaaggcaggctaatttgcttgaggctgggagctcaagaccagcctgggcaacatagcaagaccctgtctctactaaaaataaaaataaaattaaaaaattagctgagtgtggtggtgtgtgcctgtagtcccagctacttgggaggctgaggtgggaggatcgcgtgagccagggtggtcaaggctgtagcgagccatgattgcaccactgcactctagcctgagtgagagagtgagactctgtctcttaaaaaaagaagtaatttcacccagacattcacttatcttgtgatttttggaagagcaaagtgtcaaaacttgttatttgtctttggtcccagtgttgtggttgtatatggacagtgaataatatagaaaagagttaagaaaatatcagtatcctctggaagcaggaagtgtaacatttcaggatgaatactcaaagggacagaggaaaagaattcaactgtttgggaagggctttggtgtcagaagttcatgctgttgtcttcagaatatgacagactcagggtccaaaaaacatgtcagcctaagataagttccaagtgaggatattttttttacaagcaagattgtgagtgctaggtcacttctgcaaaatttgtgggcagtggaatgatcagtggttagtcacgtggctcttcttagtcctgtacttctgtggtcatgcagtccttgtggtggggcactgaggcctttctgccctgtgtccagtgtttgtcacaccgtttcccacataggctcttgataaatgtttgtgggactgagttgaaatgcaagatagatgggagtctggtaaagagagggaaatagaatggagaaagttgaatatatgtagaaataaaagaacctagaaacattaggtcatagaacgtggcatttgggcaaattgtggccaatcatgggttatgtggggactgtggtaagataaccatttgtcacatctggattgagaagttgactctcacttggatgttctatttagattgactctacctggcattttcatggtgttgctatccatgttgccttcaaatggcatacagttcctggagttttcagctaatttcacttctgggagccttctctaatcccccagctctggatgaggcgtcccttctgtgtgctccagaggcattctgcgtctcactgttgtgcatttacctcactctgttgtaattgcctgtttacttgtttgttatcttccattagactgtaagcttgcaaccatggccatctagttggcagaaactcaatacatgtttgttgaatgaataggtcatgcctcatccttctttgggggactaatattgtttttataagtatgaatgcatagttggttctcatttaaaacaaagtctacatgaagatgttcacttacaaagaagaagaaaggggcatgggagcaagaaaaatcaattaggtaatgattatagctgtcttacacccattcgagaacaaagcagggcacaaaggtatcaattattcattttaacgaacattccccagtgccttttaaaaccaagaggtccagttgtacttctcttgctgctgaatgttgaagaaaaaaaaggcaatgcatgagttaaaaagcattggctagcattacaattatgtgtggttggaaagtgcaggagtgggattttagaattgtaaggagataagccctagaggagcctttagtttatagttggtcatccttgttttcatctaggaaaacaggcccttgggttgcattatatgtgtctattggaatgtttaatttaggctttagaaagtagatttcagaatttagcagctatgtgtaaatgaaccaactggtatttttaattttgaccttagaaacacgtttttaaaattattaatccactgatagggtagcctctaccaatcaagaaaatttagtaaatttaaattgcctgagatattattacactggatccttttggtgctagtgctttcaaattctgttgggatctgtgttaggaatatgtgacatgtaatcaagaatatccatttcaattcaccaatccagggaatactcagctgagttcaaaatacatgtcaactcccagcaaatacataatggcataaatataagaggcacattaattccttatacttaaaagtgtatattctgttaaaacaattttatgaacatattttattcttatttctgtgaaatcataaagaaaaagcctcttggagttttactcttagaaagaaaatgagagaaataaggtaaatactgtgcctttccactttagagcttagctggaatttgtcactgcccaattccactccctttagtttcctttgcccatggtatatgtgtctctttaagcttcccccttctaaataatcagaattttttgactgtcttacgtattttatgttaagatatgcaaaaatgcactacatagtaaaacattctaatttgtaccatcatattctttttacataaaaaattagtttctataaacagagcaagaaaagttttggttaagtgggggaagataagaaatgttacttcattccaccagagaagctcagctctgtgtctgggttgccaatgggtgtggctatctcaagacgtagagttgatttggagttctttggagattttggcagtttctgggtcatttgctagtaaacacatccagtgtgaactccctcgctgctgttgcatatttctatatgattctgtcatttgcatttgagcctgctaaactctccttccataccattcatttattcatcaaaagcctgctttatgccagacaccatgttaaatcttgagaatacaaagtaaaatactccttgttctagaggaacttacaagtaagtgagggagacaaagttgaattaattacaatatattgtggcaagtgtgaccattgctaggggagcccagaatcaggggcatttaaatcaaatgcgagtgacaggtgggcagtccaggaagcctgcacagaggagagggcccttcagtggagaagtgacggatgagtgagagttaaatgagggctgggacgctgggggccagcattccaactagagagcacagcctgtgggaaggtgtggaggcctgaaatgagacttcccctgtgaggctcagcctggggaagagataagggaacccggtgggaaagggagaggaaagggggctggagagaaaggcatgagtcatgtcaccaagaacctggaatgctaagctatggaatctgcttcatctttaatgttagcatagtcattgaagagttttaagcagagtggcatggtcagatttgcattttagaacaatgactgacagctgcaggggagatgcatcggaagggagccagactggagcatggggacccaggaggaggctttctttagtggtaatgaagtgaagaaagggatgaggacctgactgaagctgtggcggcagagtggacaaggtaggtggggatgagtgtaggcggggcacagggcgaggattcctggcaggcacactggtttcaaagagcaggtcagcaaaaggctttctggagtcagtgttgtcctcttctcactgggtgaaatgtactggggacttcaagtcagccttcctccatatacactagcaaatgcctgcgttactgtcagaaggcttggcagaaaaaccagatccaggcatgcctgatgtgtcatgtctagagacgaaatcacagtttaggctcaccatgaacaaggcagaagccctgcttgacttctcagattccagagaactttgcagagttggtggtttctttttctttcttcctttctttttttaaagtcttctgtttccctacaaaccaaacaaattgaatctgaagaccatggagagagaataaatatggaacctgcaggactatgattacagagttgtattttagaaaacagcagttaaacttataattgtgttgttagggacacaagaaattttatggttaggtgtcctggtctttttccatcttcctacacaatgtgtttaaattctgtctgatactctttatcctagcagctgacattgctgttcttaaaggctcactctgattgctaattctcactccttgtataaaagaaaaatttcagtaagatagaatgcttccctagtttactgctacctcctctcagtctcactcactctctcacttaaatacacacacagcctatatattaaaatgtcttttcacattttattttttaggatttggttcaccttataatgtcacttatggcctcttctatataattgatcaaagcttgattttgtcatgttttgcttgatttcccttaattgtgtcattattgagattgtttgattgactttactcagagaactgcttttagtttaaaaaggaataaaaacagaggaagaaaggaaggactaaaagtagaacaagcttacaacattgggtagaagacaccaccttgtaggaagctcagttagtctcatacagagagagagagagagaatcatgtcatttcccactgatccttttgtcttgtcattgtagaaatacctgtgtctttccactgatgtgactgcatatgtttcccaatgctttgggcctctgcttggcttgtttcctcaaaaccaccttctcctttatgttatgtggcgtatgacttctgaggataacagtggtggtggttgggggtggggtgttgctggtggttctagatcttttttaaactctcacagactcattaccctacattttctagcatgtaattgcttatgccatctgtggtccattcatttgaatttgtttcagcacagttaatctaatcctatgtaaactcccccagaagttttttatgtttttcttttctgcaaagaattcagcaattcaacttttttcccttgtttcctgctgttttaaatactcattttcatcttttataaaaatgaagccaaggctgagtatttccagtttcttaattctgaagacaatttgaaggcaaaaagcaaaccttttctgctaagggtaggatgtcttaggtcagtcatatcaactgaatctctccgcaaccctcttgctagtaattcttccatagttatgtgccattcttattatgcccataacttctgtcactaatggtgatggagctagagtctgtggacaatatttatctaagaaaagaacatttaagtatgtaggtaaaaataactgaaactggattagacattggctaaaaataaaatgctttatagtcatgacttttccaattaaaattgcaatacttggctgagcgcggtggctctcgcctgtaatcccagtactttgggaggtccggatgggtggatcacttgaggtcaagagttcaagaccagcctggccaacatggtgaaaacccacgtctctactaaacatacaaaagttagccaggcatggtggcatgtgcctgtaatcccagctgctggggaggttgaggcaggagaatcgcctgaacctgggaagtggaggttgcagtgagcagaaatggtgccactgcactctagcctgggcaacagagcgaaactccatctcaaaaaaaaaaaaaattaaattgcaatacttgaaattgtttattgagataaatgatactcctaaatagaaaactgaggtaattgaagcatttggttagtttgtgaagcacagggaaaagacttgccactttctgtccaaaggctgattccttctaaagacatgacacaataaacatgtctgttttaaaaatgactttagggcccagagccatcaaggcctggctagggaattagctcagttggggacttcgtagacactggcacctcctggctgcttttcattttcaggggtatgttcagcaggagccctggaatagggaggtagcttagcacagtggtcaagaacctatgctttagagccagacttccatgcaaaactcacctctaccacatgtgagctatacaggcctgagctgtgaagttacttaacctctctaggcctgagctccttacctgtaacggggagaatagcagtgccttcctgatggaatgactgtcaggagtaaatgagttatgtatgtaaggtgctaggatatggtgtgcactcaactcactgagtggtggggctctcgtcagcacccccaccatcagggccctctagaaccctgccatagaaccttggagagacctgggtggctttcttacatggaccccctgaagcttggtgttatatgtaaccccaggttgcttaagaaacagtattagcaaggttttaggacatgtcattaacatccctctctcattttgtacatttgagaggaaggaacaatcatggcagggtttagtaatcctcgtatattagaaataacatctattgtattttatctctctggctccttgcataatgaaagactgcattattcctcgggctccaacattttgcatttgaaattccttcagttttctaaagtaatttgttggtattatttttatgctttaaaaaatattttattacttaacagtgggccatattctgtcttctgttttgccatttctgacagaaaaatcagacagtcggaaacaatttttctaaaaactgcttggtaagcattatgctaatctttcttaataggacataatttaggatgttagtaaattgttcttgcaccatcagtttcaagtcctggactaaactacatgagataaagataaaatttcttactgtgctacacgttgattagcttatacagtgcctgagccccactgcctcagccaggaatgagctgagttgcttgtgaggttgtgactttctgaatcttccatttcctcacctgtgaaatggcgttaatatctgtttttactctgcctatgatttttgtgaggatcagatgagttaatgtgtataaaagtattttttaatatgtaagtttttatacaaatataaggatattcttactgtcatttaacctagaggcctttttttctctctgctcactacctaaatgcttgataggcatgtggctctgtttattagtcttgcctttcttccttcattccagaggcaatcttttctactttgttttcttcccacttgctgccacttgctgattaactaatgagaggtgatgttcagctaggaggagtgcttcctctgctaccaccgttgtccccactgggattccaggtgcatcgagaatgcagacagcaaggcttctgtttgtagattggttgtgggaaaaaaaaaccccatactcacaggattcttaagacaaatgcagtggatattttgtgtttgaaaatgttctatttcttctttgattcttccttttctttctggtacttttaatttgttgtgagaagggtgataaagctaataatgcaccaaggaatggaaagtgcttccatctttgcagaggtcctggaaagttaacttttggtctgaagccaaatcccgatgtaggacttgaactcatgacctaatcccagaggcaagaatgttaccagctgaccaacactgaccctcataaaatgtagacatttaaaatactcctttgagtagtcctgttgctgctttctatgttttcttctctctttcagtcgtttccagcagtgttcctggcctccctgttaggagcacagttttaaagatctatttttctcactgtctttccatttgctgattatagctgcttccttcttgctttccatttctcttgtgtgagttcctttttttgttcctgttccttcctgtccttcttctgacttaaaaatagattccagggtctttggctgctcggccacaaatccgaccttccttctattcatatgggatccccctgagcatctaaagatcttttccttctctctcaagatacttgaaccccagcattcattccctgttctcagctgacttgtggagctaaatgacccttgtactcagagctgtaactgaaaattaaatctctcctacaaagatgcttaataagtgatttacttatgttaagtgttactgacaaacactgaattctccctgaatctactgactgtgtgtggtggtagaggagaagggactctttgtacactgactcaaggcatgcgtgtaacactcgtttttgtgcaaagcaatggtactgtgaccatttgaacctcaggaaccagctttcagacaacgtactgttaagggtatcctggagggacctgctgctgttttgttcccacagaagtgtttctcagggaccgaaagttgattaaagtgtttcctcatgaacattctttggttagagttggaggattatgatattctttacagaaatgacttcctatccaatgttgatctagacaatccacaaatgagtgtctgctcgagggataaaggcttgtaaaactttagatgactgggataaaaagtgctgatgacagcagctctgatttcagtgcccaaccccaacctgaaatcactattatgctcttgttacagcagcagggatgatgatcctcttctcagtggcaaaagagttttaaaaggtttccttccatctggacctccagacataacctatgtggttatgtctccatgaaaagacctggtcctattcttagtagagaatccggagtttttggtttcatcagccatagtgaagttcacatttatgtgcagctctcttatcactgtgtcactgcttatggcattgcatttacctgccctgcttttctgttcactggttgactgatgaatcctacttaaccctttaagttgcagctcaaatgttatctttactcttctacttttcccaacctctcttctggattaaggatccttttatctgagtttccttagcactttaccaaaagctgtattacagcacttatcacactattaaaaaaaatgtttctctttgccctattcgtttcagtgtttcatgaaagggcgggggccatatttaattaatcatcatattcccgtaacctgggacagtgtttgagacatagttagtacttagtgagcatcttataaattgtttggccttatctttattatagaacgtgtatctttagtgacttttttttggtatttggtaatattgtaagttccattttttgaagcaaaaggaaaacattgaagcagctaaatttagcttatattttatactccaactactgataacaataaaaaaaagaaagtgatgcttttgcctcatctttgtcatcattacttgacctacacatttcatgattgtatgaaaagtggcctaggtatgacagtaacctttatagatgggatgacttggaatttagagttaatccatatacttcttagtgacatataggtttgagtcatgggtcaaggatagacctctgggaactcagtttctgctttgaattctgaagttattctacttaggattttcatgtatcttattatatctggtatctgaggcctataattggcttcaaacttgcattgacccactgtcaagccaataaggctttgccctacataacacatttttatgaagggatctgacacatctccatgaacatagtaatgaaggttatgcccataatgatgaggcctgttactctgagatttatgttgcaggcttgtcctgtagtgtactttgtgtggtgcacctttcttaccggaactcacaggcaaaaggagacttaataagtgacataaattacataatattttgggtatacttttacattttcattagtacaactcaattcccttgctctctggccctccgacacttttctttattctgtggttttacattcttaagtttgaaattttcactttaggcaaaatgtaaagtttatgcaagaggttttcagaattctagaatttcagaattctgtttttaggtgctttcatttacattgtcccaaatgtaattggctccattaaaattaagtgttctgatggcttctgaaccttcctgcatgcttccttgcctttttctttgcatcggtgttcaatggcataaatgtttgctttagaaaagaaggatggacttttttttaaagcaatgccattcttaaaagagtgttgaagcaacattatacttttttttttttttttaagagacagggtcttgttctgtcgcccagtctggagtacagtggtgtgatcatagttcactgcagctttgaactgctggtctcaaagggttctcctgcctcagcctcccgaggggctgagactgcaggtgcacaccaccatgcctggctaatttttaaattttttgtagagatggggggtctcgctatgttgcccaagcttgtcttgaactcctagcctcaagcgatcctcccaccttgggcccctaaagtgctgggattacaggcgtgagccaccatgactagcccattttgttttgtttcgttttgatttaaagaagaagaaaatcatctataattctgccatgataacacagttcttttcacttttacttattatcttccaatttttgttcacaggcacacattttaacatagttgcaatcatgctatctattccgtttgtgataggcaggaaatatttttcagaacaaattagaaaggttactttctaatttgaatcgtttgtgatatttgttatgtttctgatgccacagacaaaagaatgtatttggacttggtgtttgaggagttttaaggtgataatgcttatttattggttaatgagcctcatttctgttttttacccccacgaaatctcccatcctgtatcaggggtgtggggcttgcatgaggaccctgatagcaccatatgagatgagggcatgtgacaaacgtgcagtggaattcagctggagtggatggtgctctttccttctgcttctagacatcattgccactctcttgctctggaggatgtgggtccagaactctctaggcctgtgctgttcaatatggtaacaactagccatatgtgcctattgagcacttgaaatatagccagtcctaattgaaatgttctgtacctgtaaaatccgcaccagagtttgaaaaaataatgtaaaatatctcagtaatttcctatagtgatcacatgttaaaatggtaatactgtgggtaaaatgggttaaataaaatgtatcgttaaaattaattttatggctgggcgcggtggctcatgcctgtaatcccagcactttgggattacatacaccaggctgaggctggtggatcacctgaagtcaggagtttgagaccagcctggccaacatggtgaaaccccgtctctactaaaactacaaaaattagctgggcgtggtggtgggcgcctgtaatcccagctactcgggaggctgaggcatgagaattgcttgtacccaagaggcagaggttgcagtgagctgagattgcgccactgcagtccagcctgggcgacaagagcgaaactccgtctaaaataataataataataataataatacttgtacctgtttcttttcaatgtttttaatttggcaactaaaaaattttaaattgcctatggctagcattatatttctactagacaatgttgctctcaggccttacttttcaaaatgcagcttgtggtttatttgtgggttctgaagtcagttaggtgggctaaaaatcaatattttaaaatcagaacagaatggaatagaaaatattagaatgtcattattgtaaaactttttgtttaaagtatgcatgtgtggactggatcccatgtaaaatgtattttttctttttactatgaatcatggctaaaaagtttgaagattagtaatctggggtggcctgacttaatctgaagcattaccaggaggcctggtctgctctgtaagagggcaggttggtaccaggaacactttatagattttaggtctggttggtaaaagctattctgggactcttcaactagaccagaccctgcaggaaagtaaacctgaacattagtgctcatcctaaaagcagtggccactcaggagacttccagagtgaagggtgaactaaggatagcttactgaaagctggacctgtgtgctcaaccctaaagtgtccctggagtccaagaatgacttttgtctggttacttgcttctcggagactttttcaaaatggtctcatgagtggtgatactttctaagaagcaggatgatttcctaatgaccttagagccaagatgaattggacagggttccttgtgaccctcaggtcctccctgcatcatatcctgttgaaatcagaagagactgtattctaatctagaagcatgtctgtcttcttcctgcctgacagaaaacatgtccttacagtacaaaagatgtaggggtggtcaccagagctgtacttttggctgggttctaaataaatgacactgtaagccacagagagaagggagaaaaggctccaaaaatgaagtttatggggttacatgggccttgtatttattctgacagttgtaaaaattcttttgggctgacccatttttcttttcttaattaaaaaaaaaatatctggcaggcaagaggaagaaatgtaaaccatgtgactaatgcttcagctttttctcctggagccagattctttaaaaattataccttagacatgtttgactttttaaaaacaattgcccacaaaagccaccaaacattttttttctgaaacttgtagacttagatagcattcattttcaggaaggaatccaaaagtacaatatttaggagttattgaaccaaaatctcctttggagattttgccctggtgaattagattaccctaggaattggcagaggaacaggcggccttttgcctctactttgcttgagtatttccagtcctgttggtagccacccaaaatgtttgagggagttagactaaaagatcgtcaaggtcctttgtagacgaaaagtactatgactccagtgacggaatgacatggcagtcaggagttatgtttatgttgacctcttgttttatacttattgcaaacaatttgtttgtttactcactcactcaaatttgagcacttactatgtgccaaatgttggcctttgtaggaaaatcataggattttagagcacttatcatagtagatttgagggcttcaaagtcaagttccaatctccctttctggggtgatttcctatgtctcacttttgcaactccacacttcagctaactgggctattttcctgttttagggtcttttctcttgctgttgccagggtctaaaatgtcctcctttccttaatgccagacatctttaaatcgccagacatcactcaaattctagctcaaatgttacttctgtgagtcctctctggtttctcaaaaggtagtaagtgattcttctctcaagccaaagcactttgtacttcttttttttaacaccacacataatcttcttagaatgaactgtatgaaatcaccagttttataagttaaaaatggttaaatattggcagcttcatacagttccagctaatattaactgtgttattgtatggaacttaaattaggcctctataaatatattgcccccaagacttatagccagaaatattcttttgtcttttcttcaaaaatatgagttattattaaactaagtttcattaaacctgtgcttgcaagtttcatttaaaaaattaaatatagaaaatatttatttttaattttattagtcttagctaatcatctaaaattttgattcagtaaaccaatgtattagctataactttcagtgtagtttaataaggttctgtataattatctactttatttgttaaaatgatttattcaacatggctaaacataaagctctgtgatatattgctggagacattccccactcccagcaatactcgccagttaacatttttttcaccattcagtattccgtgacatctgatttggatacatatctaggcaactctacaattattcaacttacggagttccactgtagctatagagatctcaggagagagttggtgggatagttatttgaagtcaatgaatatcatgtctgtagcattccatgttacctgtatagaatcagagaaggatggaaagttagtttgatatgattttttttcttttaatttagagacagggtcttgctctgtcacacaagctggagtgcagtatggtcatagcttactgcagcctcaaacttctgggctcaagagatcctcctgtctcagcctcctggatggctaggactacaggcctatgcaatcccccatggctaattcttttaatttttttttagagatgggccttgctatgttacccaggctcatctcgaactcctgggcttaagtgatcctcctgctttggcctctcaaggtgttgggattatgggcatgagccactatacctggctgattttatttttctcggtgattttatgttagttcctagtgatcgttgcttacaaaccaaatctgggattttgggaacatttgttggcagaactacccatccgttgttttcagtctaccttaattgctgcctaaaaattggtataccttcttgtacaccctttagacaccactgtgattctaatttctgtgaagattccgctcatcacatctgcttctccttttagtgtccttccaggttatttatccggccctggagacatgaaatcacttgaagggctaagtgctttcttactatcaccttctctatcttgggctttagtttcctcttcaccatgctggtcctaccctttccagtttgaagatcattttccttgatagggaggatagaagcaaaagaggagtgaagtagttctgctttttctttgttatcagttaacattaccccacctatcagcaaccactgccttcctatttttgctcctagaatagctgaaaaaagtccttttacttgaccttaacaattttgacaaggctcagttcattatactattcactttcatgttactgtgttttataaatatgtgttatcctaagtatatgtatagctttaattatgggacctgctttctatcttttataatttggaaaacatgtacaaccaccttgatctctttaggtgctttctttcattgcatattttaaatatttgtctcacctttcttgaagcctcttgcctgttaaagaaggtttatataataatgctttcctaatgtttgggatacatgtctgacacctgtacaagaaatgtaatcaccctccgccaaggtttctatatatcctgcagcaaccatttttcataactgagcataattatgtctggactaatagttatttttatttcctcctatcagtagagtagataaaaacctagaagaaagcattgatagctattggtgagtgcttatatactgagagggaggagtcaaagataattccaagacttttggtgtatttgaacaaagagaacagtggtatcattagtagaaacagggattctgtgaagaacttctttgtggtgctggtgggagggtagtgatatagttatttgaattttagacatatcatgctggaagggtttctggattagaagagatttgggattagaggagtacatttgggtatcatttacacatcagtgatactttaagcagtaagaatgaatgatatagagaaaatggaaaataaaagagtattgcaggccaagtgtgagtaatgtcatgttcaggggaccaaaaggtagagaccggttagcctaggagtcagaaaagcatagctagggaggtagcagcagtaacaggctaattcattggcacagactttaggggaggccaaagttttaaatacataagactgtgtactctaaaaacaagtaacatcctgtcacttttggtcatttcagctttccaaagcatattttaaaactgaacattaatgaaaagcttctctgagtaacccaaatagctctcatcccataggaaaggccaggaggttatcattcttaatgcatatcatatcaattctgaatgcataacaaagttggttgtttatataaagtcataatgaagttccttgttccagttgagtagaagtagcaaatctgaagaaagtggggcttttagaagcagacacactcatagcaacaaaaactgacaatcccagtggaagcctatgttcaaatgtcaccttcttggtaaggccttgtctaatcactcatataaattgcaaccatgaaggccagacgcagaggcccacacctgtaatcctagcactttgggaggctgaggtgggaggattgcttgagcccaggagtatgagaccagcctgggcaaaatactgagaccctgtttctatttttaaaatcaatcaatcaatcaatcaatcaatcgcaactctccccatctctgtctctctctttttttttttgagacggagtctcactctgttgcccaggctggagtgcagtggtgcgatcttggctcaccgcaagctccgcctccctggttcatgccattctcctgcctcagcctcctgagtagctgggactacaggcgcccaccaccacacccagctaagtttttgtatttttagtagagacggactttcagcatgttagccaagatggccctgtctctattttttaaataaacaaatctcaactccccctaaccctgcaactccctatcctccatttcagctttacttcctccttaacaccactgtctaatatacctttttatttgttcatttgtttcattgttattgattgattgattgctgcttcgtacattagaatgtaagttccatgaggacatgggttttggttgtttttttccccctgctatattcccaaagtctagaacagcacctagccgatggaagacacgtgattatttgtggaataaatgcatgtaagaagaagatgatgatgaaataccaggcataaaaataagaaaagtgtataggtatatagatcatttagctttggaataagcacttctatttatgtcagtttctctaggggaagatactacagttcattgtagcactgatggcctactgagctgtaaatgaaaggttaaactgtgctccggatgttctgcttttgaaggcagaaaaataacatatttcagtaacattttaatcaaataaatgaaacttttagaatgttgatgtttaaagggtccctccttgggaaaataattcctgtattgaacactaaattctcccatgaatgaccattattatgtgatttaaatgtacctttttttttcttttcttttcttttctttttcgagacagagtgtcactctgttgcccaggctggagtacagtggcatgatcttggctcactacaacctccgcctcccaggctcaagcaattctcgtgccttagcctcctaaatagctgggattacaggcatacgccaccatgcccagctaatttttgtgtttttaatagagtcagggttttgccatgttggccaggctggtcttgaactactggcctcaagtgatccacctgcctccacctcccaaagtgttgggattacaggtgtgagccactgcatccggccgtgtgccagtttcttaaaatttgatttttccttaaccttattgacaccctgaacaactttcttgcaggtccactggaaatgttaaacgttttgcctccttttttttccagtctcagagacctttaacccaaaggtgtggaattaacccaaaggtgtggagctacagagaaatatatggcagctaaacttaaaaactgttaaactggaatctctcccactggttttgctttcacagactgttgctttattgtaggacgtcagtggcctgtttgttactctcatgtctttttggcaaaatgaatgagtaagtgcttctaaattactgtgagatgcctgtcgaattgcataagtagatttgaaaaatgctgtattttcgattaaggtatagctgcaaagcatagctcttcagttcaagaggcgtagcctgacctcctacacattttacccttctccacagttgcctcttagtccttgaaaaaacatttttttcttattccctctctttcattatttacgttggatacaatagctgtgtacgctatttccctggctcaatataatataagtttttaaactttacaatctatggtagtgactgagaaaaactttttaatgtgaagggaaagtgtccccactttaattagaatgacaaagcagtatggagttatgtaataggtattcatgcagctccattggttacataatataatggtcactcacaacagatacttaaatccatttcacatccaggaccattgtgtccacttgcagagacagtgctttctttgttttcaccaaataaatagctagtgattattagcttagcttttaagttaaatcacattcctggaaagggaaatgttgcaacttttttttaataggagaggagaatgcatttttgaaaatccaaacatactattactgccagtgatatgaccattacacctctttgacaagagaaacctatgttttatttaatttagacagttataatttcacatagtcacatgacctttatcctgttaatatgcaatctaaatatttgtcttcaaacggtttcagtaacatggaacagccatgacttaatttgcctacgatgatgtcttttcccttccagcaccccgtaagtggaattttgacttgttgctgagtttgtgatttatttacagcatctgacatggagtaggtcttaactacttggcatgtgtggagtgggggtagagggcagcacgtggggatgtcttcagtgagcaaatggggggcctgacctactcggccgtctggtgctgctccttccgtgaggctttggagtctgagggatctgggttctgtctttcgactcttggctctgtcaattactagtaatgtgaccaggtggattgcttgtcctgtttgagcctcagtgtcctcatctataaactgagattattgtgagtatcaaatgagattgtgtatttaaaagggcttcgaatattagacacaaccaaagataatgattcccaatctgaaatttactagtcaaaaatgaacttgtaacactgattgacttctgtattcatttcctctgatctgctccagtcaggaacaagttaaagcaagtgtatgcttctactcggaataaaactggtatcagtcaatgacaatggaaaaagaataaaatttgcccctttctatgggtgaggaagagagttggagaggagaataataacactgtgctcagtagaagcagatgactttacttcagtcatggtttatttcattttgtcatcataggaatttctctaatattgttaccatggttcttaatcatcaatgcttgttataataaccgggattgaatgcaccttcttcagttacagggatttggatttagggagttggaggtggggcccgtgaatctacttttaacaagtaccccaggtgattctgatgaaggtggatcagccaggcatggtggctcatgcctgtaatcccagaactttgggaggctgaggcaggaggatagcttgagcccatgagtctacctgggcaatatagtgagacctcgtctctatgaaaaaaataaaaaaattagctgggcacaatggtgtatacctgtagtcccagctattcaggaagctgaggtgagaggattgcttgagcctgagaggtggaggttgcatgaaccatgatcatgctactgcactccagcctaggcgacagaacaagaccctgcttaaaaaaaaaaaaaaaaagtagatcgtgatcaacatttaggaaattttgctcccatcactgttgctttctccagtagttttctaagtgaatcttttctttttttcatacagttcattcttcatgtaaactcattcatcatgatatactcatatttacacttacatttgatcctgataatacccacctgcttaaaaccctttaaaagcttcacattgatactaagttgagtatcaaagctcttctggctgagcttccaccactctcccttggttcactctcctttggccacatcaacttctttttatccttcttgtattccaagttacttcatggcatttgcacatgctgttccctcccctgaaacgttctctctctcaccatttatctggtgcacacctactgattattcccatgtttcctcgtgaaatttatcttatatctaagacaaaacctgatcctctcatgtttttaagcagctttttatagggagcaatggtttctaccgccattagacagttgttaaattatcttctctgcttgaatgttggcttcatgaggatagggagtgtgtctgtgttgttcatttctgtatccacagtgtcctataatagtatgcagaatatagtggaagctcaggaaatattctgaaaaatgaatgaaaatgggatttgtggcaaagaagtgatgctctagtcctccacttatgaggatttaatgactgatgcagtgagtgggcctttttataaagtggcaatgcgcctaacttagcattctagaatgagatgtttatttcagtgataaaaacttcttataagttcagacacctcaaacaatatcctttgtgttcaacgcttagaacctggtatgggaaaaaggggaagttataaagatttcagatgaaatcctgacttattttgcatgacatctttcatgcagaaagtattggaagctgcttggtagtccaatgcctcacaagtaaatttcttgcaatgtatttatttatacttatatcacatagctggttgattagattgtgtattcatttcctcagatactcccacttggagtggtaaaaagtcaagtaagtgcatattcccactctctgttttcgaagcaaacagttggcccagtggcatctacatcagatagaacaataagagcaatgtcagccccagagaatgagagatctttgttatgtgtagcttgattcagcatctcaatcttgttgggaaaagaattctggagaaaaaaaaacccatgacttaagtaatttttaaaatcatgataaccaaatatagaattaattggtcttcaaaaaaatctcagaacagtcattttaataaattcactgcagttctcaactgctatgaagagatgggaccagttaattttgtttacttgaaatttttagttcagaaaaacagatttttgtatttttcaaggtatccatggagtttcgcatgcattgaattcagatttaaaaataatatgcaatttacttacagtattactttgttttccattcattaccacaaatatttactgagcatccattatgtagtagacattattttatgcaccagagacacagtggtgggcaagacagttaagggctctgaacccatggagtttacaggcaacaaacaagtaaagaagtcagtactatcaataaattagtctagataaggtaatctggtgtggcaggggaagatgggaagtgtgacactgaccagaggggtgctctagggggtttatctgagtaagtactgcccaatgaaaagaaggcaataaggagccagtctgagaacatgctcaggctgagcagcatttaaggcagatggaacaaatgcaaagatccttccatgagaatgagcttgctgtgttttaggaactgaaggaaggccagtgtggttggggcctagagagggaaggagatggttttggtagtgaggtcaaggagataggtaggaagggctttgtgaggtctggcagaaggctggatttcatttaaaggattatgggaagccagtgggaggttttaagtagggagtgacaccatctgatttgtgtttttaaaagatcaccatggatgccataagaacaatttaaaagattgtttattttagcagtccagctgagaggtgatgatcaagcattacatgcttttattgtatatgtacagactttatatgtacatatttttatttgactgaatttggaagaatcaagtaaaggttatttagggactataataatgtcactagatagattcattacattagaaacatatccatttaattaatattcatgaagagcttattgctgatttggttgaaggccaatttctagagatttaaatatgaatagtctttgctcttaaaaattttacagtctagtgcgggatacctataattaaataaatacaacctaatatgggaagtatatggctactatgaataaaactgtaataaatgtttctggccatgtcttttggtgggcatatacactcatttctgttgagaatatgtctgagtgaattggtgaattataggataggcatgtcaagctttagtagcttgttggactttattataaaagcaggatttgtactttagaaagatcattttgtatatggatgagtggttgaagtgataagactagaggcaagtgagactagttaggtgcctattactcatacccagttatggactgagatgtaaattaaggcaaaggcaatgaggctgaggaatgagaatgaagtgggacgatataggagatggaagaggttggattttggggggatgagggagtaaggatgatctgtacatttatgacttgggtcattaagtcagaggctagaaaaggggtgagcttttagaggaataaaatgaatttccttatgtatgtgttaaattagagttgtctgtgaattattcaggtgaatgtggtaattggaaattcaagtctagaattcagaagagaagtaaaagctgtagataaagctttgggagttaatataatatttgtgttaggtgaaactctaaggatatatgtgtgggatgaccagaaagagtatagaaaaagaggaaagaaggttgtggttagaaatgtttccatattgatggtaagtgaaggatgaggaactgttgatgagcctttagattcacagaagatttttgaggaagatgagatagtgtggttaagtctgactgtgggtccagactgcttgaatttgaatcctggcttttctgcctcttagctgtgtgacctggaatgagtcacttagcctctctgggtctcagttttcttatctgtaaaatggggataataaatgtatctgctttataaggttattataagatatatacaaaatgcttggaattgttgttgttattgttattcttgagaaaatgatgtttataaggaaaaggtacagagtttcaggcgggaatcaatagtgccgattctccagggatatcacaggaggtaagtgctaaaacatttccataggattgacaaccagctggaagagtaatgggggcagaaacaaactctgtaggctaatcataataccgtccctttttgtaggaacacctattgaatttcataacataaacacacaagcaagatcacatggtttgcttgaaagcctctcaggttattgacataagtgctagtaataccttagtttaatatatagttctttaatttaaagcagctcaaagtgtatcctgtgttcttttgaatcaccctcataacatcaaggtgagttaaggaagatgaagataatattcttagtttacaaatgaggaaactaagactaagagaggccagatgactttatccaagcttttattaatcaacttctctgttatcccatcaataaaccctagtcatccttgttttcacattgtcaagcatagtatagctcaaagggtaatcaatagagattctgcagtttagaatcacctaggatgctggttaaaatgcagaccacctagcccttgttctgggtctactgatcggaatctctggggcatgggctcaggaatcagtttctgcccagcactccaggtgaatctcttgaaaaccctttagtgtatttaagagaacaggcaaatagatccataaatgtatcttgtttattagtgagatttttcacaaaaaagtgttaaaatattttgtattcagaaactcaggctactataactaaaaccttagaaccttgttctgaacatattgtatgatttgctatatttttgcagttgaatagtacttttggttaaaagtaaaactgatttgaccttacaaatgaataatagaatccattggtaagttaccacagcactgctggagaagtcacagagaagctatggctgaggactctattttatatcgattcggttaatggccctacctgcagttagtatttttagttatatagtattgattagaaagagttgctccccctatatttatagcttcagtatgcatatgatgatgaaatgagccatatctctctctgtttttttttttttttagcatagcagcataaaactctgaggctcaggtagctttgaagactgtctctaggaggtgggacctcataagagtctaggccaggtctaggtggtaaaagcctcgtgaatttactttcttatttaattgtagaggaggtgcatttatctgtatgagttggcgtcttatctgtctattaatttgttgtatctctggcttccagcagccccatagtaggaactcaacaaatatttgctgaatgaatgtatctactcaagtgtatttaggaacaaacaaaaacaaccaaatcaaaaggaattatcctagctcactaccgagatagctagttctagaaagcactagcaagtagctgataattaattgaactggaactagaaacagagtctagttccttgcccaccctccccttcattttttcctgactgccacctttatcattgaatcctaaggttgcgagaggccttaccccatcagttctgcaactccctctgtgaggctcctgcttatttacctggcatgtatttaatgtctatggcatatgcactagtactaagctctgtacccctttctttacacgtcattaaatgaagaaattcacactcatcatctctaaggtttttagagagtagaaattccttattccttttatagatttccttagtacctcatttgagttcttggcacaatggaggctcttctctttttattttgtattttttttatttttagagacagggacttggtctgttgcccaggctggagtgcagtggcacaatcatagctcattgtagccttgtactcgtccgttcaagagatcctttcacttcagcctcccaagtagctaggcacatatcaccacacccaggctaattttctaatttttttttacaaacagggtctcactatattgcccaggctagtcctgaactcctgacctcaagcgatcctcccacttcagcctcccaaagcactgggattatatgcatcagccaccatgcctggccaaagcacttttaatactgttttaatgactgataccaagagcgggtcacaagccatggaaatgatgagcatcttcttaggaggataaatattttcttttcaaacaaatgcctatctttttacataaaattttgatcattaatatctagtaaacaaaatgtttgctttcttggtttctgttcatttggacaaattggatctgtgtttttttgccagctaccaggcctttctatatgctactttcttctttaaatgtttttttacaagtcagaatttataaatctgcccttttgtctggctgtatcccataatcaatcatattgtcattctgctttcatttccctttatttctgaaaatagaaggaaactgtcttttgactagagagtagatctctaaacctagcaggtaggaaaattatttaataatctggaaatcagagcagaacacgagtgctttccatggattcccagtctgtattacccagtagtttctcatgcagaagccagcttctcctggctttccttgagcccttgggttaagtcattcatccatctttcttagactcttagactaaatttactcatttaagaaactataataatgagagggattttgtttccccccaaagagagtctttggcactaagacgttattttttgtctttaggtgttaaggatttcagtcagtgtcaagaggtaagaaggataataccagagataataccagatgtaatcagacttaactttgggtgaaagtagttggtgtaggggaaagaaagtgaaaagtatttgtagagtgctgaatagcttgtaatctttcaacatgccttagatctattatctaactttctctttcttacaaaaatcctatgaagtctgtagattctgggcaattgagttctgataattcttgggtgtacagatatggagattgagtacccaataccgtattgctttgtgtttttagggaatattccatgattgaaagacagggctggttttatatccttgctttaatgcctatgctaattggctgggtaactctgggtgtgaccccttacttctccaaacctctgtttccttaagtgggaataattcctacactacagggttgttgtaagggttgagcatctaatccataatgtgcactcagtaaatacaagttagccttctttcttcatttacagtctaagaatggttttcttagaattaatgtatagcttatgaagaagaaaacctattaagaaaaaaagccagtttagtgtatcttttcttttcttttttttttagacggagttttgctcttgttgcccaggttggagtgcaatggcgcgatctcaggtcactgctacctccgcctcttgggttcaagcgagtctcctgcctcagcttcccgagtagctgggattacaggcacccgccatcacacccagctaatttttttttttttgtatttttttgtatttttagtagagatggggtttctccatgttggccaggatgatctcgaactcctgacctcaggtgatccacccacctaggccttccaaagtgcgggaatacaggcgtgagccactgcgcccagccttcagtgtatgtttcaaagaggtatactcaggatacacgcaactgtttttcatagaactttgccctaggtttgatcacctaataacatgcttgaaagacacctggtgggtttatcagtagccaattctagcaagcccatgatctaggaatattatacgtgccaaaaacagtgctgagggatagaatacttgccagagacactgcagcccagaggtttgtgagtcataaagctacatcttacatctgaatttataagtccacatagactttaaatatttcattttggaggggaagggatcaaactaaacaacgtcattattacttgaattccgagatccaggggagtaataattttattgtcattttggataatggggctttggtttttaacattacaataataggtaatcataacagtgggaactaaatgttcccataggaatcgcctaggtagggaaagtgcagaagattccttaatgtggtatacggagtaagaatcaaaaattaatgacttgactttaaagtttggaaacatcagttagttgctacccttccccgtactctccctggaggattggtgaaggagcacttataaatctcacaaggagataaagccccatggagctgtctgtgggatttatggcatgctgggaaagcttctgggctgtggggaagcctctccattcatagcaggcttcattcacagagaatattaggtcacacagaagctcactaccccctgctgacctttacagacagagattggttgggctgcacaaaaacagaatggactcaagcaagccagggcacctgttaacctgtgaccttagtttatgaagaccttggacatttgaggctctgaatgagagaaaaaggagggagctatgaattttggaagttcactctggatactaatttgtatgtgacaatttgtgatcttatttggcaaatgcaacagtgactattttaattcaaactcctctccctccgtgcaactcttaaatccttgaacttctcaaaattgcattgatgtattccttttataaagtaggtaacgaagtcattgaaactaagtttttgccctaggtccgacagtaaattggctccaaatggaaatgcaacctgttaattcataacgccttagttcagcagtccccaaccttttggcaccagggactggttttgtggaagacagtttttccatgaacgggggttgaggggtgttcgtttcaggatgaaactgtttcacctcagatcatcaggcattagttagattcccataagaagtgtacaacctaggtccctcgcatgtgcagttcacaataggcttggcgctcctatgagaatctaatgtcgccgctgatctgacaggaggtggagctcaggcagtaatgctggctcacctgccactcacctgctgctgtgaggcccggttcctaacaggccatagactgctactggtccatggtgcaggggttggagacccttgctttagttattggcattctgagtttcaagcagaaaagtatcagatgaaagtgaaattattttatttgaaaaatgtggtcggcaaacttcttaaaatccacttaatatttaaatttgctttctgggaaactttggaatccttaaaggatgaccagaatgtcagaaatggagatttgtgttagagaagatagaatctgttatggattaatgttggaccaagactccaggagtactactctttttcaggagatgagaaacacagcttcctgtttccttcaggagggttcctggactctatctaggaaaccctactgagacaggatggcaaagggggatgggatttctgtgtgataaaacactagctattgtttgttattacagctccctttacatcttcctgaggatgaaggatattcatcatagaagcctgaccacgtggcttcattctaacaagtggcttcaagcaaggtcaactcttggggctcgtgtagttttttcagagcacattggtttgtcatacacatgcccttctgcctctcctgcctccacatttctactttcttcatagttcagaggtgtaattcccttcttctatcagataaagatcatggtgacaacacaaataccttaactggaacgtacacagaaagaaaatgtctcagccagtgtgaaggtgtctcttgacactgacacaatctgagagggacttctgggcaggggtatgctgataaactggccctccaaaataaaaaccctaatttgtagcattgctaattttcatggcgtaaatagtgtcaccatgtctgaactcacactaccaacatgatgccactgaatgcagaggtgaggagtgtgcacatttggctcgtgcaagaggttcaagctggctccagcataccgctgtctaagccttgatatgtttgtataattagagggaaggtacatatgtcagcacatatgtgaatctggtggtgaagatttcttctggtttctctgcccagaaatgccatcatagatcagacgatgtatgaatttgccacatgtgcaagtgcctcttctggtgctgcccatctttactcttggaaccagcttaattttggtactcatccagataccatccttagcctactactcttcctattttaattgatgtaatttctacatatttccatcttagacccttctcccaacttttagattctaactgcctgttggacttaccattggcatgtaattcagtacctaacccaccaaaatctgacttcctcccctcaattttctttcttataggtgacaccattacctttccagccatccacactagaaatcaggtgaagtttccagattctttattttccttcattttattctctacatccaattgatcagaagtcttgatgatcttctttttgattatttgatgggagggtaaatgtgtccctcccatctgccaccttctccattcctattattgtactagttaaagcccttgcagttgcttatctggaatatccacaactttcgtactggtttttccaactttaaaactgtcctcatcaaatctgtcctccacgttgatttccttgactatgcttaaaacctcatcattggtctcccatttcaacaggacacagagtctcagctccttagcatgcaacctaagtcctccataatcaggtagtctcctgctggctctccagccaaagcattccttccctctgtcatattgtttatgcagccacacattttccccctgtagtggtggaaaggtatgatgcctttcctcacccatcataagggtcatcggtaactctcctataacaaaagacaggttaacaagagaaaagcataacagatttctttaatcaaagttttatgtgacatgggagccttcagaaataatggcccaaagagccagaggaaactttccatttttatgcttagagtcaatgaagaatggacagccatgtggaaatgtgattggatgaaacgggtatgatctaatggtaatagactaagggggaacccagcaaggcctgtctgttcagattcttcctggccactctttgtagtattcttctttccccctgggtgtgggccaggacccctatggaatgagggtcttatgatctactatcagacaaggtaggtcagagaatttatggtcagcttctaaacaaaaaggtgagggaggttagagcaatatttccaggctttaagccttgctttaggataagagggggttctagtttctatgactcaccttgggaaggaggaatcctggtttctatgattcacttcaagggagaaagaagtgtaggagacaggagggcaggaaaaggtcagagaatttgcttctgaggctgcttctgaggccttccaattcctttagttcaaagtcctcagcatgtcaaagttccatactttgggatagcgttttcatgacttttttaatgcttgtttctctgcctgctgtgccctccccaacatagttaactctcattcattatgtgaaacccagtgcaggccaggtatggtggctcatgcctgtaatgctagcactttgagaggccaaggtgggagaatcgcttgagtccaggagtttgagaccagcttgggcaatatagcgaggccttgtctctaaaaaataaataaataaataaataaataataaataaataaataaataaattagctggggtggtgcgtgcctgtagtcccagctacttgggaggctgaggtgggaggaatgcttgagcatgggaggttgaggctgcattgaaccctgattgcaccactgtactgcggcctgggcaatagagatggactgcatctctaacaaacaaacaaaacaaaacaacccagtgcagacagaacctacttaagaagccttttctgacacctcctttacactgggcccctcttggtgcttccctccatgtcttgcctctctctccaccattttactcacattttattgtaatggtttctttgtgtctgtttccttcaccagactgaacaacttggttgccagaactgcatgctatttacctttatatgtctagtaccttgcacagtgcctggcacatagtaccatttagttaatatgtagctgaataagtagatgaataaatggaaaagacagccattgtgtatgtgctagtagcataaaaatacaggatacacaattacatttcaaattcagataaataacaaataggtttttttagtatgcatagatcccaaacatggaatgggacatacttataccacatagtatgtaattattcattatttctctgaaattaaaatttcactgggcatcctgtaatttatctgtcaaccctaacctagcaaaaaagtgacttcccacccaatattaggttagcacaaaggtgattgtgacaagttttggtttaagttttgttaagtttgccactatttttaatggcaaaagccataatcacctttgcaccaacctaataaaagttcacacaaggcagaacctcatgttgagcttgacatcatgggccctaaagtattttctagactttaccttaacatctctgagtgtcctgtgtgtaaatagtcactgtagtactcaggtgtattggccttgtcatgttctgctgggtgtcattacatacatgatttctgctgagagaatgatgcaaattttgttgcatggcaaagaaatttatgcagttgagtaatatggagagatgagcagagcttatttgtgagtcagcttgtgggttttcctatacaggtggagtatccttaatcttaaaaccgaaattcaaagtgctccaacatccatgcttattgcagtgttttgcagtttggattttcagaatggggatacttgaatggtaagtatagtgggaatatttcaaaatctgaaaaattctgaaatccaaaccactttcagtcccaagaatttgagataaaagatcctcagcctgtattgtggtggtttgttgttgctggatagtggttgtagggcatatgaaaaggaagcataaaacttacttttggtgtttggggatgaatgtagggattgggtgtgggttttagatttttggagggagttaacagctggaatagtactcactatttactttgctgctcaggccaagatgcctgagaactgatatactgaagagtgatcatggtgtggaggactccatactgtctccatcctaatgaggttgtttgcttaacacgttccctgttaaactatcagatgactgaattattattttgattgaagggactttttttttttttcaaattagaaacacccaactggttaacagtttatgttttagaaggtgaaagagtttatttttccatgactggaaacggaattgaaatatggcatctttcatctctcacatgccctttttcctctccgtctcatgccaaaatcgataattatggaaattacctggtaggacacttgggcacagttttagatatttaccccataggactcagacatgttctcttagaaaaagctggattctaaaggcacaaagatcaaccaaaaaaacaaacatgaaacatttttgtggtcacagtaccgtgatcttgtcagtaaagcgacggtctatgattaaatccagattgagctgtttcctgttagcgtgctaacccacaggacaggctcaggcctccgtgtcttgctttctaagtctgggttattaagcacttgtctgacaagggttccacccctttcgtcttcaacttaataattcaaagttactaagataatataagcaaaaacaggtcctaaagtctcttaaaacacttacagacctataggaatcttttcttgcaaaaatgaaacttttaacattttagcttctcttgtcgggccatatggcagagtattttttgtgtttcccctctgtacagtttcatttcaaaataatttcagtggtaagcagatcattttaagtttttgtttcataagaaatgtactctatttgaatgttggcaaattagaagtcatcagatctttcccctgccataataagcaggtattaggatatttagcagttctacagaaaatgacattaagcaaattctctgataacttaacatgcattgttattttgtgtgagaatgattgtaggcacaagagcaattctatacttattttatgatattgtcattgatgttcactttgaaaattattttttaaatctaaattttcaaaatattttattagtcttctgttaggtcatatgtggttcttcctaatgcacagatgcaaaccctgaggaacaaatactgttaaagggacttacaggaatcatgtatgcatattgaaattttttccgagtaagaaagtactgaaagagaggggctgggttaatgagaaacataattccattcccaagggagaaccctggctttctgccaaatctctgctttctggcaggaaatgggacccacttcatcaggtcctttgacaagcatttttctctgtgtttgaattttgggacacgtcaatactcggtgaaaaaatagttcttttaaataatcatcacttttgataagaaggatttagaattaaagtagagtttccattgtaagtaaaataagaatcgtcaaatttcaacattgtttggtaagggaacactgttattatcacaaggcgaggaagcttgatttaaatcagagtttgactatccctaaccactgagaagccattccttttattgttgttaatatttaacattgaagtatattttcatgtttttttttgtttgtttgcttttgagatggagtctcgctctgttgcccaggctggagtgcagtggcacaatctccagcccactgcaacctccgcttcctgggttcaagtgattctcctgcctcagcttcctgagtagctgagactacaggcacgcacattacacgtggctgattttgtatttttagtagagatggggttttactatgttggccaggctgttcttgaactcctgacctcaggtgatccaccccccttggcctcccgaagtgctgggattacaggcgtgagccaccgctcccatcctgaagtatattttctaactgctacttttgaatatcatgcaggctgacaattattttggccaggtcttttgaagtgacaaggtacaaaacacaaaacatcctgacatttttgtattaataaagagatcaaaggaatacacatttgaaaataaaaattaacattatattttataatgttttgatttttcttttttaaatgaaaagtggtaaatatgagttaagttttaaatgcattacagtaatttaataagccaaaatttttcaaagtatgtgcattctgaagttctgcaagatgctctcagactaaagagaaatccatctggaaatgctgcataccatacccctctcttggagttgaataacaccgttggcatatgagaaattctgcagtaaagagatatcattgactttgttgaactctatagttcccaaacttgaccataggagttttttttggaactagtgttttacggcacacacttcaagcaacagtgaaccaaataattaataacatgtagaattctaaaccatatatctttttcacttattgtttctgataaagttaattggaacttctggggaacagatgggtactacaaggtttgttctaaaactacatatagagtgataaagaacagctattagaccctgatctgagtcaacagtcttaagaggcctaaagaaatgtttgctattttgcctgaaccagatccctctccctagaaaactttcagaaattaaataaagagataaagccatctaccacataagctggagtcttaattttaattcctgttagcggtttgacatgatgacattaagctattctaacccccttctgaaagcagttgccaccactctggtctttctgaaagcaatccatctgttagtttccttccagtagtttgatttctgacaggccaggtgaaggaaaagcaaacatgctacttagtaagcacaatatcatcattagagatccacttctttcttctttgtgtctcttctttaattttcacatgtgactatttcaatttaggaaatctgacataaaacaattacaattcaacttgcgattcagataaaccgcctggcgattgttcgcatcacttaggattatttttgctttagaaatagacctcctctctttagagcagtttccttagtgcctatgaaggatgagttaaactttcaaaattgcatctctgtataatttgttaggcacagatttactgcagaatgtaaggcacaccaatatttttcttcattttaattctcttcccttatactcaaattttaagctgtgaagattttattaccaatgaatttttatgtattatggtttatatctaccaaggtacaattatatctaccaatattcatttacagtttcattttcatgtgctagctgcttctcgtgagtaaatgtcttcttttagactttgcaagtttccagaaggcagggtcatacacccacccacccttttcatcactccccagagcttaacccagtggtgcttggtacaaccattttctcagtcagctctgttgattgctgatgatattgaatcaaaatgcacattgccgtctgtggactgaagaaagtcagatcatgattccatctccatagatttccacggagaatatactccaaccatggccagtttttcaagctatcaacatgatttcaactggctcacacaaattcttaaaatttaacaatcctctctccaaaaccagtatgactcagctccagcactccaccataggagctgtctttaggaatgagtgtgcaaaaatttttttcccattctctaggttgcctgttcactcatagttcaaccattgtggaagacagtgtggcgattcctcaaggatctagaaccagaaacaccctttgtcccaacaatcccattactgggtatatacccaaaggattataaatcattctactataaagacacatgcacacgtgtgtttattgcagcactgttcacaatagcaaagacttggaaccaacccaaatgcccatcagtgatagactggataaagaaaatgaggcacatatacaccatggaatactgtgcagccataaaaaaggatgagttcatgtcctttggagggacatggatgaagctggaaaccatcattctcagcaaactaacagaagaacagaaaaccaaacaccgcatgttctcactcataagtgggagttgaacaatgaggacatatggacacagagaggggaacgtcacacatgggggcctgtcgggggtggggtgacagactaggggagggatagccttaggagaaatacctaatatagatgatgggttgatgggtgcaacaaaccaccatggcatgtgtatacctatgtaacaaacctgcatatgtatcccagcacttaaagtataatttttaaaaaaaaaaagaataaaaaactccaacaacaacaacaacaaaaaagaatgagtttgtccaggtgcagtggctcacgcctgtaatcacaacacttttggaggctgaggcgggcgtatcacctgaggtcaggagttcaagaccagcctggccaacatggtgaaaacctgtctctcctaaaaatgcaaaaattagtcgggtgtggtgatgggtgcctgtaatcccagctactcgggaggctgaggcaggagaattacttgaccccaggaggtggaggttgcagtgagccaagatcacatcactgcactccagcctgggcgacaaagcgagactccatctcaaaaaaaagaatgagtttgaaaactttccatggaacaaaacaaagggaatgcttgctaaacctgatcctggtatcattaaaaatgcgcttggtaaaattatatcagcaaactagttcttgataggggagtaagtagaagcaaatgtaaccattatgaagtaatacctctacttctagaaaggtaggaaacacgcatacctccaccaccaccaccctaccacactaaactcataggagagagcattgccttatatgacatgtagagaaattaaataagagtgagggtaagctgcatgcagtggctcacacctataatcccagcattttgggaggccaaggcgagagggttgcttgaacccaggagtttgagaccagtctggataacatagcgagacactatctctaccaaaaacaaaaatacaaaaatgagcagagcatggttgcctgagcctgtagtcccagctacttgggaggctgagtcaggaggatcactcgagcccaggagctccaagctgcagtgatctgtgatcacaccactgctctccagcctgggtaacaaaagggataaataaataaataagaatgagaggaaacataacaggctatggccttcaactatttcaatgcttccaattttactttagggagtcatttctccttatggtaattgttaatttattatacaggttgaaggggaccagctgcctccaggacacacagtcagtcaatatgaaacctgtaagatcaggaccataaaagctggcaccttggagaagcttgtggagaacctgctgacagcttttggggacaatgactttacctatatcagcatctttctttcaacgtacagaggctttgcctccactaaagaagtgctggaactactgctggacaggtaagaatgtaaaggagcttttgagttgaaagaaatgtaggctgattatggagtggagcacgaggttctgaatcacctgcacttggtattcggagagagatatgtgaggaaagattaacgggaagggatgacctttggcacaaatgaaaagaagatcattcaggagccacttatggtctgttgctggggaaaaatatctcctaaaagatttataaaagagttgagagtggataccttaaatctagattcagttgctttatggatttactatttgccaccctaaatttctccatatttttataattttatattattcagtaaataatcagttgaccaagaattttactgggatgttgtggggatgaaatgtgctaatatgtgtgaagtgtggagctcattcttagatccacaggaagcagcttaggaatggtggcaatgatgatgcgatgatgatgataactattaacagtcagcatgtattgactgttttaaggatctgcacataaatatccttgatccgtatttttaagctacttattacatagagcagtatacattgatatttacacactgttaaactttagattttcctctttatttctgttttatttagaattaaacttggtcttttagaaaatatcattaaatcaacttgatactgggaggaagaaagctgtcagccaaacaattgttttagaatcaggagaatcctcatctaaatccttatattctggggtttcctgcataaggaaggaaatgagatacggctttctgttgggcttgttgagtattgatgtttgttaactaaatttttttattttgaaagtaatctgtgctcatgctaaaaattcttacactgtggaagaatatgcaaaatattaaagtttgttcatattgctgccttttccccaaataacatttattagatttaaaaatattagtagtaagaagaaaattaaatagaccatcaactaggcaaataacacatattaacattttaaaaatagaggtaatccatgtatatggtgaaaagttccatcagcccagataattataaaaataaaaagtaaaatatttttttctccaagctccaatcccattcctcccaggaaatcactgtgaaccatccttttgtatttttcccacacttttgggtgtatagaaagtatgtatgtatatatacacacatttatgtactgtatgtcatatatatgatatgtttatatatttatcatatgacacatatacttacctatgatacagatagcatcacagtacatagtctgttctgcaattttcatttaaaaaattttttttttctatttttagagataggatcttgtcctgttgtccagactggactggagtgcagtcacacaatcatagctcactgcatcctcaaactccggggctcaagagatcagcctcagcctcctgagttgctaggatgacaggtgcatgccaccacgcctggccagttttcagtttttacttatctgcatatcttggaaattttttactcattaagtgaattagtatatataaaaggcttagaacagtggctggcatattgaaagctcaaaaaatgtaattcttatttcaaaaccagcacgtgtagatgaatctatcataatcttttcaatagctttataatatttattgaatgggttattatatggatagacatttaagttttctccagtttttagtttttttttttttttttttttttgttgagatggcatctcgctctgtctccaggctggagtgcagtggcgtgatctcggctcactgcaacctccgcctcttgggttcaagcaattctcctgcctcagcctcctgggtagctgggattacaggtgcatgccaccacacccagctaatttttgtattttttgtaaagacagggctttaccatgttggccaggatgatctcgatctcttgacctcatgatctgccgcctcagcctcccaaagtgctgggattagacttgagagccgctgcgcccagcaaatttgttttttaaactttgtaaacagtactgcaaggagcatttttgaatatatatcttcggaatagttggttgagaattctataggataatgtcatagaagagtcactaatgggtcaaagtatatcagcatttaaagatttgaaagataactgccagattgcaccagtgacattcctgtccacagaaaacgggaatgcctatttcctcattttccccacactcttgccaactgtggatattttctctctacttttgaaactgtctttgccatgacctgaccactgacaaatgatagcttcttgtttttgaatttgtgcttcttacatttatgagtgaggtttagcatcttttaaaattcttattggctgtttgtgttttcttttctgtgaactgccttttcatatccttttgcctatttttcttttggactcttttcatctaattattgattatctaattataactctgcatattaagggaattagtttgttgcttatcatatgttagaaatattttcctaatttttccattcgttttaaaagttatttattaaaattttttataacgacattaacattttttgtgtagtcatatctattagtcttaagaaatacctttaataatcaagttatattccaatataagtaaggttattgacaatagtgggttttctctcaaagtagtttactcgtaagatgcatatagagtaagattatttggatcaatggttattaatatgttaatcttcaagaatactcacaaaatgtctgttctttgtcatacattgatctggattatgatactttgagctgcagcacagataggaagttctgtagcttttttcatagcagtgcttgacaaaataggcctggaatataaacttggattggtgaggcatttctttatataggcaggatcttatgtaatagatcatacctgtaagtagaaattgaaaaattatatgaattttatctttttggtatttcatgtttataaaaaaatgcagtatgctgttggcaggcagtatgaattgactgttcaaaacgttaaaaaactcctacaagtttactttggaattggtaacctcttctatttatggggtgactattgataataggccacagatatccacagtcaataaaggagtgcacgtaaattccagctgttcatcctaaatagaggacatatacacacaggaactggagtgtttagtctatgactcatgtacatccagattttgatattttttaaatcttttctttgttctattatagaggatagatgtttttgctttttaaaacactaactggatgactgactaacactgaaaatgaatcaaactgcatttaattcaagctgtcatgtacgatataactggagagttaggatttatttttttaccatttggatgggccaaggcttggccttgaatttaatctcataaacagatcctttgcttgcttctgaaatgaatggaattgacaagtactcaatgcctacacaatacccagcttctgcaagacaccatgcagatggaactcaggaatatgagacttgtttcatgccttgagatagtttagaggtagatttactatgaagccactggtacttaacctccaggggcgctcacttggaatgccctctgcataattttatattcatgattttgtattctttttctttgagaggatccctcagattacatatggcttcaaattacatatccataagacctggatccacccctcagtacttaatattttactgcaaaagataacatattaaggcttgcatttctgaaacaagtagataactgcttgagatggtattagatgaagttctaacatgttctgcagatgaaacaggatatagaagttcagaggaataaatatcatttatttagattattctgcagaaattgggatttgttcaaataagtacaaacctcaacatgagtatttcttccttgcttcatttcctactcacacttagatcttgagccaggcttcagtcttgattaaatttaaccaaaatgcacattctgtgaaacagtgggttcttaaattggttgttgagacttttaatgtctataattaagaggaagcaattatgttgtataaacttgcctattctgaagatgagcatttgaaatattattttgtcagtagattgtggtagacttgtttatgggtctctgacataattttaaaaataatttcttttggtttcttaatagtagtttgcttatctgttgtgaaattaacactgagacgctattacagcatgtgctaatcatacaataatcagtcaagaatagattgaagacagatactgcagtatttatttcccaccggagaagcttatttgatgtcaagctttgatttcccttaagacttctaataatgtgggttttctcatatggaactatttgctttctgggatttattttttatcttttgacagttttttattctgctataatatgagccttttgtgattggccaatagacagtggtttgaattcacgtatagctaattccatgtgtttgctttaccccttacttggggtgatcatttcccaaggacccctgtttcctgtgcttctcaacatggctcagagtccacattggcctacttttaacccaagagaaagttcttgaattctgggccagcagtttgtgttggggctttgagattttcttttatctaacttcaaacatacactcactcagttaaaaatctggccaggcgtggtggctcacatctttaatcccagcactttgggaggctgaggcaggtggatcacctgaggtcaggagtttgagaccaacctggccaacatggtgaaaccctgtccctactaaaaatataaaaattagctggtatggtggcaggcgtctgtagtcctagctactcgggaggctgaggcgggagaatcgcttgaacctgggaggcagaagttgcagtgagctgaaattgcaccagcctgggcgacacagtaagacttggtctcaaaaaaaatcatctgttctctccaccataccattttaaacataagggtgttagatactactgaatatgcccaacctcaaatgtagggagaaacctactttaattagtgaccttcagtgagagccatgaaatgttggcacaagtatctagagttttcttcagatagctgtcacaatagctcccttttgggccatttcttgaacattctctctttctgtgttatgcactctaatatcagaattaagcagaatgagctgagtgcagtggctcatgcttgtaatcccagcactttgggaggccgaggtgggcggttcacttgaggccaggagtttgagaccagcctggccaacaaggcaaaaccccatctctactaaaaatacaaaagttagctgggcgtggtggtgcatgcctgtagccctagggagggtgaggcaggaggataacttgagcctgggaagcggaggttgcagtgagctgagattgtgccactgcaatccagcctgggtaacaaagcgagaccctgtctaaaagaaaaaaaaagtaagcagaatgccaacaagaaccagagtaggggttaactaggtctccagaaacctttgccaagctgatggcactcaggtcacactatggaaagcactgagtaatagtctgaattactcccttaatttcaaatgaattctcccagtggaggacattcggggtttttaaaggttggagccatttgtaaacactatgctttaagattatctgacttaaatttgcttgcttatggtgcagagaagagactaattcagtaggtctttgaacttatttcttcttcccatgtttgcttgccatgtgttttcacaggcttcatctcatttagttcacttatttttacccctatgtttacagattagaaaattgtggctcagaaacattcaatcagtaagtagcagagctagaattaaaacctactcctttctgacttggaagctctttccaagtgtacaatatcaccttccttgatttgttaatatcacctttaaaggaacccttttttgggaatcctttttagccatccttttcactactacctcaagtgattttccctggaaactgtatttcccaagggctcctcccttcacacagttgtgagcagttcacttgagcatcagtgctgttatttgtctactcaagcaatatttatcagctctttaatgtgtactatgtactgtacaagatgctgtgtgtataatggtggacaaacctgccttcttcatgctgaatgtctagtgggaaagagtaacattaaacaaatcagtgtgcaaatacatttatataattaaaattgatagaccactgggagataaaaggttctataacacagagttataaaggatattttggagagctgtacccaaataaaactgaatgttggccaggatcttaggtgatcacttagatcatggcccataaaggtaattgctttgtctgtgtgtttggagtgtttctgtgtactgaatgggcctggccaaatccctgacctcgatcagcttttcctgaagggtcagggatagcaaatgagagagcacgggtggatttaagtaagtatagtaccaccgtgggaacagaaaccttaaatccattctttatgtcgcctggagtaacattttcatatgcaaaacctgacataccaataaccagcaaaacggagctgcctttgttagtgcaaccagttcctccacagtgtagagaggagttgatcagatataaagcttgaaaattttcatttatttccaaggattttgtcatagatgtcaaacagacttttcagaattttaggatacattatgggaaaagcaatttttcctgtctttttttttacccatgagattcagatttaaggcatatagtataatggttaagaacatgggcttaggagtcagaaatttgaattttattccagttttgcactccttacttgctctgcagtattgggcagtgaatttatcttactagcttcagttttcctcatctataaaataacaaaaatagcacctaatttatagagttattataaagtttgaacatgataatataggtaaaatttgtagtatagtggctgaaaaatattaagtgcttaagagattactattaccttgttttctttcttcaaggcatttattattatttgaaattaccttatttatcttgcttatttcatgactgtctttcccactcagagaccatgttagtcttgttcattgctctaccctcaaaatggtgcctgcagtaggtgcttaggaactatttgtctaacaaataaataatggttatcattattcatgccttttccaagcaggtgttttggaaggtccagcagtgaacattgcccagcctctgcccatgtttagtgggagagacaaataagtctatagactcgtgtcatcactgtcaaggccatgaggctgaatgtgcgtttttaatgaaaaccttttccccccgggagctggtagttgtaaaccttctataaaaagcccattgcacacatccattcagttctcaaatgctttcgttgcatgagaagctggtaagtgtttttgagatgcgtacaatatgttccaatttgctttttgttaaacctcacttaaaaataattgaattttttatttagtgctggaattacactaggcacttgccaaatattcctagattcatgctggcatgcagtgttcatgttcctgtacttccttttctttcagtaagaggcaaggtttctaatatctttcctctcctcttccaggtccaaggaaaggaagttgtcaacagagagagcactgggaaacatactggaaactgaacccgcacgacgggtctcagagcatcttcatgtgacttatggtcccagtgtcgcctctagggtcaccagcatctagaggtgacactgagaccataactcacctgtaggtgctggtctcttatagcattaacactcacattaaatcttgttactatgaaactcataatttgatttttttctaaactttttgttctgagttatttattaatgtttaacttccatcacttacataggaaatttttcaaaataattccataccattctcttcattaattttagtaacctcctacagggccaaatcgaaattagcagagagggtcactcattaagtcttttgtgcctcccccaacccacccatgcatgaaacagttgagatttagtggttggtggctccaggatgcacatcccatttatttagtagaaaaactttcaggaaatcttaacattgctttgcttcctttctagcttaacatacaatcatattgaatatcctgactagggtgagaatttcttagtaaatgaaggctgctatttaagatttttgttagaacagatgagtttaaatagattttctctaggtctgggtgttgatgacttcctaggcaaaaaaacccaaaaaaacttggatgggttacacacacatacacatacacacacatatatataacagaacatatatatatatgttctgttatgtatatgaccctctctactagtttccatttggctctgtggggggttactaaaattaatgaagagaatatggaattattttgaaaaatttcctatataagtgatagaagttaaacattaataaataactcttagaacaaacaaaaagtttagaaaaatgtcaaattatgagtttatgttctattcaggacatcatgccctgttcagttttggtccacacactcagctccaggaagcatggctggagccagaatgtgaccagaattgttattattttctccctgtaaatatatatatatttttatatatatatatatgttaaggtgttttttaaaaaaaggtagattgctgaaagataaattggacttagatcttatttcctgcaactatgagaaacatgacactattggttggtagaagagaaaagaggattgtaagaagggtgtgaaaatctttgggtatgaaaatggttataatatagaaaagagcattaaaaactttgataggggatgcctttcataaaaggtctcaggctcttgctggctcacactttatcaggtggagagaaacagtttagctcagaaaacaatagaaggtataacatttataataatttacatatccaaagatgtccacatcctcatccctgaaacctgggaatatgttaggttatatgcaaaggggaattgaggttgcagatggaattaaggttactaatcagctgactataaaataaggagattatcttggattatctgagtgagcccagagtaatcacaagggtccttaaaaatgtaaaagatggaggcagaagacagagaaagagatacaaggatggaaatgggatcagatagatgctatgttgctggctttgaagatggaggaagggggccttgagccaaagaatgcaggcagcctcttgaagctagaaaaggggattgaacagattctcttctagaacctctagaaaggaacatagccctgacaacaccttgattttaacccattgagacccttgttggacttctgacttacagaactataaaatagtaaatttgtattgttataagccactaagtttgtaataatttattccagcaacacagataagaaacaaggaattcttgtcagggagattgactctgaaaaatctagtggccataggctcaaggatgttgaaggtcggtgtccaccctcacctttgttctgttcaggacatcatgccctgttcagtttcggtccacacactcagctccaggaagcatggccggagccagaatgtgatgggcattgttattattttctccctgtaactatgccagttactttggattaaccagaaaaatttaatctggtgctgtttgagaattatatccaaccataattacctgagggaaaatggaaataagttctcttccctgctgggttggtggcctttggtaaatatttacttttgccaagtggacccaactgtcacctgccaacactatgggaattctggataggaacatgtggcgactgtagagccttagcttgtgggacgacagtgatggttttgttaaagtagacactgaggggatgctgtcaaagactttgcctcagatcatagccaggctagctttcttttcttgaaatgggatttataagacctaagagataaaaatgtttccatgaagtagcttgttttttttatttcacttggcaaagggaggcaaggacatgcaattatcctttttttgaaaagaatataaaattgcccagcaggttttttttttaaagtgtgcttaacatttgtaaactacaaaacaaaactgacaagaaactgaaatgtaatgggtggtaactgagttagtaactggacagtcagacattcagctttgatcatttaaagcagtggttttgaccatttttcagcagttggtgggagtgattgatcacaaacccctgtaagaatgtactaaaaactatggaccttctctttagaaaaaagagaatgtcacaatttttttcataaaatttagggacttcccagacttctgtaaattcatctagagaccctgggttatgatcccctaggcaaagtgtccctagcgtggtaacaggggatatgtaggcagccattatgaatgagaggtgggcactgatcctagctttattataactggaacacagaccttaagtgtggctctgaaaagtaaaccaatcaaattaactaaaattacgcttcatggttcattcaggtaaatttaatggttttagaaagtatcttgggacatctaaaaggggaagatactggtggttttgagttaattttgtttttcatatcgctattctcttatctgaaaattttttttacatttattttttgtgaacttagcccttgataatgctgtcaggcccctagtcctgggaacacaattcttttgcctttggcctctactaaagctaacagtaagcacccatttagataaattgatattccgttgagtttttgtaagctataggcgaaaaagaaaagtattcttgaaaatgaaaggatgccatgatactaaactcatattcattgtatttgatgttacaaagcatgtttcataagattttgaagagctctgcaatagcagctttttgtggttggggaaaactgagccacaggcttgtactgatttgttaataatgtattaattcatcttaaacctgagaaaaatctagactcatgaacagagtctgagtgctgcctccttcctacccccatctaccagtttcttctgttgtccgtcattgtagcctcatccattgcagtgtactaacaagatgtgtttgcagttggtggtttagcattgttatgaactagaagtggaaggagtagctacggatgggccaccaagctctgagtgcaggaaacaggccagagaaaagaaacggatgacagaggcttggaatggaaaatagaagaaaccttatagcaggagtgtgagagccaacatacttaaataattttaaatctgcgtgagatataagttgtggcaggagagaactttttttctttcccttggatgaatagtgtccttttcttgaactcctctttagacagttgtgggttaagggctggaaagaaaggttattctccaggaaaatgttatagcattttgtaactgtcaagtggggcagaaatatcaggtactcttttgctgttaatgttgccttaagtgtcagggacttagtatggagatatgtggacaatgaaagaacaaggaaggtgcagtgtccttcacagcaaaggcctagaggtgaggagggcagcttttgttgggtcttctagctttttctagtcagggaaaaatggcctagagaactaaccctcataaatggaaagcacagtatagggttctcggctcaatcttcttggccccttcctttcctgcaagagaacaaggagtttttgccttgttgtttttgacctttgtctttccccttgaataagtaacttcacagtggtaacaagacctttccaaggtaggcttggtggctgtgacccagttctcaggtcagacttggcggagaggtgcctgccatggaggatattattcagagtaattaaaaccacacttcttgctgatctgtggaaacagtccaaagtcttcactaaggttttcaccagacatctgcaggctatttcacccatgtcgttctcctgagtcaaggtcagcttctgaacatttttttcatacctgacctgtgttcttttgggtcagttacagaaaaatgcctaagatgttctgaggccagcatttattagaaaagattcccaggagtccttgagtcagcagcttcatgtgaggtctctctttcctttacttcttcctttccgttctttcactatccccaataaagtacctccttcccaactcttcccgccccagcctttcttttattcttggtagaagagggtgtgtattaattcattgagcaaatatttattgtctactttgtgcaggctctattccaggctcagtagaagtagcagtaagcaaaatagaagagtaaaaccagagtccttgccacagcctacctaccaggccctcagcatctgtccttgtcatctccatgcctccttttctattcacgctcactcagctctgcccctcattggcctcttaatgtttcttagaaacatccttctgctactcttccaaggcctttgcattggctctttggactgcttagaggctctttccctggagatctgcagggcccacttcctcactttctggagagtttacttagttttcacattcacattgggccttccccaaatacccaacctctggccctccattataccaggtcaccctgacctgctttatttctctccattgcacttttcactctctgacttagtatatattaactaattattgttgtctgtctcctccgcactaccatgtatacttcatgaaaacagagactttggtttgtttgctgctgtatcctcaatgtctagaatagtacctgtacgtagtccttagtaaataatcctcattgaatgaggactaaatgagtgaaagaatgaatgatggaataaatgaatgaaaggctcaccatagcttgtatggtagggagtgattcagaggctggttgctgaacgctgactgtcatggctgaaatccctgctgcacgtattagttgtatctttgagggcatgttacttaatttaagccttctgggcctcatttttctcatctgtagaataggaataaaaataacttcactctatagaattataggagaactaaaccaagccagcatgtaaagcccttagcacagtacctggcatatagtaagttctcaataattattaactgctgttattattggatcatttgccagaatcaagcagagcctgagagattcttcaggatcacccgcctcctgatctggtgttactgagactttcctgttggggagcaaaggttagcaagggcccccactagagagaccgtccctgggtacaactttatctaagggtttctttgaaccacagatacacctggtcttccccttcaaacacatataaaacacttcaccttaccagataggctacaaagaatacagacatcctctctggaaataactgtttctgtttaaatatttagcaaccagttaaacattgtactggttttttctttcccttttctattactttttaggctgcagtaaataattgcttaaggctgcactttaggagacatttgtaaatttttcttttgccttgtgataacagagaaaaccatgtcaaaagtcattctgacaatttttattttaagttttatgagttaccatttaaagaagagcagttggtcattggtaagccttcttaagaggttggagctttgatcttaaatcctagggaggctttgcagaaattggacacgacatcgttgacaggtttgttggtagctattctatggccattaattaaacatacacactcatacacacactttatttactaccctggaataagtgaattgaacttgactttgagttttgatgggaagctatgagagggtccaggaaaacatcaaaggaaccttcttaatctagtagtactgactgtcaaaggacctagcctgaacatttaaagagttctggattccaacactagtctagtttcttttctgtaaagcagtaattctccttaatgataagaaaggtgcagggatggcctggcatgttggcttatgcctgtaatcccagcactttgaggggctaagacgggaggatcacttgagcccagaagttcgagaccggcctgggcaacagagtgagatctcgtctctacaaaaaataaaaaaaattagccaggcatggtggcatgcatctgtggtcccagctagtgcctgtggtcccagcctctcaggaggctgaggtgggaggcttgctcaaacctagaaggacaaggctacagtgagccatgactgtgccactgcattccagtctgggcaagagagtgagaccctgtttcaatgggaaaagaaaaaaaattaagaaaggtgcaggggcaaataatcatctccatcccagtccattaagttccacaaggttacaggctctttccttttatctcacttctaaaagacttctttggaatagcgtgtatacttttgttttgcattttaatagtttttacctttaagatctcaactttaacatcttaaaactttttttctttttaattgtagatttttggaataatcacagctatcttaaaacttttatgctcctaagcccttagaagtgagggcttgatacttgtagaagcataaataaggccagatgatgcctttgcagaggcaaatctgaacctagtagttgggaggtccattactgcgtctgcttctgaaaccccaatagagcactagcaacaggtagctattgcatgcctgttgggtgccaggcactaaagagttgggtgccagctctaaagagtagtgagcaaaaagaaaacatcctggtatgctggagtttattttctaatggacaattaacacaacaacaaaatgaactacacagtatatcagaaggtattaaaagccatagagaaaaataaaggagggaaggggctgatgttacagttggtttgtattttaaatagggcagtctgggaaggcctcactgataaagtgatacctgagcaaagacctgaggagctgagagagtgagcccttggcacaggtgtgggaggaggcagcagcaggcacagattcagaggcaggaggatgcccagtgtgtgggtggagcagggaggaggctggtgaggctggaaagggagtaagggctgaggaattgtaggaggcgtgggaggaggtctctgcagatcattcagggccttgtgagacacgtaagactttcgccttttctcagagtgagatgggagtcatgggagggtttctccctttttcttttttcttcttcttcttcttcctttttttgttttttgttttttgtttttgagagacagcgtcttgctatgtgttgcccaggctaggcttgaactcctgggctcaggagatcctcttgctgcagcctcttgagtagctgggattgcagacatgtgccaccatgcttggctttttatgggagggttttgagtggagcagtgacatgatctgatctacctaaagcagaattgctctggctactgggcagaagctggggaccatttaggtggctgttgtattgatttaggttacacttgatttacactatccaagatagtgtagttggagccagggtggaagcaatggaagtgatgagaagtgtttggattcaggatatattagaagggcagagcaaaaaggatttcctgatgggttgggtggagaagagttagtatgtctgcaagatttgagcctcagcaactggatcgtgtgctctgccacacactcctttttatccatggcccttattggtgtccaagttattatcaagcagtcactctgatcccaattgagaaactgtagacactctggtagccaggagaaatacttctgtggtcttctgagccattgctcagaagatgctaccaggttagttaatgagagagaacttggctcaccagtataagttacttagtctttcttgacaccttctcattacacatttggcatcacattctggggaggaactgtgatagatgttggtgccatccaaacctgcacctcagctctgagtctgaagaatgcaggaaaagagcagaagagtaggaggagctaaagcaaagataaagaatagagagatctggaaacttgtagtacaaaccactttgaaaaaaagactatcaggagcagtaaaatgtgtatctttccctggtgttttccctttttatatctacctttcatagcttccagttgaaagataaaaagatgtgatatttccacaataactggagtgggaattaatggactaacatggaatgtaacaaaaacaaagattaagtcccacatttagtaattgagagatggcaagagaagagtttatggatccttctagtcagatacatagaagatacactggctttccaagatcccactcttgcttgcacccaccgtaatctctcctacttaaataaaccaccaagcctgctgtgagagagtacgaggacatagtttgctacgatgttggccaagtatagagctgaaaaatctcaccctgtttatttattaggaatcttgttttccatccttgccttgctcatgtggggctgagtaaatcttaatctgagttcttatctcaggaagagcaaagggtagccctggaagccttctaaatagcaggtgcaggacagaatgaagaggaaaagagagggtggagaccagtggaaaatatctttgagaggccaagaaatccataaggctgatgagctagagaaaggagcaggtggatgggtgagctggtgcctaagggcgcaaactggaacctaccgggatgggatgatagggacaccagatggactggcgttgggtcaaaccagatggtgggcttttatttttaaaaggatttgtaagtcctaggaacaaggaaccataagggtactgggcctttaatcccattagtagaaaacaaaagtgtgctctttaaaaatgtaaactcatcaattatagaatttatcaaaactttgggacagactactcacttgtgaaaccccaaggaatctctggattctgtattgatggaaggagaaactgaagaaatagtctaggcattataagttaattaaagactcctccttaataatttaaagtgcgtttactaagtttacattccaaaccaaacaaaatatgatatatttgtatgaaataggctggctcacatgtggagttgggagaacagctagcagtgtaagtagggactgatgaattattgagtaaattttgagttggtaatgagaaaatttttaaaatttaagcatctattgctttcccaaaaatcagacccctgcaccccacctccccagttgctgtgtctagcgcaacctggcctcagtatagctacagctgctctcatggttgctaagacatgagagcttctactgtagtccttgtctctatcccagccttaattttagggtccagagctatttccataatccctctacaacggacttattttcaaggagaccagactcttaagtgtagcctggagccatcagtttgtgctcccatgtggcatgagtgtggatgctgtgcctgcagagccatgtgtcccttgcatagacatgcagaggggttggacgggagggtttggtgtgctacagagttcatgaggaatctgccttcttcgtattatgtaatagccgattctcctgctgataggaacactctaatctaaaaaagtcaataaatgttaagtgttaatattaagagaaagttttaagtagtgtgattagttgttaaatgacttttctgtttagaatatgcagatatatccattaagtaactatcaataatactgcatcattttcaatgctatttcatagatatatctttccttaattacttctgaaaagtataactgtcactttgtagttgaagttgaatagagttgctttccaacaccactgactgtttttgcttgcttgttcattattatctctacaggtatggaaacctgacaagcccaaactgtgaagaagatggaagccaaagttcatcagagtccaaaatggtgatcaggaagtgagtctcccttttctttgcattctaagctctcagtcaagacaatatcttaaagtagtttagtagagtattttattcctttgaatgttgccatgatttttttttccatagtgcatacagaggcttattttttgattacctaacaatattcatttatgtatccagtgaaagtatcttaagtaaccactgtctgccaggcattgtgctaaggtatacaaaacaaacaagtgaagaaaacaaacgaacaaaataaacagtcccagctcataaaaagtgtgtattttaccagaaagagacaaagaatacacacaaaaaagtgaagaagaatgaagcagggtctgagggctggagcgtttggctatgtgtagggtgcccggattgggctgtctggtctgttggcattggagcacgccgaaatgaggtgtgccctgagccttgcaaatagccaggccgacagaccacgggaaagcctctgaggcaggagcggtgtttgagaatcagcagggaattgcatgtggccggagcgcgtgctaggggatgagcactgtgaggtgagcaggaaggtggccactcacaaggggactcatagcaacttggggaaagatgttgaatttgattctgaggaagataagaagcgcttagaaggttttgagaagagtgctgtggcctgacacatcttaaaagacccgctctggctctgtgtccggaaagtagcctgtggcagtgtggctggggacaagggtgggagcagggagcctggtcaggaccctcccaagagtccagatgagggctgcttgtggtgcgggctgaagcaatagcagtgaaggtgaccagcctttgcagagatcttccaggtgttggtggcaggacaagctggagtgcatgggctgtgtgagagaacaagaggaggccagatgcttcccagggttgcggtttgagcagcggagagacagaaccttggctttataaaataaggaagatcgagggagcaggtttaatggggagtgtgtatcagaaattcagtcacagacataattagctcagtctagatttcagggagaggcatggaatggaggtataaatttggatgtctttagtttatacatggtatttaaagctatgagactgaatgtggcttcctgggaactaagggcagatagaggagagaagatccagagactgagcctggttccttgggtgtttagagttagggaagtagagcgtctggcagaggagactggaacagagcagctttggggaaggatgggggaggagaaaaaagaagttgttgtgtccccagaagacaagcaaagaaaggatttcagggagggagtgaccaactccctccagtgctgccctagatcgagtgtgagggtctgaaaagtgactcctcctttgcagtgctgcggtctttggtgacttgacaagtgcagtttggtggatggaaaggtgggcaagagagaatgaaggggatgaagtggggacagtgagtcttgttagaggaggagctttgctgcaaaggggaatagagaaatggatggaagatgggttttttttttggttgtatatgtgttttttaaaagatggaagatattttatgctgatgagaatgtcctatgagaaaacatccatgatgcgggggtgggggccattgtaggggtgatgttcctgagtagatggaatgtgcacctgggtgcctgaaaccactagtgttaaatattcattttggggccaaaagtctggggggaatcctgtggaatttttaactcctcagaagagttactgatagactcctttcttcaggagctagggatgtgaaagtagaaagctgagtatcttttttaactcctgagttaggttccatgtagttttacagttttgttcagtggatcataactttccagaaaaccagacataccagtgtaggtatttgaatgtcaagcacaaggtacagtgggaggaacaattcttttgtttttagaagggcttggggaaggcctcttggaggaggttacctttgatctgggccctgaagcatggtgaagattttgttggtagagccgtctgggtataggaaacagtgggaccaaattgggcaaatgcaattttcatggaattttggggaacaacacagaattggtgtggctgcttcatagagtacatgttaggtgagaggggagtcagtggagctgaagctagattggacttacttcatgaagggcattaatttcttgcaggagagtttggactttccctggtaagcagtgggcagtcagcagtaatgaatttttataggagggaaacaatataatctaaaaggtgatttttcagaatgggttagacatagagccttctcgctcaaagtgtgaccgtggacctatagcatcagcatctcctgggtgggagcttgtgagaaatgcagactctcaggccccactcagacctaatggattagaatctgcattttaacaagattctcaagtgattcctaagcactttagagttttgagaatcataggagtctatgaaaactcactaagataatgatttttttagaagaacctttttataatggacattttggagcatatacaaaaggagagatactgtaagaattgagtgtaatctagacttgtgagcagattcagaaatagacatgttattatacacatattttggaactcagtccaatctagagctgccattcaattagccacctgaacactctgaggagagtcacaatcaaaaatatccagagctggccgggcgtggtggctcatgcctgtaatcccaacactttgggaagcccaggagggaagatcacttaaggcaggagctcaaaaccagcctgggcaacgtagtgggactctgtctctacaaaaatttttttaaaaaattgctggatgtggtggcacatgcctgtagtcccagttacttgggaggctgaggcaggaggattgcttgagcctgggaggttgaggctgctgtgagccatgatcgtgccactgcactccagcctgggcaacagagtgagtgagaccttgtcttaaaagtaaataataataataaaaaaatccagagcttctctgtcccatgaggtgttttgagataaaatagattttttgggaagtagcagttaagaaaattgcaccctgggtatgaagagtcatgttcattcttttaaagtctcattcgaattcgttgtatactaggaacactaatgtgaatgaaactccaagctaagctgttttaaagagttttagagttttaagcatatgagggcttaacaaagagcttcacacagaactcccctgaggggtccatcctctggggacaatggtcctttcctaaagtctcacaataacttggtggaaagttcttgacccttttgctcagactgagttgccttttaaaaaattatgcctgatgaaaatatgccactttatcttataatgggtcgctctgtcctacagattctggaatgttaaaatcccttcttactggtgacctctttcttccttccatttccctttcttctgtctttctcactgttttttccccacatcttttattgtttttcatctcacttcactattattttttggctctctttttctgaaactatgcttctcctgatcatttctgtgcctagatagggtcactgctttgtctttgtctttgtgagaggaaatcagggaagcatcttctcccatctgtatgtaatgtattgcaaatttcctggtcatcccagacctctggcatctgacttgcagcaatgattgagggcttcctgatgatcaatagatgtgtaggaggtatggcagtggttctcaacagggcgattgttatcctccagaggacatttgccaatgccctacagacattttggttgtctcaacttggtggggggaggctattggcaactcatgggtagaggccagggatgctgctaaacgtcctagcatgtgaaagtttcttgtattggttcgaaccctaaaagcatgccaacagacaacacaaagcggtgtggagcaacacactgttttaatgagtgcctgggtgcaggcgggctgagacctaaaatgacatcagccccaagtgaggacgggacaggggctttgtagtcctctgtaaacaggaagtgtcccagtctgacgtgactgctacgtagtacctggacggcctctttctcggtcttcaggggtatgtgtcttccggccagggtaggtgtcttccggccagggtagttgtcttccggccagggtaggtgtcttccggccagggtagttgtcttccggccagggtaggtgtcttccggccagggtagttgtcttccggccagggtaggtgtcttccggccagggtagttgtcttccggccagggtaggtgtcttccggccagggtaggtgtcttccggccagggtaggtgtcttctggcccgctgtcttcctgcttctgctatcttgctgacgcgtgctgctggcgcaagtggccttgagctttgggactgggcctgagaagggaggagttactcatcccttcaagctttcgggcccgggggagaatctttcagcatgcacaaagtaactctcctctaccccaacaaggaatgatctgaccttaaatgtcaatagtgcctaagaagccctgctatgtagtattgaggctctagttctcaagtgaaactgtctttatgaatacctaacatacataaaaataggagcaggcctatttggaaatttctctatttgtgtctctttttataagtagctgaatcaaatgtggaagtgattcagaggcagccacatggagagggaaaggccctggtgaaggagcctggagaactcggatcctgctccttctctatcactctgtcacttaccagtcatctgaccttggcttagtcccttcacctccctttgtttcagtttcttcacctgaaaaatgagtgcttggagtaaatgctcgctgaggtccttttaagttcagtgatgtctaagataaaatttatttagctttttctttctctcaaaaaatgaataacagaaacagagatatggtccacacagcatagtggacttttgagagtacggtaccttcgaccacttttctctgttggaaagtgtgttaccagttttgaagagacaggaagaaacacatacacaagctttgtttgttattagtcatgacatcacagctgctcactggggtcatgaataaagagctgagctaaagcattgtcttgtgggagtaaggcaaggagtggcaaaatgcccattgttttcttttgctatgaatctgttctcttgtgatttcaggtggaaaaccgacagcaggaatccaatgacattcaggaagtaaacatcctgtttagggcagttgccttcagttttgcagacctgggtggaggaggggatggggacagggactcactattggatttaaccatgaacagaaaaatgcccaaatattgtttgttttcccgttttagctgtaaagcaaagagcaacccttacattttatacaggctcccaagtaccaagtaaaatctttcctgtatttccaaatatggatttaaacctttcagagggtaaaagaactttaaagaaggaaaatgtggaaatacagatgaagcattcaagatgaaaaattggtttctgatgtcttggaccacaaccgactagtgttcttcatgcatttaaaaaagtatcagattgtgcagggactcccacatgcggagtacttgtaattccagtccagagttcaggctttgcacaatgtcaggaccctctaaagttatctggctaagacaagaatgtgttcagttgcaaaggattcaacttccaaggcttctggatgttggaatctttgcctcacggtgatttctgatggtagggctagactgattatataaggtgtgccacatttatttctaggattcctaaattggccactatttatcaattaggaaactcactttctatgacagaagaaaacatttctgcctatattcattctacccgtgcccttttcctgctgacatttttacacgataaaatgctatctttttaaataataaaatctgaaccagatggaaaaagtgaattgtctctagggcagatttattatagtcattgaattcagaaatgaagagaatgtaaagaagggatattaaccatatagagcttttacaacacgaatcttcattctctgaattttatatgagatggccatatctccctctctctatatataactttatttaaagagatttaaaactcctcaagaaatgatgctttatttctttcctttaatgactattataaggttgaaattgtttctgttttcttttctttaattgaatctcatcagtttccttctggagtgccaagttttgttttctcaaactctctaccatagtactacttcaaattgttgaaatcgttctgctttcatttccacatattcagaagatacgtatattgttcttgtaatcttttcccagaagttgtaaacagtgacaccagatttcagtcactggtaaaggatcatgtaaatagtagtaatccaagacatcggatacactttaaagagaaaggaaaggagttaaaggaagttggctgtgttacattactgcctcagaaacttcacagtggaaagttaaaaaatcttcccagagagtttgcaatcaatattcattcctgcaaattcagatgccctaagaaggcaattgaaattaattggagtgattataacaaaaatggggaaaaggaggaggggtgaagaacagcaaaaacaagatttaaaactccaatttagaagaattaaaagttataatgtgaaaggaattttttttaaagtgaaacaaaagaaatgaagaagtgatatgccatatcgaagagtctggtattgtctttaaaatatccctacaggacaaagaagaataaaaaccatagttttacaagtcattagcattctaagtcaagtctgcattttagggacatgggtagaaagccctgagcagaaactgatgttctaatagttgaggaagaataaaacaacattgataatcaatggctcaaaaagaagacagatcaatcatacgagtatctcctagggttttctacattaaagaatgtctcttttagaaaggaaaacagacatcacaattagactgtattgtttgattccctgcacagcattgtaaacaaagaaaatgatgacactgcccttgccaccaccattggctacaatttgtggtatgcttacaaggcattctgctaagtactttatatttgtgtcttcttcaaccatcacaaatatgctgagatattgtcctcactttataggatataaagtgaagcttcagagaagttatgtgttttgactaagatcaggcaggtggttaagtgacaggtctgatatttgaactcccgtccaactgactccaagacctgggtgggaagcccaggcatgccatttatagaagagcattgggatctcggatactcaagatttttctccgcatttgcctatatcaccataataagactgcggaagtacatgaagaactagattacaatatcattgttgtgactaatgttttagattgttattattctgagatcttttgtcattatttccattgctctatgctgttttgcctggctgttgctttattattgaatgaacaccctgagcaaggttcgcacacagctgttagaaatgtggaagctagacctttttcctggggaaggagatgggttgaagaatgtgaggaaacaagaccaaattaggcccatcaaaggagaacctgcttcctgttccttgtgcctcgtagcatctgtcactaccaacggaaactcagttctagtggtgaaaactatagaaggccttagccatttttttcaatagagttctatttataacatgaaaactcccttcttggactgtggggaatgagttattgaggtccttgaaagataattttggtgactggcgatgtccttttctaataatagctagaatttattgactacttagtaggaatggtccctgtgttaagtactgtacatacttgttaaatcctcataatgattatgttttattattcttattttacagaggaggaacctggggcgtaggttaaggaacatgtccaaggctacacagtgaataaatgaaagagctgggatttaaccgaggccttaacctctgtgctgcatgacctttactatttttcctctgataaaaatgaaaatatttctcttaagtacttagcttgggaatgaaagacaggtgtgtaaataaccttgactttgggtaattggcttcaggcttatccatcctactccgggccctctcccactcacatttactgtctttctgtatgtcttcctttcataatctttttcttcctccttcttgccgtggaggtttttttttttctcttctctcccttccccatagtccctgcgttgcccttgccttcttagtgcttaaatctgactctggctttgttggcattatttccctggtcttttctcaatctctctttcacgtctcctcctagtatttgaatccctgtttaccaacagcactgaaatgtgacaatgtaaagtgtaaaaaagcaacgcaggacaaccttgacaagtccagataataatattttcatcctttccaggaaaaaaacaaagaggaaagctttgtatctttctttgttccttctcatcaggaaaatcatctagctggaggtctcagaggcagcttctatctggcaaccttccctgaaacagagcaaaactgttctatgattaggagaacaaggtggagggtccggcccagagtcagggtcaaggttgacttaggcttcagttcttgaaggacaaagtgtattagatcctgccctcagagcttggcagaagttacttcattgcttgaaaggcccaccgtctgcgtaaatcttcttaccttttcattatctgcagcgaagacaagatccagttctcagagaatgtattaaaatagaaaaacattttgctgcttttgaaaaatggttccatgtcttattttctgctgatgattaagtacaaaaaattattatttcaaatagattgctggggagagaaaagaactctagatggatagtgttattctttttgtcacggtaatcctatttcttggctcagaagttacacatcatgggagaggtgacttcatacctgaaaaaatttgtattaaacatttgaccaattatagagtattttactgcctatggaatgttaatatgatttaatacgtttacctaaaatctgcattcattaaaaagtctgtgatttgcgcataatcgctgcctaaatgcttgcctcagccctctctgcattgcgtgcctgaagatcgtggggtggctagaagttctgaaccattttcttttatctctcagccaaggtgcatctgtctaatgtcttctaagcaggtgttattaggtgtgatttctggttggctgagaaatcaatgagtggccagctgcggtggctcatgcctgtaatcctagcactttgggaggccaaggcaggtggatcacctgaggtcaggagtttgaaaccagcctggccaacatggtgaaacctggtctctactaaaaagaaaaaaaaaattagccaggcatggtggcacgtgcctgtaatcccagctactcgggaggctgaggcaggagaatcgcttgaacctgggaggcgaagattgcagtgagccgagattgcgccactgcactccagcctgggcgacagctctgtctcaaaaaaaaaaaaaaaaaaaaatcaatgagtatagcagatttcatcatgctcctttcccccaactctttatattttttagtttaacagatctttaagtcctctacaagtgtttagctctttcaccgcagaacctctgcctcattgctgccccagaatcctcatcccactgactcctaaccctcaagatctcagctttcacatcatttcctcagggagatcctccctaaagccttgaccaggtcagctccctctgaagttcagtgcttccctgggaccctggacttcctgtattgtgatgctcatcgcataaattgtttttgtgactctgggaaataaagggcactcaacaaatattagtttaattggtgaatgaatttcttagaagcaaaagtcctagaagctgctttagtatgtttcaaacagtgacatctgagcatgtcttccttcccctatagacgattgcagtcggttggaaaagaatcacacactacaaagttttgtatgttgccaagaatgcctgaggtagaaaactcaattttggttgtctcctctgctatcagttttgggcccctggccttggccacctacccggcatacttgcccttaggaccgaggagttttgttctgtgagccaccaaagattactttggaaaaggaagtcacatactggcttttctccagactgaatttaggttatgtcacaattgtaatcatccagtttggcttcaggaattacttctgcctttacaagttattcaagaatcatctcttgcagttaatactacagtttgatgtctttgatttgtcctagagaggatacctcaaggtatatgtatgtgggcacatatgtgtgtgtgtgtcttgtgtgtgtgttcacagcagccatcttcttccagcaggcctgaagtcacacatgtcatagcatggcttgtattctgtgtcattcttcctgtgagaggtggcagattctttgagtcaattcctgtgagtgctgatggattttcgctgagccattttaccttttcaatcccttccttctatgacttctggcaagtagttgtaagactgttgataattatgtttctctccaggtatctcaaaatgtccttattgacattatatcatttgaaatcacaactgatcagtgtcaggtagatgaagaaggtgttattatatctcttccccagagaggggggtcagtggagttaactgacctatccaggcttccttagttccccggtgggacagccaggatgaaagatagagttttctttctccaggtctccaagcgtcctgtcttggtctgtgtacagaaccaagtggcttctgtagtctaacagacataccagacctgtaaatttgtgacttcaaaccagaatttcccttcagctgtaagattctttacatccccccactctgttctggttaatatataagttagatcttaggactggagccaggctgggtaagaccgaaaagccattggccagtaatcctgtttttcttttcatcattattttgcgatgttgctttcttttttgaaatcttaaaagtttcgcatttgtatctgcttctaaatctatcaagaacggaaagtttcttcccaggactggcacacacaaagctactgtgagccttgggcatgtgtccaggcctttccagaaagcttccctgcctggtgtgctgagaaacgctctgccgatgaggagggcagggctctgcctcgtgttctattgtgctgtttgtgtatgtctttccctttctctgtttcttcgtcctcctcccccttcattcctcttttgtgtgaaaatgcttttttctggctgattgagtatctgagtttgtggtgaactttcaaagccttcttaggctaagctacaggaaggtcactgtcacaaagagtaaaaaaatgtatagatcgccagagttcattaaaaacatcagattgaggaacacaaaatgtccacctaagggcaagtctaatgtggacgaaggctcctctttagaactctcctagttcttctgaggctgcagctctccatagaggtaagtgctgtgtgcccatcagaaatacccacacgagcatgcagagatggaggcaaggatgcacatattttgtagttgtgacaacctgaaaataacttaaatacctgccttccagtagaagaatacttaattatggtgtgtccacatcatgagaaacaataagatagatctagaggtaatgatgaagtatctgtaatatactgctcagtaaaaaagcccatgttgattttctttctatctatctatctatctatctatctatctatctatctatctatctgtctatctttttttttggagatagggtctcgctctgttacccaggctggagtgcagtggtgtgatcacagctcactgcagcctctatctcttgggtacaatcaatccacccacctcagcctcctgagcagctgggactacaggcgtgtaccaccacacctggctaattttctgtattttttgtagagatggggtttcgccacgttgccctagctggtctcgaactcctgggctcaagcaataatcctgtctcagcctcccaaagtgctgggattacaggcgtgagccaccacacctggcacatattatgtatatttaaatatgtatacatatccacagaaaagcctagaaggatatattctaacagttaacaaaaggtcctgggaatgggattaggatgaagggagagagtaggtattttgcttttttagtttatgtacatttgtaagacttacttttttgcaataaataatgagttttatcataataattaaggatcacaggcatttaagaagtgaataatatattagcatcactgactcttacctgtaattttgtgtttccgtctgggtgttcttttcagtgaaacactgtcttgttgttaggctgctactgtttttgacttgagtatatgatatgaattatcacctctccatatctgtttttccatcagtgtcatcataagagtatcttttcactgaaatattaagaaacattaagcaagtatagtggtgttaattagattaattcatccctctttttaaaggtgcaaaactctttttctgtaaaagtcaagctgatgtaaatgcaaatatcaggttttcaattaatttctggctttctggaagaaagtgaaattattgtttatcatttcatttaatctggactaaatatttggagtattgaattatttctatgactttcatttgatggtttcatgtatctactttagatgcagataattgaatattatagttccaaatgctttaacgttccacattagtgaaacaatgatctacaccataatgaaaacagtaacacatttattttctttctgtttgtacttcaattccaaaagttaagcattaaattggctttagtcatacttatgctttgatgatagtccagcttcttggtgtgaaatcaagatgtgaagaaagttagacacacctgtgaaagcccagccttcactttcacatatgtgggtaataacttagtccagttatagtttgttaactaaaaaaacaatttctttgaagtataattaggtgataatgataattttaaaatgtgctaaaaaattctttttggctgaaaaattttggtaaagtgtttagttaagatgaggtgttgtgtctctgtcaataaaagatgcatggattaatgtatagtccctgtcatcttctccagccttcagcagtgactattccgggaccgtatggggtaactggttgctaggcaggcagagtgttctgttctgttctccttgtctgtggcatgtgattgagtcaggagtgttggtaaagtcttctttgaagatgaagcatagaataatagcatgcaaaacattttatcctttttatccttcagctatttgtctctagccttcagtgagtgggtgccccaacctaaagacaacatgctgtgttattactaacatactggagggagctgtgcacatacaaatgaccctgtctctttttgtgccctggaaccttgtcttcccctaggtggactctgtgacccacagagccatcagaagaaatcacctttgcttatcaagtttttgttctttatcttttaaagacataacttctctacctactgtttctgctacttgaaacatattcctctcattgtaatttgagaaacaaaaggataattttatgaggacattttcagtgttcatgctgaagccctggtgatccttgtcaacttgaatttatgcatttatctttccacactcaggcacttcctttcatcagatggatttctggcctaccggcagtcagttatttcctaacatattaggtggcagattttgtgggatttaatttgagcataatcttattgtgtacagattgctttgaagtttcttcaggactcactaaaccttctacacatcaatttttctgccctgtatgggtttttccaaagtttagcctccttaaaacaaacaaacaacaacaacaaaaaaccttatcagtttcactgcagcactccacttaaaacaataaagtttagtttgttttcaagtgctttaaatccattgatgtttctaggaacttttggatgaatgatctgttgaccacccacccaagtttccaggggtgcccctggggtccaccctggtgtccagggattgctttgcctccccacagccagttgggtgcagtgactctccatttgtctttctcagtgcaatcgcttccatactaagggcctggcttgaccagtgtgcagaagacttccgagagccccctcacttcccttgcttacagaaactgctggattatctcacacggatgatgccgggctctgacccagaaagaagagcacaaaatcttcttgagcagtttcagaagcaagaagtggaaactgacagtgagtacttgtttgttcccagggaaaaggctagattctgattctccagcctccacgctggagaaaggttctccctgtgctggctaataggaaaccttggtaccctcaaaacaacatgctgctggaggattggcttgagtataaaattctcaagattactgaagtactaattagagagcctagaattttagacagagaagggtattttcaagactacctaatctggctccctcattttatggatgaggaaactgtggaaactccagctcagaaaaattaagtaatttcctggggtttcttctgttaccaagaagagggtctccttgatgaactttaatcttcccttatcaacatgtaccatgctgaacctgaatttgcattttattacctgtttaatggctccttctagccttccatcacaaccactcccgtctagcagtcaaggaatgaagtctagttctgatcctgccctcccaaaagcttggaaaaggtgtttgtccttcagtatggaaaagcatcactgtaacgggtcccctgccagtgcagattgtcatcatttagcatctataagggcctcatcaaaggaagtttctgcagctgtttttccctatttgaagattaacttcctatttgcaaggacaaaggaaaggccaccactgcaggttatgaggtgcttggaactattaggctttgaagaaagtcagaaagaggctgggacaggcttccagtgtgatgttgtatcctctcactggggtgctgggtgacagtttccatggtggctgacccacttggagcttctgacaggcattaccctgaagggatgcctgacttcatcagtaagggaaaggaaatgttcctcagcaccaataaggaaagctgcatcagctccaaagaaaatagacctaaattccaaacaatacctgctgaatttcttatggatgggggtcccagagagagggaaatgcaattgcatcattggaagctgactgccaaatactctatatctcagatgacttcatctgccaggaatgtttgaataccaggggcactcctccagctgcggacctcagctcccttcagggcctccatgcctggctttgtgctggagtgggaaacgctgtgttggagcccagctctccccactggggctgcccctggctctgagcctaattggggaaccggtgggaccagtcattcattgtttccaacacagggactgcaaggcagagctcatttggcaggctgaggcaggggagagggagattgcctcagttcccatgtgcttgttttacccaattttactcctgcggaagaagcaagctctcctatatgtttttaaaaagtaaaatcgtgcttcatgttgttacttatctctggaggagaatcaaaagcagaaaacagtgaaggcatggactatgccccagagagaaaggatcatgtaatcttcatgcacagcaacattatagacacacattgggctgctgtgtttgctgaatgaatgaatggaaagatcaagccttagcacataccctgctccttgactgaagtgggttaggctctgcattgcagggcaaatgggatatatgtatgtatttgttgacaagacgagggagaggccgtttctgaacctttatttgggatcccaagtttctaattacacctctaaattaaacagtgccagagttgtatggaggaagaatgatgaaattagattgcttaacatcctccatgtcatggggttttagcttcctttagcttgtacctgtttgtgtcgcagactccggggataggcagtgatccccttctacgtttttcagtcataacccaaccccattggcatctggaacttcaagtccagggtaaaggggcaatcctcaaatcacatacctgccaccagtataggcagataaccacatgctgccctaaaggggaagtggtgtagggtccactctcggaagctccttttccctggaaaatgaaggaaagccactgtgacttaatccaagatgcccaatagtctttaattctacaaagaaagaaagaaaaggctcaaaatataagcattctgggggagtagtaacatgctgatttacatttctgctaagatataactgaatgtaactagagttttctttccttgagaacaggtttgacaggaaggagtgtgaggggtgtgaaggggctgaggttgggaaacaacccgagcactggggaaaggttccaggaaaggaaggctggggatttaagtcagaaaaccttcatcaaattccagtctttcaaaatggagactggaggtcctattccaggtgtgggctcttctgctttttattcggaatcctgggtactgattttctcttcttcatgctgtgccctatgtaatttgctaattgatgatcttggctgtgataggttcaggtgaatttagttgaagactgttctgcttcatgcattcttagctttgggtggaagttgaaagtgactctgaacattttgagaattttgagggcttcgtcagcatttctaacaccaaaatggctcattttattgcccaaagtcatacctgccttcatggcgagtccttccaggcttctggttataagtcgcccagcaaccaaaaattgcatggttggggtttaggagttagttggattagtcctggagctgatctgatcaaaaagtttgaaagagccctagacaaagggctctctctagactttgcctatcctggctctgtccttggcctaggagccagtgatttgtcagagtgagagcatgagggctctgatcttaatagagaatctaagaacaagcagagatgggaagatctccattgttctcagatgcattgtgcttgtggttgtctccctgtggctgttctggaggattggccctcttcttcctaaacaaggagtaaagtctgatgactctataagcaagattatatacactggcgccaaattactaatcttttccatatgtgaacagatgggcttcccaacacgatctccttcagcctggaagaggaagaggaactggagggtggagagtcagcagaattcacgtgcttctcagaagatctcgtggcagagcagctgacctacatggatgcagtatgtcttctctttgtgatcagatgtactttcacttaaaacataggggagtgatggcactggtgccccggtgacagcagtgggataatgtgattttaagtcttcttgaatccttgagacaggctgcgcctgcagatacagagttaagatgtgtcttgaatcaatcatctgaataattcaggcctgagctcttcttgcaactctaggagaaggtgcttttggagctcaagacacagagggaaataagaattcgaatccctgtgaaacaaaatctgccttgttctgtgggtatttttctccctttacactcataaatatttcaagatctgaactgtttatttggaggattgtaaagggatcaaagtataagttagaataaaataaattcacagaatccacatgtgattgtatctggcccctcatttccacgtgtgctttctgtacttttgaagtttgaatatttttgtgagctggacatatttgagtatgtcagtcagatttcataggtcggtgttagatggtaaatacaagaggactgtgaggagttatcgtggtggctttagctcttctgctttatcacttttgacaaggcagtgtggaacagggtggagattttccttctagtgaacattatcgatgagtatattaattatttacttttgtctgttgaaatggacaccatgagacaaatcaagtagaaaaggattatctggccattcacaaaaataccaatttacaaatgacccagatgacatgctttgccatatgaaatgtctgtgttgtccttaaagtcagttcctcttttgttccagcaactcttcaagaaagtagtgcctcaccactgcctgggctgcatttggtctcgaagggataagaaggaaaacaaacatttggctcctacgatccgtgccaccatctctcagtttaataccctcaccaaatgtgttgtcagcaccatcctggggggcaaagaactcaaaactcagcagagagccaaaatcattgagaagtggatcaacatcgctcatgtaattgtcttttataaaatattctttgtgtttggtagatgcaagagactgctccatcacttcgtttaaatggtttagctgtttggttgaaaaggcagtcaaaagaccatatatgagagcccactgggtttttgttgttcttccagagtaagaaaaaagttgcctttctaaacttggcagcttatttattttcctcttttttaaaaaattggacccctgctcacttcttcccagttatgggctctcacactgctacctctctagagtgagacattctgtctgctttcccctttgtattcacgacaagactgagtgttggtttcagcaccatgttcagtaaatataaatgtatggtctgcatgtcaaaacagactgcccttcaacccagagtgattacctatgccccctcccagtacctggaggcattacatcttctgcagttttgaagagctggtacttcttcagagtcctgaatctcttttctaaaggactgagacacttacagagatctcatattaatctgaggtcatgtctcatattaatctgaagttggaggggaggagtctgttcctaggcctgactcacattcttctgagtgttggagtctagtctcttggatgaactgcttacataccataggacctccccttctcagcatcttatctcatgactgagaaaatggcaacagtgtgcagtcagtgggccaccaaatattttgtgaacttctaatgtgtgtaaaccacaatattctgtacttaggggacatactaggatagagcataattatttgtttgcaggaacccgtacacaaacaaggaagctaagatatactggaattatctcagcctgagacagtagaggagtagggccatgggagataagcactgtaaaagtgggggagagagaaatcatttctgatgggatgatcaaggaaggtttcatggatgaattgacatttgaaattaactttgagtaacagataggatttttggtatttgaagattagagaggtttttttttttctaggcaaaagaaattacatcagcaaaataatgattttgaaaaattattaatatgaaaatatcatattaatttgtgttctgggctctatgggtaaactctcaaccaaaacacattttgctttatgtccccttaaatatatttttccttgagcccctattgatagggcataatgttacattctcttttgctgtctttgattaaagagcagagacacaattgtgccagataatttgccttgagtcttcaggtggtctgttattacagacttcttagtgtattatgaaagtcagcaagaaacaaagagtgtaagttgcataaacaacttctatttctcctattctaaatcgagcttattgctcagcaagtaagagatacaaaagaagttgtgagtgagatatagtgtagaagttctctgtttttttagaatgataaggaattatttttttttttgccataagtgtcacagcatgtctcaaaagcagactgtctacccctaattcattcaactactttggctatagtgacaatatagcatctgtgtatgtgacatagtggggctcaagcgatgacttttggtccaaattgaatgtaaattgtgcatttatgtagtaataagaaatgcaagttgaatcatttgaagtatatttcaaatcccatatcatgtgctaataaagccaagggctcttactttttttttggtgatatcacttcctaatactgagtatgttgtatcttttacaattgtgtagggaaatgtaataaaataatgaggcttaccagtggtttgctaccaagatttattttacctttcctgcattcatcgtagtcaatttctattgaaaggatatttgaaaaagaaaatttttctgacctaatatgactatattttcttggactgcccttaatggtatgtttttacttttgcatcacatctcctggaagatgcctctttttctagaaatgggaccagatgccttttgtactcctttaaacccttagtttaaacctctttttgaataatgtgttccatgtgtttatttcaatttgcatgatgtatctgttcctgagttcctttttttattgcaagtttcctgatttttagaatataacttttgtgaacctttgttgaaccatgctcccataggcttagtttccagattgcaattcagaacatttctcttgttctctctctcttcccctccctccctccctcttttcctccctccctccctccttcccctccttcttctctctttctctttatatctttccaaataaggggaggacattgaggcatttaaaaagggtggacatgacttttattaagtactttggcatttactctaaagaaaatgtttgagggtttgtttggcatagttttcagtgtccagattttggcatgctaaattagagtgctgtttttccttcgtattcaggattaacatttctttgtgaaatgattctcgaagtgatttacatttatgcccaatcactctgggacttcttacctgagatactctacacaaaaccaaatacgtgctcacatggtgtactcacttgtaaacactgggcctagtacgctgtcatgtgcctgtatatgaagcatctcctttgacataaggcctggtccagtctcctcacgttgctaccttccccatgccagccaagaatgggactttctccctgtctgttttgctgtccctgctattcagtcacaggactttgactccaaggtcactaactgctgatgctacaggctccttatggtagcttaagtttaaatagggagcctctctccttacccagaaaatggcatccagaatgtttcctgttctctttctattttgttttaaaacattgccaaaatgaattttattttaaaaggccgagttattttggaagcattgaagtaccaaggtgtttttgaatgtttatggttgcaggacaagccaatttgaaaccaaatgaatgtgtataaaaatatccccccttggctaagagcataaaagccaaagttcaacttgtggtgaatttttattgccaaattatatacacctctgtggacaagggttggtgatgagatgttcaataccatctgacctcaaagtggctgctgcccagctcattttgggatctaaagaagatctaaagtgcatatttttaggacatctgtgtgctttcagcagaagaaagttgctctttctagcatagctctgtagacttacctccattagtgtttttactaggaaagctggaaactataaaactgtaacaacaacacaaaaaaatatattgacgagagaaaaacaagcatactgtgccaaaatctataaagtgtttcgatgactggggtgggaggaaggagccactttttgatgttcactatttatacagctgcctattttgtggtaagaattcatagcagctgtgatacctctaaaacaggaaaccaccaagtcattgtaatattgatagttaaatgccttttatgttttaatcactccccatgcaggaatgtagactcctgaagaatttttcctccttgagggccatcgtttcggcactgcagtctaattccatctatcggttaaaaaagacttgggctgccgtcccaaggtaagttcccaagtgtttgctctgcttttctttggccgggataattagtggttgtgatgagtcctcaccttcaaagcttgtatcgcataactagagaaacatatttgaaatcctctgtgtgtttcaggcagggtgcatcttacacataatcattaatgacttttgaggcagggctcctgcagaaatcaaactcattctaagtataccaaagccaagattattggctttggggatgatttgaaggatgtgcttattatctggattttgagggataaggttgtggagtgatgaagttacagcaatttgccattacttctggttatttttcagcctcactacaaagccctaagctattttaggactcaaggggtaatgtgtgcagataggacattagttcttgatgttcagtaggaaactatttagttgtccttttagtttcagcattttaaaaactatcttattggcattaaaaacctttaaatgttctttcctaagtacctgaaattattaactggccacatcctatgctgtttttcttcatatttcttggtgcaaccgttggaataattaacaacttggtttcctgatttttgcactactgccatcacttccatttccggaacttcactgtagatcaaagaactttgtgcaaaggaaggaaaggtgagggagggggcagttctgattctctgtcactacagatttagaggctggggattgtgtcatgagtacaactaggccagctacattcaacaagtttgcccaggtttgaactagtcaggaagttaggctatatcagggaagaatctataaattctgtatggtctataccacatgtggtatagtcagtttcagttaggaggagagggatgccagctggcttcccagccaggctgccttagtggggcagaatggaaggtctgggtcctcagtttcataagtttactcagagttgatcaagccctaagagactggcattgtttgaatttgcaagagccccaagctggtaaaccagagtttcataaatttatgctgaaaaatgagtgccagaatcctcaagcttgctgataagctcatattctcgttcaggggatagtctacttggtgtaagccaaattatttattaggtgattctttgatgggtaaaaagaaaaaaataaagtggatgtttataatgcctcatgttacagagctgtagaagccacagctacttgcactccaaagctcgtgctttgtttatgacatcaatatttatcagtagaagaactagcaggcttttcaaagaccaatgcaattttcttgattattattctttttttaggttctttcttctctattttgaataatcaaggtgattgtgtgtattaaagagagattagttggttgattttcctctgcacatttctccttaagaacgatggggtcatataaaatcattacttgataggccctggtgaaatgcgatgggaaaatcagaagcatgcagtgtccccacccttcacacctccacttcacctcttctttcccttaccaccactctccactcaactgtagtatagtatcaaaaacaaagggacagtcaagtgttaaaatgtagccttactcaattgattgcaaccttgtctgattgccacgaaaggtaatcctttctttgatggttgaaaaaagaacactaaggaaagtcacgtaaccagcctaagatttcttccacagcaagtttgagactaaaacatgagcaaaaaaaattaatggacttgtatcttagtctccttggctgccatatgaaaagatttattctagctggcttttaaaactattttctaaagacaaaggaaaaaccctctaagctgcattctgtgtaacatatgtttctggtttgtttcttagttggtttgtatgtgttttagcaaggacactacagaagtgtcacagttccttagagaacacacttctatatcagctttacatgttctccattgctaaattcaaggaacaggattaagataacttatttggacatggtacatctatacagtggaatattttgcaggcataaaaggagtgtagtactgatacatggtgtaacatgaaggaaccttgaaaacatgctaaatttaaaaagccagccacaacagctacgtatcatatacttggacttgtatatgaaatgtccagaatcagcaaatctatggacacggaatgtagatcagtggttacctagggctgggactgggaggacggtagggtcccagggtgatagctaaagggtagagggctgctttttggggtgataaaatattctaaagttgattatggggatgactgcacaactctgtgaatatactaaaaagcattggactgtatacttcaatgatatgtggattatatctcaataaagctgttattgtaagaaaaaagatatcttatttggttatcactttccctataatccttgacatttgtcgctttaagtagacaaagggaatacctatttatttctcttcatttagggccacatataattaattttgaaattattttctccaaatatgaatagcttaatggttttctttattatttagagtaatattacactcactataaaacaggctcttaataatggtttttttcataataatgaaaatgttgcatatatagtgatattgcccctattaattctttgtcttcagaatcatgcactcattaaccctggagggtgtgtagagaaaaccatgaggctcacagagatgtagtgtcctggaaagggagaggggcagagcagatgctttgcatatgtggtttcactcactgtcccagcagtcccataaaagcactgtcatatttcccttgtagaggtgagaacattgaagctcaggaaagttaagcagcttgtccaggatcattcagaaagtgagtggagagatgcaattggaactcaccacccctggttgcagagcccatccggttccaccattctctgactctgggagtagaaatagtggcctgtgagccagaaaatttggcttccatacctacaaccctcagcagttattcgtggaaatttgggaaaatccctggttctggcatcgtcatctctaaacttaggggcctggccaagatgacctctcagatctgtgggctctgtgtgtgtaacagtttttttttttttttttttttttttttgtttaactcactgagaagaacatgtcctaattgaacaacttgatgccccaattgaataatccttttttatgattataatatgcatggctagggaaatatacctctctccacaggggtggccaagtccaccttaaaagaaataaaaagccatcccgcataaaaaaaaatcatgggccttatctgtgcttacagtacccaccaaccctgagatcagcacagtccctccttagacatgagtcctgaggacagctgggccaaaagtgtcgggttattcctaactcttcattgttaatattttcttaatcccttttcatagggaccgaatgctgatgtttgaagaactttcagatatcttctcagaccataataaccatttgaccagccgagaactactgatgaaggtgaggctcttagtgaggctgctgtgtagtgctgttaatagctctggaatccattcaaggaagagtagtgtgagggctccttaagttccttcaactccaaagaaagcctaaagtaactagaaggcaaaaaatttttttaaatgcagaatctaagaaacttggggctgagaaaattctaagtccagttgagctctctctttctacctcccttagcttgcctgttatgcaagcagattgtgaaacttgagttcatatgtgtatgtacctccttaacaagctactctgcaaataccaagtgctggcagttaggtgggtgagaggccctggaatattccttctcagcaaaacatctagaatgacagaggccaagcctgcctgcaattccacatcctttatttggactaaattgcacaatctgtcagtcagcagtatttattgaacaccaagtaagtgctgacttctgaatgacacactaggtaaagatatagcttagttcattttatgtctccagacatttgttgaatgcctaatatttgtaaagctttgaacctgcttctagaaatatgaaggtgactaacacaaacactgtttcctggagtttaccatctaattggggtatatagacactaaacaacaagaataaatagtcaaataaagacaactaacaggttgtgaacaaccatcagaggggaactagcatagaccaaatattatcctcatagtctttctataaagtagattttatcatcatcattttgtagatagccaagactcagagagggtaataacctgccctaaggcatacaaccaataggtggtagagctaaaatatgaatgtaatgtggtgagactctaaaacctgtgcttttatcaccaagacataaagctatttcttctgacctttttggagtaaggtgcaggatggatcagatccagcttcatagagaaggtaaattagtagttcagtaaatattggttgagcacccactaggtattggggataaaaccatattaaaggcagtgtttgatcttaaggggattacagtctcatgtgggaggtaaaacatttataaaatagtgtgataggtcctaccataggggaaagtcctgaactgggcaatcaaaagttgtgattcttatccttaatctccttttctataaatgggagccaatcaaagtatttggtctgttgacttcatagaattgttttgaagattcactatggtaaaatacttgaaagtgctatgcaaatgtaagttattttttgtatttggtgagctatattcatgtaaaaccaaagtatgcataacaaatgaaaataaatagagaataagctgcatatttgagcttagggaagatacttggagtaggagtgaaaatcaggtagaggtggggttagtaagaaaaggcatccaggtgctaacccttaggttagtcgatcctataagggcatttgttaaggtcttcatgactgttcctgtcctatgtcctacttatccttcatgtctcagtgtagactcctccttttctggaagccttccttcattctcaggtctgtgctccaggagaagctgtcatttctctgtcctggcacttatcacttgctctgttgcaactgcctgtctctctactggtctgtaggcctcttgcaggcaggggctgtatgtatcttttcactttgtatccctaatgcccaaccagtgcctggcatgcagtaagtgttcagaagctattgtttggctgcatgaattgatgggtcttatcattcacatgactttttaacaatatgcccactattagcccttcttggagtaggtgatatgagaagggcagtatgtgctgatgtctgactttggatttggactacctgattaactgcacactaaacaatcattactgagatcgtgttactccctgcttcacatgcccctggctttgcatactttaaatggaaacccatctggctggaaggagatggcttagtggtctccctgtcagcagtacgaagctagactaactggagccacacattcaaatccaaacagtcctgagtcttccttccaaagtagataaattgaatactgtgcagctcattgcctggtagcagccttctggctgaaggcttagaagtgaagctgtatctagacattaaagatcccataaacctttcttaaatgcagaagttaccccccgtactctaaattaaatttcttatagatatgactcaaattccaaagaaatggaaaacttggctgtgaattcatgtggtctgtgcattatcattaatgatagtgaaatgctttgggcagtccatgtatatctgtaggtccttttccagtcatttttgttaatcattcttcatatgaagtgtctaattctgagtgtaaattgtcagcacattttttttttaaatggaatcacaaggtacttagtttctcaaaagagtcactaggaaaaactaccggcctctgtttctagtgttactcctggttttatacggatttatggttgggtaacaatataatagtttcattttattttattttttgtagatatgtagtctcattatttttctcaggctggtctcaaattcttggactcttagttttaaatgacctaacttctcttcttctgggaagatgtaacgtgccacttatataatatggcccaggcaacatgattattagcaaaaatctgtggttttccttttaattgtttttaaaaatgtttcatttcctctcaaagactatcttaaacctgctatgtccttgtgatttctgaaacctgggtaattctaagcaggtgaattatagtctggaaatttcaagacatcagggaagaaagcagaatgccagcaaatcttggttctcatgattcttggtaagaattttttcggttgactttatataaaggactgctagaaagccccagaaattcaaccctgatggagacgtatgttcagtgacactccaaaacatgctaaactcaaagttagagcaagagtctgttacaactgtgacagttctgagctataattgctggtagctactgagcttaagttaaccaacatttatggagatggatccagagtccagtagacaagttccatctagacctagtagaagagggccctctgaagcccaagaacagcatggatgagggtagctgaactctgctaaagatggttataaagaaaaggtgagacttaagcaagccatttgcactaagagacggagagggaagagaagggcagagggggagataaaaggagagagagagggagaaggagattgatggaggaagagggagatttggcatttatccaaacataggtgatgattaaaatcatgagattggatagtatttccaaagacatgagtacagcagaaaacaagaggataactttgacaaaaagaagaatcactaagagaatatgagaacagcagaggaggcagggggagagaatgagtgatacagtcacaaaaacctatgaaaactttcaagaaggttcaagggattggtgttgtgcgacattgcagagtaggagatttggggctgaggaaggaaaaactgaaactgctggatgtggcaggtaagtggattttcagttgacacctcatttggaataatagggactcgtcggtctttttagatctctagcagggatggaatctcattctcatgaaatcataaagtcatggaatcaacaagtcttgtagctccccatctcaggcgtttctctctcctatctaatgaggaggttgtcttaagtgctcttttgagatccctttcacctctgttattctgtgattcttaggagcctttgaacttttcagaaattctctttaggaattttagccatgtctacaataacttatgatacattattcctctgcccataactgacatactggagggagaccagaaggacctacacaccggaaagaggtgggcactcttattcaagtcagacataattgatttctcactctaagcaaattctcaagaatttcggaggactcacaactatctagcacaggaaaggcgcatattaggctgctttcttttttttagaggtggggtctcactatgttgctcaagttggacttgaactcctgggctcaagcgaccctcctgcctcagccttctgagtagctaggattacaggcgcatgccgccatgtccagtataggctattttcattcatccctgtgaaaaactatgaatgggagatcattaaatagtggctctctttattatcatttgtgatgggaagaacttaaataggtaatgagtcactgtgggttctgtcccagtagtgtacctgggacctgagttaaggctgagagatggaacatgttgatgctctatcactatcagcaaggccaagccactgaaaaaaacccttttgtggttgtacagtagtggaaggtcacgtgctatggtaatacataaatctcaggaaaagtgactaaggaaaaactagtgtagaagttatatactactgaattgtgcaatttacccccccattcatgcagttcctggaaaatgagaacttaacaagaccccaaaaccgcaaaagcacttaatgttcagtcagcaaactcatgattactcattatatagaagagtttgttgttacaatagacaggaggagagaaagggtagccatgtgtcctcaggcaccaggaggaaggattgatttgtaagagttccaaacctgagaggcaatttagaagaactgactgggggctggggatgtgtgaaagttcgacttttatggattggtcatgtagtacaatattggacttcctcagaaaacttccggtgcaaaagtttcatttagctaagaaatgctacagaagtagtccctttctttcacagaatgctggcacatccatttcaggccaagatcgagaaatcacaaaatgtactgaggaagtcgatctttgttttcaggatatctgattactttgagtttaatttgggatctgtaaaaatgtcttcatttatgagaattgcctggcttgtattgatgattgctttcataaccaaatcaggtgatcttcttacaaagtaaggggaaggccaggtgtggtggctggctcatgcctgtaatcccagcacttggggaagctgaggcaggtggatgatctgagatcaggagttcaagaccagcctggccaacatggcgaaaccccatctctactaaaaacaaaaaataaaataaaatataaaaattagccaggtggtggcgcattcctctaatcccagctactcgggaggctgaggcaggagaatcacttgaacctgggaggcagaggttgcagtgagctgagattgcgccactgcactccagccttcccagcagagtgagacttcgtctcaaaaaaaaaaaaaacaaagttgggggaagaacaagaaaatccaagtccaccagcctcgttataaataggcaacttgcaacaagccagccaagtatttgcataatatacatcgtgagagcctgctggaggcctcttcattttgcatggtgttccgagcgagagttatgcagggttgtgtgcgagaaactagatgcctctttacttcttaccattgtggcatcctgtatcaattccctctgtgtgcatttctgtttctcaggaaggaacctcaaaatttgcaaacctggacagcagtgtgaaagaaaaccagaagcgtacccagaggcggctgcagctccagaaggacatggtatgtctggccctcgtcttccctgacagctcacagaggagaagggccgtgtgcgtctgggctcccacatggcactggcaccttcagtcaacagggcacccaggctttcagaaagggtctcccattctctaccccatttgttctcagcagccctgggaggtctataggagagagatgattaccctcattcaactagtaggaagtaagcactgggtggcaaatcctgttttctggcaaagttgttttctgaaggtgagggggagtctacagcaggtcgacttcctccctcttgcagtctcttccgccccctcctgcacttagaagctgctccaccttggcctgagggcctcctgagcttcctactgtagtcagcttctgatacatggtgaccaaggagaaagagtgtcttctccacagggccctggtccttgtactcagagatcttttcatttgttctaatctagccattgcccagctctccttactaatcccaaggctaaccaaatctttatagtttttcaatatttaaaggagcatcatgcctccctcctgaagactgaaagataggtattatcaactttagcttcattttaaacttctgactgttagcataaagtgtggaagaccagagggaggagattagagactgacaaactctaaatattctgctttaagagggttttctctttctttggaaagctcaacgtaagtaagaaatgtttttgaatgataggactcttccgcaacatgaagcctataaaacattcacagtgttacaaacttttttggttgttcaaagacaagctaaaaatagctgttaccaaaaaaatagattattttagtacaggatgagaccttgtacacagaatgggaaggacacactgcagctgacagtgagttcctgaaggacaaaaccctccttggtatgaacctcacaaagcagttctggctgaggaagcagccagcctcatgtcaagcagcctggctttaccctgtttgaggctttgtgttctgccaaaatttccagaattggcttgatgagatttaggataagggatccatggggaccgctttttacttttcctttaggatgtttagtgccttggtggcttactgaagaagagagatgattttaaaggagatttagtgaaatgaatatagtgtatccctgcagttgtaggtagaagtgcctccaccttcatttccaactttttattctggaataagtttagatttacagaaaagctgcaaagctagaagtgcagtttccctcattgttaacatcttctaaaaccatagcacatttgtcaatactaagaaactgacactggcataatactattaactaaaatctagactttgtttggatttcaccagttttccactagtatcttcttatctgttccaggacccaatccggcataccaactgcattttgttgtctgtcacccctgtctcttcaggtctacgacagtgttttcttgactgttttttatgaccttggttgtcttaaggggtctatccaggtattctgtagaatgttccacagtttgaggttgtctgctgttttctagtgattagactgagcttctggatttttagaaagaatatcacagagtaaagtgcccttctcatcacatcacatcaaggagtgaatgaatggtttcagcgtgacatctggtgtcatgttgatggtgacacgaatgatgttgatctttattacttggttaaggaagagtttgccaggttcttcctcagaagttactgtttttctctttccctcctctattatttgagagttagtcaccaagtctagcccaaggggttatattaatagtgatgccccatgcttttgtggtacatacttctctgtgtacaacagccaatggtgaggcaatgactatccagtgccatccccaactaccaggaatgtccccatgctctgaaagagaacagacatccttctcacttgagccaaagcaaaacataaaccccacagtcaacacttttgaacagatgtgtatgatctcctggctttgaggcttggttttcatgatttcacaagttagatattagatcatggagtttctatcctatttgtgtagaaatttaaaaaatgttattcatggaggttagcaccactggcccgcagttaggccttgaatacatccatttgctccagcttgaagattcctaaaacccctcaacttttcaatgacaataaagacagttttgctttggatgctcttcagggtgtgatgcagggaactgtgccctacctgggcaccttcctgactgacctgaccatgcttgacactgcccttcaggactacatcgaggtgagttccatgtgggtggtgtgatcgggcctgcagccttcccactggataccctaaagagtagttaacttctcttagtatcttttgaaggtccaaaagtacatggcattgtgctagctgttaggaggaatacaaagaataacaccaaagactaacaccagaagtggctcaaaatccagtggaagtaattaatatatcaaaataagcagtgaacgatagtaataatcgaaattcaaacaaatgcattgagagaacatgggagatgacaattattattatttttttgagatggagttttgctcttgttgtccaagctggagtgcaatggcacgatcttggctcactgcaatctctgcctctcgggttcaagcaattctcctgcctcagcctcccaagtagctgggattacaggcgtgcaccaccacgcccagctaattttttgtatttttagtagaaacagggtttcaccatattagccaggctagccttgaactcctgaccacaggtgatccgcccaccttggccttccaaagtgctgggattacaggcgttgagccactgcacccggcccacaatgaactcttatgaggggttgtgatgaacagggctcatgaaggagtgggtttgggtttgaacaagactttaaggccgggcgcgatgtctcatgcctgtaatcccagcactttaagaggtcaaggcaggtgaatcacctgaggtcaggagttcaagaccagcctggccaacatggtgaaaccccgtctctactaaaaatacaaaaattaggctgggtgtggtggctcacgcctgtaatcccagcactttgggaggctgagacaggcagatcatgaggtcaggagttcgagaccaccctggccaacatggtgaaaccccatctctactaaaaacacaaaaatcagccgggcatggtgacacatgcctgtagtcccagctactcaggaggttgaggcagaagaattgcttgaacccgagaggcggaggttgcagtgagccgagattgcgccactgcacttcagcctgggtgacagagcaagaccccatctcaaaaaaaagaaaaagaataaataaataaaaatacaaaaattagccggtcatggtggcaggtgcctataatcccaactactctggaggctgaggcaggagaatcacttgagctcgggaggcagaggttgcagtgagccgagatcgtgtcattgcacgatctaggtgcccagcctaggtgccagagtgagactcggtctcaaacaaaaacaaacaaacaaacaaacaaaaaaccccacaagactttaatgttgagtaggactacttggtggggtagagagtcagtcaaatttgtgatttttcaaatatgcttttctttttgtattgctgcctgctgtggggtatttttctctctctctgtctctctctctctctgtccccttgtccctctttctctctgttccccctctctctacccctactcccttcatcccccatcttctctgaaagggaaaatacatgaaaactcagataaacaacttgttagtagcagcaataaaatattaagtgaagaagaaatttcaaatttgaaatgaaattgaaagattgcttgcatatttcagtatatactacccccttgttatcatatgcaaccagcctgcttttattgtatcttaattagaagaagtagaagttactttgcatagatctacctacctttggatttgccacagtgttgtggacacatttattcattttgcatctcctgacttctatgtctcttcacatcctctttctcagcttatctcaggaaacacccatcagtgttggggaattctggggagtaaccaaagatttagaagttaaattcagcctactgagaataggagctgaggggatgaagaattgaaacttaacttttcatgatgctatggagaaatgacttcccttttgataaaccgtatgagtcaatgaccatctgttttagttgcttttggtaagggaaaaaagtgtaatggaatatttactcaagcttttatctttactggttctgcaagtgtctttggatcctgatttgtaattatttatcattactattttagttggtttcagacatttcaagagaaggctttctgcttatcctgccttataataatactttttttaaaagcaaaacaggactctcttcttccacagtagtcgtaattataggatcattgataattgtgactttatcacccctttgatctattttaatgtgacctacgacaacatatggctgtgttttaaagtagcttggttgctcactctttttattaaaatttcttttagggtggactgataaactttgagaaaaggagaagggtaagtagagttgttggctgtgtttcctttgtctgagcatgaaaaaaatgaaagaaatggggacttaagtttttttgtagaggcagaaaaaaatgagttagcacctactgaacgtttatcatataccattttgcttggcattctcctatacattatcccccactagccttatgaggtaggttttatcatcctcaattcaaaggtgaggaagctaggactcaagagattaaattactggacgagaatctcttggtggcaaagccagggttctcatcctgtcctgatgccccaaagcccacatttcttccctgcccactccttatctcctttacaattagcttcagcaatagcaggcttgccacttaattaataacaatgtattttatacttgaagattactaagagtagactttaagtattctcatcacaaataaatatgtgaagtaatgcatatgttagttagcctgatttagccattccacggtatatacatgtttcagaacatcatgttgcacaccataaatacaaacaattttttaatttgccaattaaaataaaaaccaggtttaccctattaaggataaggggtttctgatgagtaaatgacatagaagagttaataaagatggtaaactctcgtgggtatactcgagagaggaaaggaaatggccttcgtcttcggtgtaggtagttattctttccctttcgtgtcagcataggaaggtgtgctcaacatcaatttcactcttcctgtggatagcacagttctgaactgtgctattcaagataaaacagtcttgaaatttttctgtgattttcatattcaaatggcatatttaaatagatatttaaaagactcaaaggaaaatgagtgagcaaaataataacttcaccctgtagtactctcgttatttttcagtactttcacattccacaaatattgactgtctacctaacatggggggggtttgggaattacagcagagaaagaacagagctgcctgccctcgtaaagttcacaatccaggagagaggtagacaaataaataggcagttataatacaacctgaaaagggtttgtgagcagaagtagtgggtgttagagaagtatataggtggggtatctatctccaacttgtagggccagagaaacttccaggagaaaatgacgttgaagttaaaaccaaaaaggcatagaggagctaaacaaagctgggcttatcagaacaagatactaacctggacaaatgtaaattttttgtcccatatagacgatacttttttctttagcatgatggtaaatattccttgaggatactgagaccaagggccgaggtcactggatggcaagttgagacttggagaatctaccagttcttgagttacttctgtcatgtcctgtaatgataataaattcagttattgccccctcagttcccctctctgtcatttaacttcagaataactgtggttggtaatctctttcctttttagactaggatattaaacttctggaaagtttgactgtaaaacctaaacctaaagcttatacccattgctgacttaaattttttttattgaaacatccaaataagtataaataattttcaacataattatgtacttgcctctctgtgagttttaaaagacttagttaaatgatttagtggcgtagtaaaaacccaaggattcaggaaatctaaacattcaattttatgagacctaggactgtttagatactcagccctaccaaaacttatttattgaggggtaaaggttgaggaagatggggatggggatcttgggagctccctgacttaaagtatttcttttcttttttttaagaaatatgaatagaaattaatatattttatgaagtacttaaaaccttaaaaatcatttttctattccaaggatgaaagtgaagaagagaaaaaggaagccactgtaacttaacgtagtgactagtttgggttgctttggtagcttgttttatacaaattgctttctcaaggagaaaagaggattaaaaattaaagcatacaaggactttggagagttctagttagaatttttaagagttagttagctcctttatttttaaggaagcagtatttcagaatcctcctagatggttttcttcatcttttatcctaatgtggtatattttcatgttgaaagattctatatttggttggccttattattcagtcttttttttttaatttttggtattctgtctgctttaggaatttgaagtgattgcccagataaagctcttacagtctgcctgcaacagctattgcatgaccccagaccaaaagttcatccagtggttccagaggcagcagctcctgacagaggaggagaggtgggatcacctgtcgttcatcggggtagaactgaagtgttggcaagaaaaatgctgcatttaatacctcgctgggtcatttattcaacaactatttagtgagcagctgctaggttccaggtccttggttttcaaaggcgcatggtgtggcaggaaaggctgagttgatagcatcaagatgtactttcagactcttgcttggccacttatttatctttgtaaccttgaacaagtcatttgttcttccctatcttaaggatgctcatctgtagaatgtttgtgaggcgtaactaagatcttatgtgggaatgctttgttagaatgcttgtcctcagcgttgtcaccaccaccactgtcactgtgtttgtcattcctgttaattgatggtagctttccaggaagctttcaacctagaggggttgagagactcatgaaactttgaaatatgatgggtaactacattcctacaaaacctatgggaagaattggggaaaataaggaaaatataaaggcattaatatttaggctggctgtaaaggagaaacaagattttgccataagaaccggaagagaacattccagaccgagagagaacacaagcaaaagcttggtggcctgacatgtttggcatttgaaggaacagtgataactcaggtgtggcagggacacaaagaacagtttaaaaatagtgggatgggcatagaaaggcatgttcacttgagtgccctgcctgctggctcagcacgtccctgtcctgtagcctgctcgcttgttggcagattggtctgcaggccatatgtggcccactgcctgtttttacatttttaaatgattggggtgggggggaacaaaaaaagaatattttgtgacacgaaacagttatttgaaattcagatttcagtatctacataaatatggttttattgaaacacagcccgttcatttacatctcatctatggttgctttcatgctgtaaagacagagttgagtagttgcaacagagaccatatggcccacaaagcctaaaatactatgtgatcctttacagaagaagttggcccatccctaccctagcccaggggatttctttggaagtttatcataagggagagtgaaattgacagcaaaataagtatttacaaaaaaaaaaacttgaggtttagagaaatatttgaatgaattaatgacagcatttggattcaaactcaggtctgcccggctctacagcctaagctctgaagatggctgtataatgttgggcacccttccccacctactcagtaacgaaatacatctactgtctacagctacaagctttcataaaaggcacttggaatcacatataaattcctcttgtgcttgtgtcagttatatctgcctggcagatagaggtctgaatctggagcatttttaatttaggaagttttggcaattaaaaatttaaaaaagtatttgtaggccaccctggccaacatggtgaaaccccatctctactaaaataaataaatatatatatatatatctttatcagtaatgtaattgcctatgtctgttcattgacgatcagatagattacaaaagtctcttcattttctttagataaaactaagtcatttgtgcatgtgcacaaacacacatacaaaatagtaggaaggaggtaatagagaagaaataggagggggaggtagtagaggaaggaagattcttccactggcctagcagtgggatgagaatgatcagaatggagttagtttttgatgctgccaaagtgcatatatccttgtatttgaaacacgcagaactaaatagcctcaatccatatgccagtggaggtgagggaggaagcacataagataaatgtgtcaaatcgggccgtgaagtcagtaccccctgacgtttatgataggacaacgtttgtatatatctttactttgaacaattagagccttctctaaaacaaaaccaggacatcatgtgaatttaagtgtgtttttcaattctctaactttgacctcatggagcccccttctctttctcagctatgccctgtcatgtgagattgaagcagctgctgacgccagcaccacctcgcccaagcctcggaagagcatggtgaagagactcagcctgtgagtgtcccctgggggttctggggctccaagagggtgccatcagagtcgtgagaggagatgtattcaacaggatgaccttgagccagggtgaaagtgaagagcactccgctcatttgttaagccgtttatccttctgtcatgaactcaaagcatttgctgagtccattcttctccactcccctctctgttgtgaatcaccattctctcctgcctgaatcactccagtaacatcttcactgtcttctggctgccccttacccaaccattcattctccactaaatagctaggttgtcttttaaaatgtacaccagattatgttgcttcctgtataaaaacccctatagcttttattttaaaataaaacccaaactctgtatcctggtttactaggccttacatgacttaacctgcagacttccctctcttacaacattgccctctgttcaccagtgttgaagacgtttgcactggctgtgcctggcctgaaatgctctttcttcatgactggctccttcaaatattagcaaaaatgttatgtgccaagagagaaccctttctaatgttgctgtccacccctcattctcattcatactagctgcttcctccagtggaatgtaagcaacctgagaacaggaaccttgtctatcatgctcgcagttgtattgcctgaggccaggagtttgagaccagcctggacaatgtagtgagatcctgtctctacaaaaaaatatcacttaaaatattagctgggcatggtggtgcacgcatgtagtcccagctacttgggaggctgaggtgggagggttgcctgagcccaggagttcagtgttacagtgagctatttttgtgccactgcactctagcctggatgacagggcgagaccctgtctctaagaacaaaacaaaacaaaacaacaacaacaaatatatatatatatttatacacacatatatatatacacatacatatatatatgcagtacctagctctcaatatgtgcctgaaaaaccaccattatttttaatgaaatgaatcagttaatatctttttgaggatttggggggatcaggattctgactgtctttatgggcatttgatatttcccagcactgtctctccacctacttcagtgagtcacattgagacacaggcagggatggcacatgaccttgagtgttgccatgtccccggtgtaacataaagacctctgctggatgtggatagcaaggtctcccaccatcagcggccacgcaggctgctatctgccatcaggtgatatgggtggtatgaggcattgtgggtgggttggaacatgcgctttagtagaaagcatctggaagatcatcctgtgttttgctcaccctctctttgttcagatgactgtcctggccctgcggaactctagatttatgagcttttggagtcagctcttgaggagaatttttcatagtatcttgctgtcttttcatctttgcagatatgggggaatgaactactgagataatctgaggggcctgaccaagccttgtcagctggtaagactggcatgtgcacagggaatcagctccctgatagaggagtccagacatgcaggggatcctgggtgtccactctgctcactgaggcagcagaaggaattgggagcttctggacccactatggcagtcagaggttcttaaggaaaaaaacaaaaattctcaatgcaggcaggcctaatcctgcgtcctgctacctctatcctcctgccttctccccatcctcatttctatgctactgcttctctgtactcctctccaagcccgggatctatatgttttgtggtgggagttctaatacccctggatcctctgtcttcactgacacagacaagtggtcagtcctatgaaaacatttactgtgaaatccagagagggcaggactgtgagggtgctatgcccttcacaaagtgtggtaggtactcagtacatctcttactagtaaaatcttgctgggataacccttggtatctgcagttgagtttgggcatctattatgaaagcagttcatatgcccccatcttatttcttgtacatacaagggtgtttgcataccattatttttcaaaagatttcatgatcttcttagcatgtttacaaatctgggaaatgcatttttgctgttcccacattcaatggctcatcattccaaagaggttggagaaaactttgggtgcttaggcctagtttgaaagttagagatgcctactactgagccagaatgaaccttcacaacgcaggacaaagcaggaccttactgaattgtagaaatggaagaaccctagagactctgagataatggatggaggaccactagttgacatcctttcaagatctacctttgtaatttatgaagcagtaagaaagggcattatttttgcttctgtgatcagagtttagctcatacccctatagtccctgtaatgctcctgtaatgcttgaagggtcataaaaggaagacagggaaaatggggctggagatagcagggtagagataaggcagagcaaaaatatgcttgagctcttggaattcaagcatataattccgaaaatatttaataaaaaatcaagttcaccttcattgtttctattattgttgttattttatagtcagtacttgtttaggttcagcccacgtgctagttgccttgcatgccgttccttcttaatctgactcccgccctccttttaccactacttgtggtgtaaatctgttaacggtaaaccttctcagtcttagtctgagaaagtctttattttgccctccttcttagaattatattagacgggtatagaattcaatactgactgttactttcactcagcactttgacgatattattcagtgtcttttgacttccatggttacttttgagatgtgtggtatctgcttaattactattcctctgttttatgttcccactcctgttgcttttctttcttctttccttccttccttccttcctcactcgctctctttctttcaaaagagttttgctctgtcgcttaggctggagtgatcttggctcactgtaacctctgcctcctgggttcatgcaattcttgtgcttcagcttcccaagtagctgggattacaggcacatgccaccacacctgggtaatttttttgtattttggtagagatggggcttcaccacgttgcctggagtggtcttgaactcctgaactcaggcagtcagcctgcctcggcctcccaaagtgctggaagcactttgagagccactgtgcctggccccctgttgattttaagaatttcttttgtctttgatataccagtttaagtgggagtttagtcttaccctattcaggacatggctcttggatgggaggattcctatggttcaccagttctggaatcctctcagccaccatctcttctgatatgggccttcttccatcctctccatgtcttctggaactcctcctacacatacctggggctttcttactgctttctccatatcttttcactgttctttctatgtctttatcttttgatgatgatttttgaggattttcttcagatctgtcatctagttcatgatttttttcttcaagttatttaatccttccactgaggttttagtttaagtcaccacctttttcacttagaggtgaaatgtttttcaaattatcttcttcctttattaggatgtcttgctctgagctccggttttcaatttcttcttttatgtctttaatatttcctaacatacttattttgcagcttggcttatagtagacatgcagatatttgttggatgaataagcacattattagttttgttctgacagttctcaaatttgaagttctcaggagtctaagcctgctttttgttatgcctgttggctctctctttcagtggaatatttccttgtgtgtattttgtaattttgtatcacgagtttatctttatcaggggattctctgaagcctgggctgaaggtatatccctcccgcaagattttctttttttttaagaaaaaatctagtttactagcggtgtcaccggttgagagtttctaaccccatagaccacataaatagcaaattggagtgaggcacagacccagctcacacatgacttcataggagacatttttcttctttccatgctcaggcaagaacagtctccctgttgtcttcctatgctagtagaaagatatttttctggcctatctttttagtaagggtatagccctttgtgggccctggctgtatatagttttggttctaactcctcaccattcataaacagaaaccctcatctttgggccctgggtgtgcattaaaacccatatcactattttgccaagattggggcctcccactcccccaccagagcagctgcagaactagctcgcgtgcttctggttttcagttcctttttcacttaaggcctgtagggatttcccttcctatcttgcaagctcaactaaaaagagtttttaatatttcttatctagctgttttatagaggaagcatttaggatactgtagttcacagattgttggaaatagaagtcttcctccttggtttcttacccaaagcagtgccatcccttctttgcctgtgaagatcattttatggtaggaagtgatgggggtatgctgatggtatcttgatcctgccaaggtggtccatagactgttaaaatgtagaggaccattgacctagaaagacttcagattagtactgaataatctatgtgttctttgaagttggaaatactcttttgggacaagatgtttactactatttgttagaaactttatagcgaatgtcctcctaaaataataatgacagaacacacaagactgaaaaaacatcaagggcttaatcaacacaaaatatttgcctaatcatggattccagatttgtaacagcccaaatgcttggcattctgtttttttccagactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaaggtatatactcaacccttctcataattcctaatgcaggcacctacatgctctttgccacaccacagcaaggaatgtctgtttttaagtggatcactctatagtattttgaaagtcatgttttgaacaggcatcaaaagaagagttcaatttggggacatactactaatagaaacaggtgtaaaagcactaagcagtttcgtttattcatttggcctttgaaatattgttctatacccacctcttaaggcactggagttatttaggggaagtaggacttcttagaaagagcaaaaagtcagagatggagatgtgtcaggttcttggtgccatgttttgtcttagccaagcatttatcacaataatgttgcattgcatgccactccaaaagtcagtgacttaaaacaaccactatttatctctcttatgtatctgctggttggctgatctaggttgggcttgacactaggccacagatttggtccaggtctgttccacttgcctctcattattgttggagtaacgggctacccagggcatgcccttagcatgctaagacggacaagcaagagggcaagcccactcgcaagcatatgtcaagcctttacttgagtcgtatcaaccaacattctattggctaaagtaatcatgtggccacattccacataagtaaatgaagcagagaaataggctccagttttagtgggaggaactctgaaatcacagtgcaaagggcacagctgcaggggaagatgagggattggtaacaaggatacattctcccatgttggaaaaaaggaaactgatgagaggtgataaaagaatttccgtcgagtttctattttctgtgactgcataaataaaaatttaaaaaccaaaatatcttaatcttaagatcttaattaagaccagtcttcttttttttttttttttttttttttttttgagatgaagtctcactactctgttgcccaggctggaatgcagtggtacgatcttggctcactacaacctctgtcttctgggttcaggggattctcctgcctcagcctcccgagtagctgggattacaggcatgtgccaccatgcccgcataatttttgtatttttagtagagatggagtttcaccatgttggccaggttggtctcacacccctgacctcaggtgatccacccacttcggcctcccaaagtgctgggatgagccaccgcaccccaccaatatcagtgttaatcttctgtacacatctgcttcaatctgttggttgaagggtttggatcagaaagtcaactatgacataactagaatttgcaccatttggggaaggtttctggctaaccaagcttactcaatagtgacttctggctccttagcttatggttaggtcagtaaggtagaatgttggcaatggtttcatcccttggtttatatctgctgctcttcaaggggacatgtgtgttgcttcacatggtgttaaaacaacagtggtaatcctggaaccctcaagtgactttgtcataatgtagccaatccaggaaaagcatcatattcaggattcatcaaactgagatgactaatttgctgctctagttggatttcttagctttctgctttgaaatccaggggatacaatcattcatgctctaaatattgaaagaaagccttcgtggacacctacggactggccatgctctcaaaaggcatttttcctcaacccgggatgtagtcattcttcgtgacttgacatacaaattagctttgtcaaaatctggaatgcagtctcatcattcactttttcacagcctctgaggttttataggctccatttctgatggtagacattgtaggaaagtaataactgaggtattgcccacattattgtgggatttctccctgtctctccaggaaggagatggaatcacagtcacaccttgtggcatagtggaaatgtacattggtccaaatggtaccttttaaaactatgcagaagcccagtgtgctttctcctgcacatcccttgcttcatcttttttgtctcatccctcatcagactggctttttaaattcttgcagaagtcatggctctttattctttggatgaacctttctcagagtcatacatttcttaaacatcagtgattcacttggatgcaagtagctcctggactgcacaatccctgcatattagctagaaaggctcgtgattctcctgcttggcacatagctggactgagctgacctccacacttccttcctgacctgagagcctgtgacagccgccttctccaaaagtcctccagactgtcattcttccttttccacaggctgcactgtgaggttgctcttaagggtgaagtgtaatttatttgcattcctttcttcattccccgatcatgatttctaaatattgatttttgcacttgctcctcacttcttaaattctcaataggaatttgggggctcatcaggcagtctgtttagagctgctataacccaggcatattctaggctttatcttaactataaatgtcactagaatcatagaaaaatctaacaaaggaaatagagtttggatagaggaacatgaaggcgaaaaaattgaatgaataattggaaaatgcacccccttaactaatatatctgcaaagaaacttatgctattaacttatctatcatcagttagtcctcaaattgagccactaagttgattcatttgggaacataaggaagaaaaaaacccaaaaaccaaaacaaaaactaaaccatattatgatagagccacaatcagacccctacccatgagaattgtcacatcagctggctggctgtaaactaactgtgcaatagaactgaatgtataattatgccacaggaggaaatctacaggaaataagataatagactccattttaatcagaagcctgataaccagaaagctcaacttctatactgtttccatggaaaggcagataaatatgaaagaaatgttatttattttataaatgacttccagaatattttataggattaacatggtataatttagcttaagtcattccgggaaattctttataattttctacaataataatgggtattttaaatggttcaatttaatgatttttaaaagtacctcttccaataacttctttctttggttattggtattgcatggatgagaaatgtgtagttaatcagaaaagcatattaactgtagtactccatttcttaattgtccttgatacacatcatgaaaatgtatacagttggctctactagcaaatgtggaaagtggtgaagctgcttaaaggctgtatttcccttgagcaagtcacttttatattctgaatcttattctcctcgtctttataatgctctgcattttgttcacaagacagttgtggaattaaaatgggataagataatatgaaagttcatgataagcctcacagtactaaacataccgaggtagcagcatactatgttgattcatcttattgtcatcagccacaggctgagccttggccatgtgcttgctctgggaactcgacagtgggaatcagggagcttgggttcctgttctaggggtgctgtcaactagctgtgtggacctggagccccagttttctccctgggtctcaggttcctcagcagaacaggtatgggactagttgatgtccaaggcctttctagcactaatattcaatgcagagccgtataatctggggtacttctcttagaaacttctaaaaatacagaactttctctctcactacgaaatctgactgcagtaggactgaatcaactgcgttggcaaggctttcctccagccccgtaagcttctgacttctttgggaacccatattgcctccagtttctggtgtctgctgccacctgctggttaacttctataagaacagctaaaacctagggaaatagaactgctttgcctcacgtgcttatagagtgattaggtcacactgagtcaccgataggcatctaccactgatggggactcagagtacttacaccagggatgagacacatgtgtgctgtgggctgttgtggaggaaataactgcagtctatcagtcttgatatctacctctgctttgaaaattgcaaagctgttggccagcgttctaatctgttttcttctggggtgtgtttactcttccagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttacaaccaacagaatgaagacacctgcataatccgcatcagtgtggaagacaataacggcaacatgtacaagagcatcatggtgaggagcaagccctgacccaggagcgggtttccatttagattgtgtgtctgtgtctgtcggccgctcagactaatagccctaaatatgcacactcaatattagcatatacatatatgcattcacacagaagggatgtgtgtcagttccaggtctccctgggcatagatgctgaatgatatatgtatataaaatatatatacatatatatgcacacacatggtgtatataggatataattttcacatcttaaagaaatgctaaaacttattcgtttaggtcagtattagccatttgaaaattctcaatttgggtgacagtgtaaatgtgctccagggaggatgacacaacctcacacatttttggaagccttcctatggaattatatgtctggttttatcattgaatttccacacattcttagcagtgtactcccctgatggcagatttttgtcatttagtcatttggatcaaacctagttaataaagtggatgatcaagctagaaatacagtttgggttaatgaggaacgatgcctataaaatgagactgacctttttgagcttcttgtaaaatctgtgtgtttctgaggacaattgcaaagatatttttaataatggcagtcttttgggaatacacacagagcctctcatggcgataaccttgggtatgtgaggtctggtaggtttatcacaagaatataaactccttagtttatgggagataatcatgtattggaaatcactttatcctttgcagcaaaatcccacagctaattccacatctctcctcatctttatcactcgcctctttgaaggcacactcagtgcttacaagctcaggtctgaatatggcataagtggtatggaggctccacataaaagctttgctaaagcatttattgagtcaacaaaatatcaaacatttattgcgttctagtcattagatcaggctttggggatagggagatgagtgagacatttctgcctttgaggaacttttaattagaaagggagcccacaaagcattattcacaatgtgcaaaataatagagccaagatcaggtggtaaagggccttgtggcccacacagaggagtgtgttaatcccgcaggcaatagggtcttgttgaaggcttttaagtagtgatgggatttgctcattaagaaagtcatggcactgtgtttgctggagtgtcggggtagactggaggcggggaagcaagttaggaagctgctatcatgttccatgtaggagaggataagggcttgaatgacggtcatgtggctggagatggtgaggatttttgaaagcttttgatgaggtagaattgtagaatccattcatttagttaccaactttttggttactgttgtggaggactagaggctgtctgggtagttggtgggtctgtgagatatgaactaccagaggaggatattcagggacatttaaatcagaggtaccagtatgacatcagatggcattgtctgatagatggtcagaaacatgggctggtgcaaggctggtgctgagatcaaatactgggagttgtcaaaccccacaggggggacgtggtctcgcgagactgagtgtaggatgaggcagaatgcaagtggtaatgagggaggggctaataaaggagcacccgagaggtagaggaaacacagggaagccaaggtcctccatgtggttactgcctgctcagcatggtctgttcacctggcacctcttacctgcaccaatcagagagaatgtccactgcataactctacagtgtctctgaattatagcatggatttgtacaccaaacagttatgttttgggacatgcctggtcagcgtgcactctgctcagtctggggggaactgtgagtggttggactgcacaaacctctactgcccaggaggagtcacaggttgtgcatgctgtctgagtgttgggagggtagtgagcagaagatcccctgccccctgctctgagattcctccttccccagcaaatgggctgcctctgtgagaatcacctctcctgccaaccccttcctgtggccctttatattgcaccaggtggtggcactcacctttcatgaaaatcctgccagcgcatgtcacaggcttattctggagagacgacacactgctctcgtgctctcattctaatcgttaggcctctcaggagaaaccttgctcacaggacgtacctttctgaaatgtattatgctgtgtgctgttgaccagaagatggaaataaatcagtccaggttcaggcgagactagcagttctcaaactttttgttctcaggacccctttatactctgaaacagcattgaatattccaaagagctccagactatgtgggttgtatctgttgatatttaccacattagatatttaaactgagaaactttcaaaatgttgattaattcatttaaaataacaataatgaacacattgcatgttaatgtaaattttattttttaatgaaaaatatctatttttttccaaaaattattgagtgagaagtgtggcattgttttccatttctgaaagtctgttaaaatgtgagtgagactggctttgttttgttttgtttttgtttttactgtgagtacagggtactgaagaatacagtgacagctagtagatttgtagttagaaaccactggaccgatttgtgctgttgtgccagcaattccatccaccatagcttctgcaatacctatgcaaatgtcaacacaaagaaaagacaaacagcatcttagtattatcatgaaaataattttgatctcatggatcccctcacagatttcagggaccccacgggccatagattgcacactgagaactggtggcctagagaacttgctttgcaagagcaactaatgtccctggaatccaaggcccttccatagaagaagagacagcaattagcccttgtaaaattacctcctcagtgaccatggaaaaatgtcttctaccactgaacccatcactctttcgaaatgatctttctctccattgtgtcaatcacagagtcagtctcccaagatcccttacacagggaatgcagtatttctgtcacaggaaagtcaatgagggcgacaccaaagcatcgttcagtaccgcgcattcagtacagcagccactggccacgggtggcgatggagcatttgaaatgggaatactccaaattgagatgagctgagggtaaaatatataccagattttgaacacttagtacaaaaaagtaaaatactgcattaacaatttttgtattgattatatatgctgatgtaatatttggggtgttcaagttaaatatcacctttcaaaaactttttttttttttgaggcagagtcttgcactgttgcctgggctggattgcaatggcacgatctcagctcactgcaacctctgcctccctggttcaagcggttctcctgcctcagcctcctgagtagctgggattacaggcacccacgaccacgcctggctaacttttttgtatttttattagagacggggtttcaccatgttggccaggatggtctcaagctcctgacctcctgatccacctgcctcggcctcccaaagttggtgggattacaggcatgagccacctcacccgtcctaaaaactttttaattgtggctactagaaacttaaaatgaaatatgtggctcacattcgatacctatgagtgctaattcagtctatcagcataaggatgcacgcttgagctgtgaatactcattgtaatcataagtttgattcagcatcgctttgatggtacaaagtaataaacacgcaagggaaagcccttggtcatcttgtcttcattgggacatacctggggaagtttaaggaaaggagaatgaaggtagcctggctgtctcatatgacttacccaccttagcctgacatgcatcccctgaagggaggtcttctcctttagctttctgctactagtccagtgtgacccagctttgggagtattttcttcatactatcaaaaacatattttcctcatttagaattttgtgtgcacctacttttcccttgtaaatgaatatgccagatgttttggtaacagacacgtgaacaagatctttgctgcttacaaggacccctttgtaatgcacattgtttatggaatcacaaacaccagctgctgccccagatcagagtgaggcatcttggcactgccatcctcaggcacacaatggcagtttctgggaggaaatgagacttctgtatgtgtcgaggggggtcgtggggggctttctttctatagtcctcttgccccctggtgagaacagcttttatttttaagtaagaataatctgagttttcattcacttctttcaaacttaaagaaatcacccaaggtatggtacataatttagctttcttttcaggttgctctgcacaccctgcaaatagttggctggcaggcagtgaggtgaagggaagaacatcagaattggggacgagggaaacctttaacttgtgcttttaaaacacttacaagctgatgtttattgaagcataatttgcatgtagttacatatgcagatcttaaatgtttgattctttgagttttaataactatatatatctatgaaactactaccccaaatctagataaagaacatttccatcctgcctgccagattccctgtgccctttccaatcaatcccctcctaacctagaggttcattttctaatgccacagattttgtttttcctttttttgaaagaatagactccactggtatgtaatcttttgtgtccggtttcttttgcctaagatgatgtttgtgagattcacctgcattgttgcatgtgccagttcttagttcccttcagttgctcagtaggattctattatgaatatactacgatttattctcttttcctgttgatggagattcagattgattcagtttttagctattgtgaataaatctgctatgaatgtttgtgtacaagtccttttgtggacgtatgtttttattccgcttggtaaatgcctaggagtgggactgctgaatcacagggtcacctgtactttttgaaatggtcaatgggcagaactgcgaccatttttatcccgtgggttgtaaccagtgccatagaagcagttcaacatgggaggataattttgggccaggactaataatgctttgcatttttcacaattccctcatatatattctttcacgggaacttcaaccactgtggaggagataggcaaggaaagcgttctctccattttaatagcggatgacgctgtgactcagagattaggtgactcgcccatcatctgtggctgctaagggtagaaccaggactagaaaccagggatcctggctcttggtccagttccaattccacgagtccgttctttctggaaaggcatcacaacacaagacagcaagaatgagagggtcaggagaactccctcaggaaacgtgaagctaagtactttacaaacctgttcattgtctttgcagttgacgagccaggataaaacccccgctgtgatccagagagccatgctgaagcacaatctggactcagaccccgccgaggagtacgagctggtgcaggtcatctcggaggacaaaggtgggcatccttccgagacaggcatgttccttcccagggcaggtggctagcacatgtccacagtgctccgcgtttagaaggcagaaaacggatacgtattgttttattgggacctagtggtggtttttgatagtgcaagggtgaacaaccgtgccatcacctcacttgtggaattaagtatctcaaaccgctctccgattccccagctcttgtttttcctgcgattttgatgagtatttcttctgcccagtctttctgagctcttcaaacacttttctaggaagaagtgtctccctgtgccaggaggcagagggtaggggagtctgttgggcattgcaggtggccacacacctcctttacccaagaatgtgtttctaagttgtgtgtgaatctgaaatttagtggttcctgtaataatttctcatcatttcaattaatcatgtatgaaaggtattttctttattcatgatcaattttaaaataacacaaacctctaacttgaaggttatttacctcacatttattgaggcaaagaactggtaatctatgaaaggcttcaatatgcctgggaacatattatttaaagaaatctcttttatgaaatactttttgggggaaataatcacccttgcatgtatctgtctgctaatatgaatttggggattgtatttgttgagagaaggaaacaggctggtagaaaactcctctgtaccttgtcacttcacagacagtgactgtcaggataggtctcttctccaagtgcagaaggagcagcaaatattgttgaccgaagccaaccctttctgccgccagaccccaaactgtccattgcagccaccttaagtagtcctctgctcaccaacaagcagtgtcccctataagtgagaagcattccacaagctaggctatgggatcagcatgtcacccagggctctattgctggtttagaggagagtggctgaaattagaatactaccttctcctagagattaaaagctacagcctctgggaaaattctttttcagtttcctcttggaagatttctcattcattcagctgagccttaggctgtggggcaacactttctcagttataaccttttgatgtaattataattataattctaagcctaaaagatggtctcaagttgtaccattttgcttacaacacagcactaaggtgaggctggtgggtctaaaggtccaggagtctcgaggggtagccaggacccagtgttgcccaccagctgtgtggtcctaaatgcaagctgctggacccccgggccttggtccttaattagagacaataccctgctggttcctcatatatcacagggcgattctgaagataacaagaaatcgtgtacctgaacatggggagacactaagtgatatataactgtgaggactattattactgacctgtgagtatgtgggcagcagcatgggacactttgaggggattgttctccgctgagcctttgtgcacagaatgtacaggagtcacttggaacctgctcatatcagtcttgttgttggatatcaatgtttgaagttaacttaagactcaatttgtccagttttacaaccatatgcctctctggttgcctccccgaccccactaccacagagctagacttgcacattttaccttttttaattctgtttgttttttcaaatactcattacacttgagtgctaaatactgtataccttcttgtggcgattactcaaggatctagaaccagaaatgccatttgacccagcaatcccattactgggtgtatacccaaaggattataaatcattctgctataaagacacatgcacacatatgtttattgcagcactattcacaatagcaaaacctggaaccaacgcaaatgcccatcaatgatagactggataaagaaaatgtggcacatatacaccatggaatactatgcagtgataaaaaaggatgagttcatgtcctttgcagggacatggatgaagctggaaaccatcattctcagcaaactaacacaggaacaaaaaaccaaacactgcatgttctcactcataagtgggagttgaacaatgagaacatgagaacacatggacacagggaggggaatatcacacaccggggcctgttggggggtggaagactaggggaaggatagcattaggagaaatacctaatgtagatggcgggttgatgggtgcagcaagccaccgtggcacatatatacctgtgtaacaaacctgcacgttctgcacatgtaccccagaccttaaagtatagtaaaaataaaataaaaattaaaaaacaaaaataaaagtgaggctgggcatggtggctcacgcctgtaatcccagcactttgagaggccgaggcaggtagatcatctgacgtcaggagttcaagaccagcctggccaacctggtgaaacccgcctctactaaaaatacaaaaaaatacaaaaaaaaaaaaaaaaattagccgggggtggtggcacacgcctgtaatcccagctacttggggggctgagacaggagaatcacttgaccctgggaggcagaggttgcagtgagctgacattgtgccactgcactgcagcctgggcaacaagagcaaaactccatctcaaaaaatataataataataaataaataacttaaataaataaaataaaactgagtcaaaataactttgctttgatgatttcatattacacttggaacaatccttgttcaaaaattacagatgtctagttgggaatcattgaaattgaaaatagtttaaatattaaaagaaggggatatttgctgcaatatttgctgctccttctgcacttggagaagagacctatcctgacagtcactgtctgtgaagtgacaaggtacagaggagttttctaccagcctgtttccttctctcaacaaatacaatacccaaattcatattagcagacagatacccaggaaggggagcatcacacactggggcctgtcagggggttggggaaaaggggagggagagcattaggacaaatatctaatgcatgcaggacttaaaacctagatgacagattgataggtgcagcacatgtatacctatgtaacaaacctgaacattctgcacatgtatcccagaacttaaagtaaaatactataaaataaagatatgcacgttcagcacatgtatcccaaaacttaaagtaaaatttttttaaaaaaatatacatactttcctacatgggaaataaaatactcgtttgacgggattacttcaaaaaatatttcaatatttcaagtagaattctggagtgctgtagattttctgttttttctatgtcattggattctcttagtctttgagaaaatctgcatactggggtggaaaatggactgcaggagaaacgaaacccgagttcaaatcccagttctgctattcactagctgccatcttgggaattttctttaacttttcttggcctctgtttcctactgtactttttttctagttttaacattttctattggaacatttaattcatggagcgaatttctaaaatctcatttgtactaattttttaaattgggattgagaagctggggccaatttttggggtagtgatggtgatcactgtctggttcaggtcacattccagagatgaagggccgtagtcccgttcttgtgtctgggcaaggtttacagctgccgttgtcagtactgagctgacctccacaagctgaccatcttatctttccttatctttttcagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagtaacagacacagcaaaatcaccctctgaagggagggaccagtggccccttgtttgccaaaggcagagtggggctgagaaacaggctgcggtgattgcaattaccatccggtgttcgaggatcattggtgaagtcagcagatatttattgagttcctgtggtgtgcaaagcattatgataggcaccgtggggaaactggaaatgaatttgacatgaaaaggatgaacgattcactgattctctttgactcatttgagactaaaatgcagaattaccaacatttaaaacatatatatgcacatgtatttggtatgcatgtgtatctatataaaaatatataagagggactttatgggatagtatggactatggaaaaacaaatttgcacaatggcctgggaagttgaggtcactttttacagggaaatagaagaaactgagaacctagtctcgtatattctgagtaaatggaatcagtcctgggaatagagagtgtcctttgtgccagtattacaagaagcccaaactttatttttataaagggagaggatgactttctcaatcaagtgccaccagataaaaacaactgcagaggctggaactgccacaggctgtatgaaaggccactttggaaagggtttggatgagctggtggccttcaacctctgcctgcatctgccactttctgctaccctagggaggccaggaggagcttcggaggaccatcgccccactggtctagccatcatgacacctctggaggtgtcaagctcctgaaacaagctcatttcagtttctggcaaccccgtgtatttccgttttccccctaaagaacatatcataatcattgcacaaataaccatgttctttggtaatgaagccagaaaagaaagcgcaaaagaatggtgactcatttggactcttatctgtcttggaatgtcactgcttcattgccttctctgattgccttttgcatgtaaaactatgtgtctggagtcttttgccatctggatcttagtacctctttattatgtgcaatttattcctcaggtgtggaaatttctactgcaattgactacgtttgattattttgagcttgtgaaagatttctgaacagtgattgtcccgttaatagcccctcagaagatgttccctgctgataacagcatcctattttacttacttttatagcattactgtgcctagtcgtggggaaagagatggggctgtatagattatctgaatcatttgtctaagaggtacattcttccagatggaatcaataacttttttttttccaggttcccgtgcttgctatcacagtatcattgttaagtgacacttttgtctctcataacaccatcacactcttccttccaagtctgagctgtgctggggtttgaactaaaagccatatgtggaatattgacatgtgtaagaagcactttcagaatgttgtcctttttaagaaatgattctcaaaataccagtttttattccaaaaatttagagaacaaacccggaatatgaagtgcagattgtaacatggagctatttttttttcttaatcccataatacagctcctaaaagttgtgtgggatttgcgttgcataaatagccatgtgaattccacaagaagcaccagggaaagtttagagatttgcggcaatggaccgaagaacgggccaggaagtcctccaatttcctttggtctttccaggagattggactacacattgtaaagactgactgggtttcaactagtcaaaaagcactttcttctgttttcaatccctgttcgatttgtgcttctgtgcttgtaggagagatggccagggtggcagccctcatgcaggttgaagtatatgtagcctcagcctgatattcttggtgcgaaggtaaaaaaaaaaaaataaataaaaccattggcctggttgagggcgtgaccaccaagacatatatgttgtgcccgtgttcatcctgtgtatttatactgtatatgtagagtctagatttatatactgcaatgtaaaatatatatatatttaccttttttaaagacaatggaaattccaagtagctaaaacttagcttcatttatttaatgccactttaaatgtcttaaatttgtttcctggtggacagccgggtaatgcttttagctgctcgcatgcttgtctttctgcatctccatcatctgtttaccttttggttaaactaataaactagtttgggacttggctggcatgtgctgccagacccaaaggga

SEQ ID NO: 560 - DNA, 54435 bp, Homo sapiens
ttacccggaggaaaatggatttattgctttataaaaaagaagtctaataaaactgaagagaaaataactaaaaatccaaacacaactcacccctctaagcacgcccaggaggtctcaagacacacttctgggggcagtcaaggtgggcgggttggtgggccaggcggacgggcctcccccgtcatcagctccagggccccacggagcccgccggcagggggtgctgtgggcctgtggccttggacaagctcctggccccacgccaggatggctcctgggcactggcccagctgcaggcctggcggctcccgcctggtcagtggggataagggctaactcctagagcccaccccgaccccacacacacctcggacccacccacgtccccaccccggcctggacctccacgtctgccggccacagcctttcgtccacctccacaaaagcagctgtgtgtatgtacggggtgccctggcggcggtcctcaaattcccttcaggtggcagacagaacgagggtgacagtgaaaacgtgtccgcggcattggccctcggggaggaggcgaggggtccacccagcccgctaaaccctctccagggcataagccaggtggggcttctccaccggcctccaacgggtgggcaggccctggacaggcgacagggggctggaattacaaaggaattagcaccgacaacaggaagcgggtccttccttcctcaggcagcctcaggctggccggggagggggtgggggccaggcgcgggcgagacagtgcaagcctttgtcctcaggcaggtacggctgtgggcatgcagccgaggggcaggtggcaggcaggggatggcagccccctctgctttggcaagaggcagaatccagacactggcgggagagcgcctgcctgccgggcgttcctggctcctgctgcaggcaccacagagaccccaggccccgggtccccggggggcggcagagcaaagtcagggcagcccctgcgttcggcaggagaaaacgcgcgtgtccggggccctctcccgtccttccaccacagagctccgaggcagggccccgggagggagcgtgaacgctggcacggagacggcgaaggtcctgggggtgcgtggggtactctggaggggcaggacaggggtcagtcactgaagcacaggcaggagaccgcagttccgaggcggcagccactacacgaaggcctcctggttggacgagccgttgattttgaggaagagtttgtcatcctcctgcctctgctgcagctgccgctccagctggcgccggtagcagatcaggtagagcgggaggcagaagcccagcaggctgagaaggagcagccccacgttcacctggggaggcagggaggccgcgcatcacagggcgtggtggtgcgccgaggctgcagacccgccctccactcgggtttgggaaaggggagaaggtcacggggtggaagggggaacgaaacaggaaggcccacgaggtcccatatgccagcgtcccggttcccaactcttcacaggccatgtggccaccctcagggcctgggcccccaggaaacacgggctgatctgaacctctgggcttggaacaagttcctggtacctggtgaggaaatctggccctcggaggtggggcggggacaggaactgtgttctttttttttttttttttttttttttgagacgaagtctcgcgctgtcgtcattcaggctggagtgcagtggcgcaatctcagctcactgcaatctccgcctcccgggttcaagtgattctcctgtctcagcctcccgagtatctgggattacaggcacctgccaccacacctggctaatttttgtatttttagtagagacctggtttcaccatgttggccaggctggtcttgaactcctgacctcaagtgatgctcccgcctcggcctctcaaagtgctgggattacaggtgtgagccaccgcgcccggcccaggaactctgttctatttctccccaaatcaggtccagagaggacatgttccttttcctgcctagccaccattcacaaagggactcttaaccaatcctaaccaacgctcccacatgtcctcggggccctgaagcccccgagggggaccttgcagctcgcagttagcagaagggggcaggcgcccatgacccaccatcccccgacccctcttacccacagagggtctccctggagaggacccatcatggccagaaacagcggctgctgcagaagggcgaagagcgcgctgatcagagactgcagtcccgtgaggctgccgaactgggtggaggggtacctgcagggcaagcgacagctcacagccatcctgcctcctgggctttgcttggccccaggtgtctggtgaccccgggctgcaccgttggtgccagagaagggtggggtgccagccctcggattccttcctgctgggcagttctgtttttttttttttttttttaagatggagtcttgcactgtcgcctgggctggagtgcaatgacacgatctcggctcactgcaacctccgcctccccagtccaaacaattctcctgcctcagcctccctagtagctgggattacaggcgcccgccaccacatctggctaattttttgtatttttagtagagacggggtttcactacgttggccaggctggtctcaaactcctgaccttgtgatctgcctgcctcggcctcccaaagttctgggattacaggcgtgagccaccgcgcccggccctgctgggtggttctgcaaagtgtttctctttggaccagctccaggccccagactctggggagggcccaccccactcagctgtgcccagggcctgtgggtgtctggctgagccgagtggaaagcgtggtgccagcggggacctgcggtttgggaaacaggcccagagaggagtgtggaggctgggcttggctctgcagtgccctcgtccagagaagcattgagtaatcgcggaaactcagcaccacagatcccgcccccctccctcagaccctgccaggacagccacagcttcctccaggcctggggaggggcaggcggagggcaagcggagctgggattaccccaggggctgttgcgggaattgggagagagttccgggctaaatcttagcacatgtcaggctctgctggcccagaggtgggaaaggaatcccagcaacacatgagctggtcccacatcagagactgtggatgatgatgtttgagtttcagtttttgggtcaaggcctgagccagagaagaaggaaccactgtggttccttttatgtttctggggcttcttggaaaaagatacaggtttcattttagccagggctggagaaagctatggccagagctgggcgcactgaggctctggatgggcccgtctggtgtattctggactcagtcacccatgttgctgcccgtgatgagggcaactggaacttccgcatttagcttcaggcagccagaacctacccatccttcccagtgagcagccagggccagccccaggactcggctgtagtggcccctgaggccataatgagctgcacaggtgcctgaccctggctgggggaactgacttcgtgttgaatgccaaggcttgtgagcacccaactgtctgcccactgacctgcttcccacgaggtatggcctttccctgaaacacccagcagaaaccctggtacctgtcccctgaagcaggaagatgagcccttctgggacaggctgaccctgcctcagagtctcagtcccaccagcaacctccccccggccattcccacaccctcgcccaccaggccacctgcggcttccaggacttacacggcagcgtacaggcccccgacagcggagtggatgaatcctcgcacgattgtgtgcaggatgaaggagaggatctgggggaggaaaaggcgactgtgggcataaggccttaagggaccgtcccctcagcccccgccctccaattcctgggggccctcaccccaggggcagtgtcagcctggagttggatcaaccccatcctccggagccaattgtgaattttcagaaattttgcaagccagtcgttaacacagtcattttttgtttgtttgtttgttttgttttttgttttgtttgagaagaagtcttgctttgtcgcccaggctggagtgcagtggcgtgatcttggctcactgcaagcttcgcctcctggattcaagcaattctcctgcctcagccttcggagtagctaggattacaggcccacgccaccatgcccggctaatttttgtattttttaagcagagatggggtttcaccatgttggcccggctggtctcaaactcatgacgttgtgatccacccgcctcagcctcccaaaatgatgggattacaggcatgagccactgcgcccagcctaaccgagtcattattaaaaattaaattataggctgggcaaggtggctcacgcccgtaatcccagtgctttgggaggccgaggaggtggatcacctgaggtcaggagttcgaaaccagcctggccaacatggcgaaaccctgtctttactaaaaatacaaaaaattagctgggcgtggtggtgggcacctgtaatctcagctgcttgggaagttgaggcaggagaatcgcttgaaccaagaggtggaggttgcagtgagctgagatcacggcattgcactccagcctggtgacaaagtgagactctgtctcaaaaaaaaaaaataataataataataataattaaattataagccgagaatggtggctcacacctgtagtcccagcactttgggaggctgaggtgggtggatcatatgaggtcaggagtttgagatcagcctggccaacacagtgaaaccccatctttactaaaaatacaaaaattagccgggtgtggtggcgggcgcctgtattcccagctactcaggagggtgaggcaggagaatcgcttgaaccggggaggcggaggttgcggtgagccgagatagcaccactgcactccagcctgggtgacagagctagactctgtctcaaaaaaaaaaaaattacataaatttatgactaaataaataaattatattaaagtaaaggtaatgaatactcaaaactctgaaaactcatcacttcctggcctggtgcagtggctcacacctgtaatccccacactctgggaggcctgggaggatcacttgagcccaggagttccagaccagcctgggcaacatgtcaagaccccatctctgcaaaaaaatataaaaattaactgggcttggtggtacgtgcccgtagtcccagctactcaggaggctgaggtgggaggatcacctgagctcgggaagtcaaggctgcagtgagccaagatcccaccactgcactcgagcctggctgatgggagtgagaccctgtctcaaaaaaaaacaaaatgaacgaacaaaaccatggaaaacctcatcccttcctaattattttacttggttcactagagcctgtgcacgcatcaggctttcctttttttttttttggagacagagtcttgctgtgtagcccaggctggaatgcagtggcacggctcactgcaagctccgcctcctggattcaagcaattctcctgcctcagcctccctagtagctgggattacaggtgcatgccaccaagcccggctaatttttgtattttttgtagagacggggtttcactaggctggtctcgaactcctgacctcaggtgatccacccgcgttggcctcccaaagtgctgggattacaggcgtgagccaccgtgcccggccaggcttttcacatctactgtagaaataccacgtgtcactgtgactctccagttccacagtcagtggcaacacatgggcagctggaaatcagccacggtgagtgcatgtgcaccgtggaagtcggcaaacactagaaccagggccctgctgacagacgtgtatgggcacagcactgagcaagaggttgctgaccacggcctcgagctgcctttgcccacctcggactgtgctccagggtctcccaagcctggtcacccggccctcccagcaggtggctgccctctcacctccctcgtgaagtgtttcttcgctttttgttttgttttctttttgtggtttgttctgttttgtttggttttgttttgggacggtctcgctctacaccccaggctggagtgcagtggtgtggtctcggctcactgcaacctctgtctcctgggttcaagcgattgttctccctcagcctcctgagtagctgggattacaggcatgtgccaccaggcccggctaatttttttttttttttttttgagacaaggtctcactccggttgcccaggctggagtgcactggtgcaatctcagttcactgcagcctcaacttcccggggtgcagtgagccgagattctcccacctcagcctcctgagtagctgggactacaggtgcactccacaacacctggctaatttttatttttagtagagacagggtgtcgccatattgcccaggctggtcctagtaaagttctgtcgctgtctgtgggaggccccctgcccaggaaggctgctgctggcggactccgccaactccgagaggcactttttaagagccatcctcttggccaccaggtccctgtggtcgccttgtcttctgtacacagccctgccatcccgctcagcagccaggacctgttcccaggaatgtgggtggtgggggggcaggggctgctcttggcagtgttgaaagagggctgtgcccagtgcccacacacacacacacacacgcacgctgtgcaggcctccccacctcaaatgccttgttgcctttttacaacttttctttcagtgagacctacataaaacaaaaagatgactgtccccactgagcactgcccctcgactggacaaggcggttagggcaaaggtctgccagtcttgcagagaaagcagcccaggaggccagggagggccggagggatgcagcaccccctggggccggcacaaatgttccacggcccgctgcgctctgcacgcccagtgttggcacgtacacacaacagttcccacggtggggcacacctgggtgttcaacgtacctcaaggcctcctgtaaaaagggagggactcttacttccctcctggacttgacccaagatgccatctggactcaggctacacctctctggaaggaaaagccacacttgcgtccctccaccatttgtaaatttagggattgggccaaaacctactgctagaccactttcacagaccagtgggtggagccaggcaggtgacaagggccaccttactcaaaatctctgtcaaaaatcaggttccagaagcctcaaaagtttggcaaagaaattcagtttttttttttttttttgagacacagcctcactctgtcgcccaggctggagtgcagtggcgcaatctcggctcactgcaacctctgccacccggattcaagcaattctcctgcctcagccctcctgagtagctgggattacaggcatgtgccaccacgcccagctaatttttgtaattttagtagagacggggtttcaccattttggataggctagtctcaaactcctgacctcgtgatccacctgcctcagcctcccaaagtgttttggttttttttggtttttttttctgagacagagtctcactctgtcatccaggctggagtgcagtggcgcgatctcagttcactgcaacctccgcctcccaggttcaaatgattctcctgcctcagcctcccgagtagctgggattacaggagtgtgccaccatgcccagctaacttttatattttctgtagagacagggtttcaccaagtcgcccaggctggtctcaaactcctgagctcaagcaatccacctgcctccacctaccaaagtgttgagattacaggcatgagccaccggcctggaatgaagcttttgaatccagatatgaagccaccatcaaggtcttcctccactctgttcagtgtagaaaccccgtgagactctggtgacaggggagcagatgctcccaccaacaccacagattggccagatctctttggacgtcagattccagctgcttgagccgatacaaaacaaggaactctacagcgaccccacacacttccgggaaatggcatgatggtggtatccacggttatgcaagacgcccccaaaaccaagacatgccttccggggaggagtccctttgcagaagacaatccaggtgtccagctcacctgcagcagcaagcacagagcctggcagggaacaggccctccgcaaataacaaagggctggtgggctgctcggttgagtggaatgaatgaaagtcatcatctgagctgggcacggtgcctcacacctgtaaaatcccagcactttgggaggccaaggcgggtggatcgcctgaggtcaggagttcgagactagcctggccaacatggcaaaaccccatctctactgaaaatacaaaaattagctgggcgtgatggtgcgcacctgtaatcccagctactcgggaggctgaggcaggagaatcgcttgaacccaggaggctgaggttgcagtgagccgagatcacaccactgcactccagcctgagcaacagagtttgactctgtctcaaaaaaataaagaaagtcatccgctttgttgatggcttccatgaaacattacacacttttgagtctttacatgttccttctgactgccccacctcccacctgcccctcccactccccacacccacctggagaggcaggttgggaatgaggcaggtcaccccaaagcccacgagcagcaggttggtgaaggcgaaggcccgcatggcattagtgatcttctggatctgccggtcccgcttcttctttttcttctcgcctctgtggagacacagaacgtgcaggggtgggagggctccccggaggaagccgggtgctcctgagaagtcaggcctcaagcgtcgcagcaggtaaactgacgcaagactcagaagccacccaggcacgttttagggactgtgtcggggctggaccagcactacggacactccccggcccttctcagtggcaagctgagtgtgactctcggagggggtctcgggtacaagaagatggccatccatatgctgcagtgctctgtgaaggctgagctaagacgacggggagagaagtagcagcgtgtgcctgagctggcacatggcaaagcctcacttcaccactggcttcaagttcacccaaatcttgcaggacgctgataagaagccagatacaagccaaataggggagtgaatgggtttccccttgtggggacaggagagggtaaaggggaaatgagcaggcagcagatggaactggagtggacacaaataacctcttggctgcaggacctgacctagatagcacagcactgttttttgttttgttttgttttgtttttttgttctttgggtttttttttgagatggagtctcgctctgtcacccgggctggagtgcagtggtgtgatctcggctcattgccacctctgcctcctgggttcaagcgattctcctgcctcagcctcccgagtagctgggactacaggcacgcgccaccttacccggctaatttttgcgtttttgtagagacagggtttcaccatgttagccaggatggtctcgatcttctgaccttgtgatccacccgccttggcctcccaaagtgctgggattacaggtgtgagccaccgcgcccggccaagcaccctctgcaattatctctcgtgaatgaacgattaccgatcccagtctcacacccacgcagacaccctggatgatccaagaacggaccccaggtgctcacagatgtgcagggagtcccaggcccaccacttcctaactgtgcggccctaggcaaactactgcaagtcccagcctcagctccctcatctgtaaaatgggtataacactggtccccacttcgccagggtgctgggagtcttcactgagatactgtgcatggagtcctcggtggagggcctcaggcaataaaccgtagcttattatattaaggtgtggagccatggaaaacagcgtttggctgggcgtggtggcttatgcctgtaatcccagcactctgggaggccgaggcaagcggatcacaagatcaggagatcaagaccatcttgtctaacactgtgaaacccctgtctctactaaaaatatatattaaaaaaattagccgggcgtggtggcgggcgcctgtagtcccagatacttggaagcctgaggcaggagaatggtgtgaacccgggaggcggaggttgcagtgagccgagatagagccactgcactccagcctgggcgacagagcgagactccgtctcaaaaaaaaaaaagaaaaagaaaaaagaaaacagcgtttaactcatcctctgatcttggagcccatcccttacataaagtaggactccagtaccttgtttaatcttcacaatcatgaacaactctattaacacataatatgtttatagcaactcactactcaaactgaccggaataaaccttgcaggcagataacaaagggttggtgggctgcatgattgaatgcaatgaatgaaagtcaccatctgagccgggcgcggtgcctcatacctgttaatcccagtactttgggaggctttaagatggtgtagccactgccaaggggtggagggagggtggtcttaggagcaaaatggtctgctagccattgtctgtacactttcacctgtgtctctttttcttccttcttactcaatgcttcttctttattgttttttctttttgagacagtcttgctctgttgcccaggctggaagtgcaatggcgtgatctcggctcactgcaacctccacctcccgggttcaagcaattctcgcgcctcagcctcctgagtagctgggattacaggcgcgcgccgccaccgcacctggctaattttttgtatttttagtagagaccgggttttaccacattggccaggctggtcactaactcctgggctcaagcaattcactcacctcaaccttccaaagtgttggtattataggcatgaaccaccctccctggccaatttttaaattttttgtagagacggggagtgggggctggccatgtttcccaggctggtctccaactcctggcctcaagtgatcttcctaccccagcctttcaaagtgctgggattacaggcatgagtcaccgcacctggcctcaaactttagcatttccattgcattccaaacaatttccataaagaggggagcagttgaaacgcatgctgagctgaatgagtgagtctctctaagggctccgggagcagctggagtgcattgctctctccctctgtcccacccaccctgtgcctgacatgcagctctggggtctttctgcaggggctgcgggctgggagccggggcaccggccctgcctacgcactggttggcgtctttctcctcgggctcctcggaggcgtcttcacactccttcagcctccagtccatgatgtagccaatgacgggggccgtcagcaggcacagcagctggagcacgccgaagatggaggtgtagaggccaactgtggaggaaggcgctgcgtcatggggacgcctggcagacagccctggagcagggactgggcaccagctgggaaggggctggtccccacaggctcttctggggtctgccccagaaccccctgtcactatgggtcttgcgaggagcccggagaccttaactctgaagttgaggatggagcacggggcaggtcaccttcttctcggttccaaatcccctgcttgtttctaagaaacagctaatgaaacccagagtgtcacaatggccttcccagagctccaggaagtcgctataacttgggaactcctgtgacggaggctaagtgacgggccgttagtttctgtctctagaaatagcccagaacggctgggcgcggtggctcatgcctgtaatcccagcactttgggagcccgaggtgggcggatcacgaggtcaggagttcgagaccagactgaccaacacagtgaaaccccgtctctactaaaaatacaaaaactagctgggcgtggtggcaggcacctgtaaccccagctactcaggaggctacaaggagaatcacttgaacccgggaggtgaaggttgcagtgagccaagatcatgcctctgcactccaccctgggcaacagagcaagactccatctcaaaaaaaaaagaaatatcccagaaaggcaccgctcacggggctctgatgtcagggcttccatattcaaagacttaaaatgacagtggattttccagggaagcagacgaggaatgttgattgccccagttttacccccacggctctagccaggaggcatgtctggagcttgaggtgaggagcttctgggttgaacagagactggctgggaggggacatcacagcattccctgacaatcccccccaccccccgcttacccgtggccatcactgcatcaagaaagcaaaagtgaaaaagcagaaagaagagaggttagtggcagaaatctcagtgctacagagagatgggagaggaggcaggctcactccatgcccagcacgcactgcatttcccacactgcgtttcccgcactgcatttcccactaagcgtgactcggggcgctcaggggaggcagagctgcagccaggcctctggaagtggacttgggacaatgcccagcccgggcccctgctgacattctcctgtctgctggtgccgggtcacaggcggactggtgaatcaggcctgtgacgttggcgggtagcgtgatggggaagtggcgggcatgcggaagacctggtgcaatcagggtccctgtcaccacactgcctgcgggaagcggctctgtcacatctacctcctgctgtgctcagagagagggaaaggtcaaagaacctgcccctgatgcccagccaaggcatctgacaccatgggtctcctccagatggccagagctggtctcccttccactccaagaaacggggaccatgcctgggcctgctccccttccttgggccatggcccccctgccacagaggcctggtggcccctgagctgctgctccgagtggaatgtcctggtctagaggcccttggctgctccagtgtcttaagacccatatgtgagtgctggctctgaccttgaacaagctcctccatcactccaggcctcgtttttcaggtgtatatgatgatagtatctatcataaatgatgacgtaaacagatgatagtatctatttaactcctagattgttatcaagtcaaggacaacaataggaaaacatgtcacctgtcaactcttacaaagggagggtaggacaggtggcccctgactagggggtgggggtgcagggggcacccgacccatctggccagccacagcctctgtaccctgctcccattttcaggcctcaatccccaagcactgttggccctggactgttttccccccttaattctgtttctcaatgcctgcttcttcccagtaagtgccacaccctgagggtgggtgggagagtgaggcagcagtgcccactttggctgggactgggcactgctgaggacagcatgggccacgtcttccccatctcaagactggctttttggctgggcatcgtggctcacgcctgtaatctcagcactttgggaggctgaggcacgtggatcacttgaagtcaggagttggagacatggtgaaactccgtctctactaaaaatacaaaaattagctgggcatggtggcaggtgcctgtaaccccagctacttgggaggctgaggcagaacaatcgcttgaacccgagaggcggaggttgcagtgagccgagctcatgccactgtgctccagcccgggtgacaagagcgaaaatccatgtcaaaaaaaaaagactgtatttttggctgggcattgtggctcatgcctataatctcagcactttgggaggctgaggtgggagaactgcttgagcccaggagtttgagaccagcctgggaaaaatagcaagaccttgtctttatggaaaaaaaaaaaaaacaaattagccaggcatggtggcacacacctgtagtcccagatacttaggaggccgaggtgggaggatcccttgagctcaggagtcggaggccgtggtgagctatcagttgcaccactgcactccagcctgggtggcagagcaagaccccaactcaaaaaaaaaaaaaaaaaaaaaaaggcggccttttcccagctgccagcaccctggctagttagggtttccctgaatccgcaactcctgtttgatggcgggtctcaaacgctgggaggcagcagagtcaccggtcagcggcaaggcctggagtctccattcggaaccagcacccgggagcctctgccgcgggtggtcgcggggccgtacgcggaggcgatggctctggtgctttgagccgttcctcagcagcacggcacaccccctcctgcggagccgcaaagctcacgagtgtgcggaaagtgacccggaccctgcagctgcctctcggccggagctagggctatgggtgttgggtgtaacgggtcacagaaggaggagggggaaaaccagtgcctcgtctgccacagaccaaccttcctggcctggcttcctctacttcttgaaattgactttttgaacatacgaaacagttggaaacattcctcctgggcagcaaaagatttctcagacagcttgagtaaaagacgctgactcagcagcagggagatgagcctttcgagggccagggaccagctctctctgcacactttggggtttccgccactccagggctgaatgtttatcaggctgggtgtggaggtttacgcctgtaatcccagcactttgggaggccaagaggggaggatcccttgagcccaggagttcgacaccaacctgggcaacacagcaagaccctatctctgcaaagaatttaaaaattagctgggtgtggtggcgcgcacctggggagccctaagaggtcaaggctgcagcgttcacatcactgcactccagcctaagcaacgcagaaagagaccctgcctcaaaaaaacaagaaagaaagagacatgatagattagggttccccaaagtgtgttccacagatatttttttttcttttgagatggagtcgcactctgtcgcccaggctggagtgcagtggcgcaatctcggctcactgcaacctccacctcctgggttcaagcaattctctgcttcagccttccaagtagcagggattacaggggcccaccaccacgcctggctaattttttgtatttttagtagagatgggggtttcacaatcttggccaggctggtcttgaactcctgacctcatgatccacctgcctcagcctccaaaagggctaggattacaggcgtgagccaccgtgcctggcctagactaccattttcacagtagaactggctgttatctggttccctttgctatcttttccttttgataaagctggatttctcatcccctaaaaacctgataactgattcttcacaagtcctagggtatcttcaccttgataaaaacaaggaaaccatcggaaaaagtggcacaccagggaggctgccaataaaaaggatttggagtgtttgtcccgcctggggatgactaaggctgactcagctcaggccccggggaagtcctgactttctctgtagaatcaaaacctctaatcagctgaagacctgccctgtttggaaaagtggactgtgggttatcagctgtgtttgttggagctgacaagcctcaactgttcgcaagctccgaggaagtctctgccctgccctgtttctcggtgagggatgcagatcccagtgtgggccagttgccccagcgtctccagccccgtcctgacctcgatgcccagggtgtccacgcacccaccgtgccactttctgggaggactttgggcttgacctgctgtctttcagccatgctcaggtggagcgttctgttctgttttcatttacagacacacacggcaaccctccccctcaggcactggaaaacacacaccccacaccccacacccaggaggctattttggtccttccctccctcctggaccaggaaaccctgatggggacacgaagaaacagttggggctggcagtgatgcaatagctctgacgggcagacagctcctgggatgcggcctttccatggcccggctggcccggctcagcttaacacattctggccggtggccagtgggctgggctcaggccggggagtgacagcgaccgaggctgcccggggcacctacctgtcttctggtcgccgctgaccaggaacttgaggatgttgttcatagcccccatgtagaagatgagccgcagctgcgtgacgcacatggtgaccaggctgagcagcaggatggggctgaacacgctgtgcatgaaggagggggccactgcagggagagggtgcggggctcagggccggggcacactgtccccaccaccggggggacacgcagatccctccacgctggaggccaggagggggccctcgggacgggcctggtgagggtaacggggttggcgctgcggtggggtcacctcttgggtgaaatcaggcaaatccctttccctcccccaggccttcctgagcgcctctgcagaacagggcgggcggggccgcctccccttttggggtgaggtgggaatggggtgagccgatacccacagagcactccctgcccgtcgcccggctgcggtctcaggcgggtacctgcggcatccggctggcacttcacctccaggtcgacggtggacaggcacagcttgtggccctcctgcagcgccacctgctccttggcactcctcatggagctgcccacactcaggcgccggcccaccgtggtcacctgcttgtagaactgcttccctgtgatcttgtggtcaaagcccagccagctgaacttgatcttcaccctggggccccgggagagtgtctgtgggtgctgcccgggaccccggctggggggcgggggctgggggcaggcgggacgggggcacctctacttacgagtagtccatgtcctccggccccgggaagggctcaaggggccagttaaagaagcagttgaggaaaaccagcccggagcagccggcccagaccacgaggacgacgatgaaggagacaccagcatcatagatgagctgacaggcaccgcggggacggggtgggggggggagggggcagagttagcccggggaggccagagccgcagcaggcaggggcgtctggccacccctgctgtccctgtgctgagccgcgcaaagaggcacagccctgccagcctgggcgttggggcatcaggcacccgccttccagtcctcccaccgtgcctgccctgctggtcatctgggcctggcgtgtgattagccccccgactcggaggccttcctgaccgccccgccatgaccacggcacgtcttgcaggctcatagtgatcggcccagcagaggggacggtgctcctggtccgtcggcttgtctggtattagcggagctccctgaaggcgggaaccggccagccccgtccactgatgcttccccagtgcctctgagagctcacatggcagaggccaaagaaatgctcaaggaagccaggcatggtggctcacgcctgtaatcccagcactttgggaggccaaagtgggcggatcatgaggtcaggagttccaggccagcctgaccaacatggtgaaaccccatctctactaaaaatacaaaaattagccgggcatggtggcgggcacctgtaatcctagctccttgggaggctgaggcaggagaatcacttgaacctgggaggtggaggttgcagtgagccgagatcgtgctgctgcactccaacctgggcgacagagcaagaccctgttcccccccaaaaaaaggaggaggaagaactttcgggatgctccccagtccaggggcatgagaatctctgcaagtccataggatggctggccccagagtcccagctcccaccacttcaatgcccaggtggccagcccacaccgtgtccccctctcctcgccaacagcattcccacacacaccaccgaggaaaggggcttttacttagtgtgagggtcagaggtgggagaagcccctacggggccctggcagacccacagggtctggggaacttgggctgatggactgtgaggtgtttgcttcgtcctgaccctgtgtgacttccacaggctcaaaatcctgcctaggagggaaacagctgaaacacttggccaagagcagtgctttggctggcggggagtaacggtacaataacagcaggctgggggttggggagcaggggagcagcgggagaccaggatgacggaggagacgggggcaagactcacaactggaaacagactcacccaccgcccttcccctgccccagccccgaaatgcaaaggcacctgcggcagatcctgcagccacatgcgtgattcccgtcccctgaggccccgcggttttcatttgtcgcccctgtgatgcccaggtgcatcctgcccgggtgggggtggtggagaggggccaccccgggtgcccacaattgcctccctcttcagagagggtggaaggagcctggagcaggcctctgcacagacaccagtgcaaaatacacgtgctcaccttgattcctggaaaggtgactgccgaggaggcgtaggacccaatcatcaaggcaataaacgtggaccgaaggtcgccgaacatgttgggcagctgagagataagaagcagagaaacctcagtggggaggatgcaccagggaaggggaggaggaggggacagagaactaggccccatgaggccccttcttcacctgcgccccttcctgtgtgactcacaggggcattagttcaggggcaatgaccgctcactgaaggtttctccttcatggactgaggctgatggggccaaggagggaggtaatgcagaatacaagcagttgtctgactttccggctggcaaccctccctatctctctgctcctggcagagcccaggagccttcttgtcttttcagggtaacactgagatgccagagaacaaagttatgagcctcaggcagccctcaaagggagaaagcctgttaaaaataagaatctatttggggataatagcatcattttataaataaaaatatcagcattccagaaagaccagatgtcagcaaaaactgcttttggtttggagagggtaggtttttggaagatgtcaatcagaattctacagttctcttcggtctgaggatgaagctggcccaggattcctgcttctgaatttcttttctttgttttgagatggggttttgctcttgttccccaggctggagcgcagtggtgtgagctcggctcgttgcaacctccgcctccctggttcaagtgattctcctgcctcagcctcccaagtcgcgagattagagatgcccgccaccatgcctggctaatttttgtatttttagtagagacggggtttcaccatgttggccaggctgatctcaagtgatccgcccgcctcggcctcccaaagtgctgggactacaggcgtgagccaccgcgcccggcctcctgcttctgaatttctcagtacaagcaggggattatcttcccacaggatgttcggcccgagcagttagcatcctggaaggccaacgggaagcaaggtccgggctctcttcccaacgaagccactctcggcatctcacatcagctcattctgggtacagggcaagagggggcccacctgaacaggacttcaaggctaactcttgctcattctaccgaaatccaggcctagggcaaactacatcctcccaaagaggcacaggttctctaacctcaagagacatcacactgtgtgtagcaaacctttcctgtccacacccagcgtccctggccttgggggctgccctctggatagccatgccaacctatttcattaaattcaggctgcttatggggacttaatctatgtcccctccaccctccccaccactccccatttgtcttgaatctttttctttctttctttctttttttttttttttgagacggagtctcgctctttcgcccaggctgtactgcagtggctctatctcggctcactgcaagctccgcctcccaggttcacgccattctcctgcctcagcctcccgtgtagctgggactataggcgcccgccaccacacccggctaatttttttgtattttcagtagagacggggtttcaccacgttagccaggatggtctggatctcctgacctcgtgatccgcccgccttggcctcccaaagtgctgggattacaggcgtgagccaccgcgcccaacctttttttcttgttttaagagacaggatctgctggacgcagtggctcacgcctgcaatcccagagtgctgcctttgacctcagagtttaagaccagcctggacaacatggcgaaaccctgcctctgtatctttttaaagttaaaaaaaagagagagagacaaggggggcagatcacctgaggtcaggaattcgagatcagcctggcaaacatggcgaaaccctgtctctactaaaaatacaaaaattagccggatgtggtggcaggcgcctataatcccagctacttgggaggctgaggcaggaaaatggcttgaacccgggaggcggagcttgcagtgagccgacactgcgccactgcactccagcctgggtgacagagcgagactctgtgtcaaaaaaaaaaaaagagagagagagacagggtctcattctgttgcccaggtgggagtgcagtaatgcaatcatagctcactgcagcctccaacttggctcaagtgatcttccccccccagctcccaagtcactgggacaacaggcccacgccaccatgccccagctagtggttttttttttggaggcagggtatcgctctgtcacccaggctggaatgcactgacatgcaatcttggctctctgcaacctccacctcccaagttcaagcgagtctcctgcctcagcgtcctgtgtggctgggaccacaggtgtgcaccaccatgcccggctaatttttgtattgttagtagagatagggtttcaccatgctgccaggctggtcttgaactcctgacctcaagcgatccatctatcttggcctcccaaagtgctgggattacaggcatcagccatcacgcccggcctttaattatttttgtagagatggggtctcactatattgcccaggctagacttgaactcctggcctcaagctcttctcccaccttggcctcccaaaataaataatttttgttttatcaaacctgcctgcctgcaagcaaattaactgttactgagcggagggagtttgaacttggcgacatacctgtctgcagtcactgctgcctgttttgcccacttttaaaaatgagtaagggatgtcagcaaaatttaaaacctctgtgcttcaaaggatggcatcaagaaagtgaaaagagagccgggcgcggtggctcacacctgtcatccccgcactttgggaggccgaggcaggcagatcacgaggtcagcagttcaacaccagcctggccaacatggggaaaccctatctctactaaaaatacaaaaaattagccgggcgtggtggtggacgcctgtaatcccagctactcgggaggctgagacaggagaatcccttgaaccgggagatggaggttgcagtgagctgacattgatccactgcactctagcctgggcaagagtgcgagactccatctcaaaaaaaaaagaaagtgaaaacaggctgggagtggtggctcgtgcctgtcatcccagcactttggaaggctggggcagcgggattacttgagggcaggagttcaagaaagtgaaaagaatgcacagaatgggagaaacttcttacaaatcacagatcaagagcttgcatctagaatatataaacatagtgcccaacagttattcaaaaaacaaaaaatagaacatataaagaacccctacatctcaataataaaaagataaataaccaatttttttttttagatggagtctcgctctgtctcccaggctggagtgcagtggtgcgatctcggcccactccaacctctgtctcctgggttcatgccattctcccacctcagcctcccgagcggcacctcccattgcaggtatgtgccaccacgcccagctattttttgaaataaccaattttttaaatgggcaaaggatctgaatagacatttctccaaagaagatatacaaatggccaataagcatatggaaagatgctcaacatcattaatcatagtgaaattcaaatcaaagccacaatgagataccacttgatacccattaggacaccaaaaagtcacagtgaggccaggcgcggtggctcacgcctgtcatcccagcactttgggaggccgaagcgggcggatcacgaggtcaggagttccagaccagcctagggaacatagtgagaccccgtctctaccaaaaatacaaaaacttagcgaggtatggtggaacatgcctgtaatcccagctactcgggaggctgaggcaggagaatcacttgaacccaggcgggggttgcagtgagccgagatcgtgccactgcactccagcctgcgcaacagagcaagactacgttttaaaaaaaagaggctgggcacggtggctcacgcctgtaatcccagcactttgggaggccgaggtgggcagatcacaagatcaggagttcaagaccagcctggcgaacatggtgaaaccccgtccctgctaaaaaaatgcaaaaattagccaggcatggtgacgtgcacctgtaatcccagctacttgggaggctgaggcaggagaattgcttgaacccgggtggtggaggttgcagtgagccaagattgtgccactgcactccagcctgggcgacagagcaagactcaaaaaaaaaaaagaaatgaggccgggcgaggtggctcacgcctgtaatcccagcactttgggaggccaaggtgggcggatcacctgaggtcaggagttcgagaccagcctggccaaaatggtgaaaccccatctctacaaaaatgcaaaaattagctgggcataatggcgggcacctgtaatcccagctactcaggaggctgagacaggagaatcacttgaacttgggaggcagagcttgcagtgagtcaagatatcgccactgccctccaccctgggcgacagagtgagactccgtctcaaaaagaaaaaaaaaagaaaaaagaaaaagaaaagaaaagaaatcccttccaacagaagacaaaagaaatgtgatgtgctcacacgtgcccaggcacgcccaggtgagcaatcttactctctgggtacctgcctcccaggtaggttgcagttcaaaggacaagcctcggttcccaagctcacatatttgggctgctccattactgcactgtagcaaaggcatctccgtggccatatctaccccagtgagaatgcaaatatttgttctgcttatgcggaaggagggaagtgttcctgcccggcatgccagcacagccggcgcaaagaaagaaagaaagaaaggggccaggcgcggtggctcacgcctgtaatcccaacgctttgggaggccgaggcaggtggaccatgaggtcaggagcttgagaccagcttggccaacacagtgaaaccttgtctctactagaaatacaaaaattagctgggcgtggtggtgggtgcctgtagtcccagctactggggaagaggctgaggcagaattgcttgaatccaggaggcagaggttgcagtgagccgagatcatgccactgcactccagcctgggtgacagaacgagactctgtctcaaaaaaaaaaaaaagggaggcccagagaaggcttggaacccaaccagaagggcaaatggaagcccagagcctggctcccttggtgcagggtcaggtgaggctaacatgtaggttgctgcagtcacctttgggtaaaaagagtgtctcaaacttttcaacagagctagagaatgttccggaaaagcagagagcttgctagctaggcattttccttctacctttttaatctcaagcctgcctgccttaaccctaacctaggctacagaccaacagagccacagggccctggggtgaccatgtggccctgcctggtcttctggagtcttctccccagcactagatccaggatggggaagagcagaacctggggaagaggccgactctccatctgtccatggatgaggccttgccctcaggcctggacagggcaggggcctcccagctgctccctttgatgccctgcctcttgccgcctggaacattcttaccagcaccaagaaaattcttcccaacatgttattctggtcagcagggccattccttagggagtagagtgcctcaggggaaccacactaggtagccttcaaaccaacactgacatcttgtatttttaattatgatcttttccttagaacggcaatgcctgggctgggcgcggtggctcacgcctgtaatcgcaacactttgggaggctgaggtgggcggatcacgagatcgagaccatcctggccaacatggtgaaaccccatctctattaaaaataccaaaaattagccgggtgtggcggcgtgcacctgtagtcccaggtacttgggaggctgaagcaggaggattgcttgaacccagggggcagaggttgcaatgagccaagatcatgccactgcactccagcctggcgacagagtgagactctgtctcaaaaaaagaaaagaaaagcatatccattgcaaaatgtttggagcaaagtataaaaagaataaggtaaaaatcaccctgaggccagacgcagtggctcacatctataatcccagcactttaggaggctgaggcaggtggatcacttgaggccagcagttcaagaccagcctggccaacatggtgaaaccctgtctctaccaaaaataaagaaaattagctgggcgtggtggcaggcacctgtagtcccagctacttgggaggctgaagcagcagaatcgcttgaacttgggagatagaggttgcagtgagcagagactgagccactgcactccagcctgggcaacacagttagactccgtctcaaaaaaacaaaaaacttttactaatgactttcaacatttttctacaacttaaaaaattatttggccaggcgcggtggctcacgcctgtaatcccagcactttgggaagctgaggcgggtggatcatgaggtcaggagatcgagaccatcctcgctaacacagtgaaaccccgtctctactaaaaatacaaaaaattagctgggcgtggtggcgggcgcctgtagtcccagctactcgggaggctgagacgggagaatggcgtgaacctgggaggcagagcttgcagtgagctgagattgcgccactgcactccagcctgggtgacagagcaagactccgtctcaaaaaaaaaaaaatcatttatatttgtcctttttttctatggggatgttaatctttcttttttttttttacagtaagctatatattaattgaatatatatatatatatattttttttttttttttgagacggagtctggctctgtcacccaggctggagtgcagtagtgctatctcggctcactgcaacctccacctcccgggtccaagcaattctcctgcctcagcctcccgagtagccagggttacaggtgcctgccacgacgcctggctaatttttgtatttttagtagagacggggtttagccatgttggccaggctggtctcaaactcttgacctcaagtgatccgcccgcctcagcctcccaaaatgctgggattacaggtatgagccaccgcgcccttccaatatttcatttaacataatttcaaagtaggtctgtgctctaaggtgagcaaaagaagagacattctaaatctcataagagatttttttttctttcctctttttttttttttttttttttggagacatggtctcgctctgtcatccaggctggagtgcaatggtacgattctggctcactgcaacctctgcctcccaggttcaaatgattctcctgcctcagcctcccgagcagctgggatggattatagccacctgctatgacatccaggtaatttttgtatttttagtagagacagggtttcaccatgttggtcaggctggtctcaaactcctgacctcaagcgatctgcccacctcagcctctcaaagtgttgggatgacaggcgtgaaccattgcgcccagacttttttttttttttccacactgttcctctgagtgaggaatcaggtttcaggaccctcaatgttgacaactaacattttacccttgagattttacctagagataccgaaagaaaagataacatctgaatacaagaatcgcgttgcatatttgctgcctccatagggttgttgtggtagcgactgattttccacccctcccagtttggtggtgtttgtttgtttgtttgtttgtttgttttaagtaaaatgtcagaaatgcaaaaatgctgcatttatttcccttaagacattgaaaatagtggaagtttgcagatttttaattcttcgtaggtctgagctggcactagactgctaccaaaggggtctgttccacacgctaatttcaggcttgcggaccatcagcaaactgcaatgaaacctgtgggcatgaatcttccagagtggtagaatctcattcccatatgcccgccaagtttccaggtgtagctgggaaaacccaaatgttccctggatcccgagatggctaataagcactcaggcctgctacaccaccgaacagagccccacagccagagaggcacacggcctgcttcacacagccgacaaccccgctggaaacaaccagtgctgggagccaaggccaaactgatgcaaaggcgctactgagccagagcccttctgcaccgagactaccccaggcatgcaccgccctcccaaaggtccaaaacgatgcaaaggcgctactgagccagagtcgtgcactgagactaccccaggcatgcaccgccctcccgaaggtccaaaccaatgcaaaggcgctactgagccagagtcctgcattgagactaccccagacatgtactgccctcccgaaggtccaaaccaatgcaaaggtgctattgagccagagtcctgcactgagactaccccaggcgtgtaccaccctccggaaggtccaaaccgatgcaaagccactattgagccagagtccttctgcaccgccctcccgaaggtccaaactgatgcaaaggtgctactgagccagagtccttctgcaccgagactaccccaggcatgcactgccttcccgaaggtcccaaccaatgcaaaggcactattgagccagagtcctgcactgagactaccccagacgtgtaccgccctcccgaaggtccaaaccaatgcaaaggcgctattgagccagagtcctgcactgtgactaccccaggtgtgcgccgccctcctgaaggtgcgtgtgggtcgacaagggtgcacaagcggcagggggctgcatagcaaggtctccttcagctttgttttaattatttttatagagacagggtctcactctattgcccaggctggtcttgaactcctggattccagcgatccttccaccttggcttcccaaactgcaatgattacaggcatgagccactgcacccggccaatctttgtatattgattttgtgaaggctctttatgtattaaagacattcattcacaggccgggcacggtggctcacacctgtaatcccagcactttcagaggccgaggcaagcggatcacctgaggtcaggggtttgagaccagcctggccaacatagtgaaacctcgtctttactaaaaatacaaaaattagccggacatggtggcaggcacctgtaatcctagctacttgggaagctgaggcagaaaaatcgcttgaaccccagaggcagaggttgcaatgagccgagattgtgccactgcactccagcctgggcgacagagcgagactcttgtctcaaaaattaataaaaataaaataaaatgaagacattcacagttctatatactatgaataaattttcctagtttgtcatttaacttcttaattcatggtgttttgttttttcagtttttttttttttttttgagatggagtttcgctcttattgcccaggctggagtgcaatggtgcaatctcggctcaccgcaacctccacctcccgggttcatgcgattctcctgcctcagcctcccaagtagctgggattacaggcacccgccaccacacccggctaatttttgtatttttagtagagacagggtttcaccatgttggccaggctggtctcgaactcctgacctcaggtgatccacccgcctcagcctcccaaagtgctgggattacaggcgtgagccactgcgcccggccgagggttttaaagatcataaatagggtaggtattaacaatagttactattatgatatgtgttatgacttcataacagggaaaatcttctggtcaagctgctcctgggcatagccaacgagggaagtgtcctctggcaggaaccacagctctgggaggaagaaaaggaagccgactacaggataaaacacaaattagtattcccctttaaataaataattagtgtccacagagatggcctttcttctcctgtccttgttattctgttgtgaccacacattgactgctgtcaggatgtttatgctttgggtttcactggtcaaggtcatccttcatgttctcttcagagaggtttcatttgacacaaatgctaggtactccctaaaagctgaaacacacttttgaccacctatttaaaaacttttattggtcaaaaaacaccatgaggccgggcgcggtggctcacacctgtaatcccagcactttgggaggccgaggcaggggatcacctgaggtcaggagttcgagaccagcctggccaatacggtgaaaccccatctctactaaaaatacaaaaaattagccaggcgtggtggcgtgcacctgtaatcccagctactcggcaggctgaggcaggagaatcgcttgaacccaggaggcagaggtggcagtgagttgagatcgcgccattgcactccagtctgggcaacaagagtgaaactctgcctcaaaaaacaaaacaaaacaaaacaaaacaaaaacttaaagattagaaaagtcaagggactcccccaagctagtaatggtcagattggggattcaagccaggccaagcctctgtgtgtaggccccaggccacgctgcctctctggagtctcctgtggctccggccaatacacacttcagtttggatcccacggcttttacatgtgccttattaagatccaatctgcgcccttcaactagaggtttatttttcattcatttacttatttattttttgagacagagcctcactctgtcgccaaggctacagtgcagcagcacaatctcagctcacttcaagctccacctccctggttcaagcgattctcctgcctcagcctcccgagtagctgggattacaggcatgtgccactacgccacgatgcccagctaattttttttttgtattttgagtagagatggagtttcgccatgttggccaggctggtctcgaactcctgacttcaggtgatccatccgcctcggcctcccaaagtgctgggatgacaggcgtgagccaccgcgcccggtcatttttttaaatttgtttttggagatgaggtcatgctgtattgcccaggctggagcgcagtggctattcacaggcatgatccctctactgatcagcaggacacttttgacctgctctgtttctgacctgggccggttcagccctccttaggcaacctgggggtccctcaccccccggaggtcaccacactgatgctgaacttagtgtagacatctcatcaacacagcacgctattgtgcagaactcctgggctcaactcatctgcccacctcagcctcctgagcagctgagactacagggggataccacaatgcccagtccccaactagagatggcttacattccttctgaagctccttttagacccatctgccccctgccctcacctcctgctgttgccttcggctgacctccccatggtccagcgccacagcatcggatgggcttgcatttgcctgtggactcccgtaggtcatcctgacatctgggtcactccccacattccccctctcgctcactccgtccccagcttccctgcctccaccggtctcagctgcgcataatggctgttcgaagccgcggtgccggagtgagggctgagcgctgagcagagcgccctagcgcgggcctcgagggctggcggaggggaaggaccccaggaggggaaggaccagctttgctgccaagcaggaagccggagctgtttcctgactcaccaccacactcacaggtgggagtgcaagcccctcttcccgccctcaggtgcttcccacagccccctcgccgcctctgcctccgtgcgggtcaacctgtcctgccagcccgggctgttcactcactgcctccacgcagcctcagtcacacagggaagcccgtgactctctctctttcagccccctggctgcagcataaacaggccggactgtgtgaccttcccagaggggaaaacagcagctgcaggcggcccctcccctggcattctggccatagagcatgaccaccggacaggagtgcctgcagggccaaggccctgggacagtgcgggcgcgggagcttctctaagatgccggacgtacgtgccttttggcccagggcaggccatggcattgctggcaggcagaaacaaggggcaaccgtggcacccccggccctgactttccacatccacggactcccgagtcctccctggcctgcaggaggctggggagctgggtggtgggtgggggctgcggagctgggaggtgggtgggggctggggagctgggtggtgggtgggggctggcattctggccctcgggtcccctccagagggagccttgtccccaagtggctggagtacacacccagagttctgtacaacctgcacaggccgggatcccggaaccagactgcacaggtagactctgccaggctgggctgtttcctacccacaacaaccgggcacctccaagcacatgctgcccgggacaaggtccttgtggtcacctttctgcttcagtgctgaagggaggggaagggtgtgctcccctcccccggccacctcctgtgccttcccggccgggtccagtcctgccaataccgctgccctttccgtctgaacgtggtcacatactgcagcaaattcatgaggcagaaccctcagatggcaaattctccccaaaccaatggcaagtagctgactgcctgagcttccccaaggtacaggacagaaagagaggaaggtggggaggcacagcaggcactgggcactggcaagtcccgctcaccaggcacctagaccctccagagctggccgggggccaccgcgggaccctctcctggaccctccagagctggccgggggccaccgtgggaccctctcctggctgcagacgcggggtctactgagccacggcactaaactcctgtcccctctctgggggcatctgccatcctgccctcctctccaggatctgaagagggatgtttatcctcttcacttccctcagatcccacctcccatgaaatcatgccttcctcaggtttaaagtcagacttgaaggaatcaaaagggaaaatccacagagaaatgtctcatcggggagcctggcaacattttgaaacccgcttttctgtgtggcttctgctgagaaatccccatcccacccacggggacaggggtcagagtaatggagtggaaatggcaggttcacaattttggctacagctgctcccatctctaagcaacccaggctccgggttggagggtggcgaccccaagatgcggcctcagccgccggccgtgtttgtgctccagccgatgaagcgagtgcaaagggctgtacaaacgcgaggcactgaacaaacactgagcgtgccgtccagatgtcccgggggaggctgaggatccacaccgtggggagtgctctgcccccatggagtgacctggcgtccgccctccacggatggcacgcgatggcccaggccctgtgctgcagggccctgggagagccagcactggctactgggcagcctacctgacgcgacagccacccttgcccctcggagcctccacttgggagggaaataccaccatgggtgccgacctcttgggctctggaaggatggctcatggccatctccttctggactacaaggaaaaggcgtgtgcccgcttggagccccctctcctaccagtgggggtaacagctcgcagcccctggtcatctgtatttagaccacagcccatgcagcacaaaggccccgggacccaggaagtccccgaattaaggcttccacagcgccgtcccctagagtcctgggttatcacagagctattatccacagccccaacatggttgttgaagattggagttagaaattcctaaaggcgaccctggagactcctttgtcccccaaattagaacacgggtgggagacacaaacagaaagtgccattgtgccctgagcttggcgtctctgggagctgatcccgacagttctgctttctgaagtcctgggttgtatcagaatgagattcggctctgctcagcagaagccccagtcagcccaagagtgttgcttaactgcttcagccctgtcctcactgacctcatttcccttttggggtctgttctcaaggagcaggcactggagccctcatcagaggcctcagggggcaggggaatgcccatggaactccctccaccctggggggaggcagaaagagatgacttagaaggagagctggcccatgcaaccagagggtgtgggtgtgaatggtgggtgtcagcacatgccctcagacgaggaacagtgacgtagcagcttcctggggcctctggaccaagggttggcaaactttttccataaagggccagacaatagacttttttttttttgagtcagagtctcgctctgtcacccatgctggagtgcagtggcacaatctcagctcactgcaacctctgcctcccgggttcaagcaattctcctgcctcagcctcctgagtcgtggggactacaggcgcccaccaccacatctggctaatttttgcatttttagtagagacggggtttcaccatgttggccagcctgctctcaaactcatgagctcaggtgatccacccgcctcagcctcccaaagtgctggggttacaggcgtgagctagtgtgcctggctaagacagtagaccttttgggctttacaagccatatggcctctgtcacgactgcgttgactctgatgagataccacaaaagcagccacagacaggagcaaacaggcacagctctaccccatgaagttttgtttacaaaaacaggcagtggtctggatttggcctggcaatggcggtttgctgactcctgctctagatcaaaaaatgaaaaccttgaagaacaaaccaacagcctcccttagacagacctctggtagccaaacgcttcaaatggtgatcaggtgactctcttgcctggtcactctctagcctgtgtagctttttgcctccagtgggagagcaaagagtgaatagaaacgctcctgccacagtggtttgtgtgttttgtttttttttttaagacggagtctcactctgccacccaggctggagtgcagtggtgcgatctcagctcactgcaacctccgcctcccgggttcaagcaattctcccacctcagcctcccgagtagctggaattacaggaacatgccaccatcccaggctaatttttgcatgtttagtacagattgggtttcatcatgttggccaggctggtcttgaactcctggcctcaggtgatccacccaccttggcctcccaaagtgctgggattacaggtgtgagccaccgcacccggccaccgcagtggtttttagccttcacacagacctgccagaggccagtgaaagtaatggaccctcccctccagaaagacacagctgagcagcacctacacacgctttgttggcatggaatttcaagggtgtgcacggctctcctgaagcttactcatggaccatgtagagacctgaaaaccccagggtaagatctcctgctcactcggaaagaacactagtgtctttgtatttgaaagagctcttacgagtcactaaatactaataataataaaatcaagagcactgtagaaaaatagacaaatgacacaaagaagcaattcacagaagaaatgcaatttaccaataaagaggagaaaaaatgctctgtctcactaataatgaaataaattttaaaaatggcatgtcgtttttcataggatcagagtggctatgttttaaagaggaatgacatggcactggaagggacatggaggaaaagacactcgtgtacgtgctggtgggcctgtggtggcaggcaggcttttttttgagacagaatttcactcgtcgcccaggccggagtgcagtggcgcaatctcgactcgctgcaacctctgcctcccgggttcaagcgattctcctgcctcagcctcccaagtagctgggattacaggcgccctccaccaagcccagctaatttttgtatttttagtagagacggggtttcaccatactggtcaggctggtctcgaactcctgacctcaggtgatctgcccgcctcagcctcccaaagtgctgggattacaggcgtgagccactgcgcccggccagataacatttttagaagactatttaacagtacatattaaattttaaaacatgctaatcctgtggcccagggctgccaggaacttattttacagaaatacatgtacagggatgctcacttcagcagcattcataaattggaaaaattgggaaccaagccaaaagtccattagttggaaacaggttgaataaatgatggtccatctatattaaagaataatatacagaactgcttaataataaggcagatctctaagtactgacaggaaaggatgtaaaagatacattaagggaaaaggcaagttatcacagttcttttttttttaagaaaaaaaaaaagaataacactggtacatgcagatcttttaaatactgaagaaatatattccaaactgatgaagacaggctgatagaattttttttttttaaacggagtttcgctcttgttgcccaggctggaatgcaatgccgcggtctcggctcactgcaacctccgccacccaggttcaagcgattctcctgcctcagtctcccaagtagctgggattacaggcgtgtgccaccatgcccgagtaatatttttgtatttttagtagagatggggtttcatttcaccatgttggccaggctggtctcgaactcctgacctcaggtgatgggaaccttctcagcctcccaaagtgctgggattacaggtgtgagccactgcgcctggcaggctcatagaagtttagtctacaattcatatttctgaaatgttaaatttttacttttatttttgggacaaggtctcgctctgtcacacaggctggaatatagtggtgtcattgtggcatactgtggcctggaacttctgggctcaagccttcctcccacctcagcctcccgaggagctgggactacaagcaactgccaccatgccctggctaattaaaaaaaaaaaaaaattggagagacaaggtgtctcgctatgttgcccaggctggtctcaaccctggcctcaaatgatcctcccaccttagcctcccaaagtgctgggattacaggtgtgagcaactgctcccaacctgaatttttaaaataaaatcatttttgggccaggtatggtggctcacacctggaatcccagcactttgggaggtcaaggtgggaggatctgttgagcccaggagtttgagaccagcctggtcaacatagtaagaccccatctgtaaaaaatgaaaataaaaaatgtaatgaaaaaaattttgttttataattataaaacataaaaaaagacaaagaattcttactggcctattagctccaaccgcagggtcccttttaaagtctttctttttttcctttttttttttttgagggggagtcttgatcttgtcacccaggctggagttcagtggcgcgatctcggctcactgcaaactccgcctcccggcctcaagcgattctcctgcctcagcctcccaagtagctgggattccagggacccaccactgtgcccagctaatttttgtatattttagtagagacggggtttcactatcttgggccaggctggtctcgaactcctgacctcatgatccaccacccccatcggcctcccggagtgctgggattacaggtgtgagccaccgcacccggcctaaagtctttcttaacagggattcttggtcgtttttcagacaaaacacctctcggcatttcggggtgtgaggtcctcaagctcaaggaccatctcgttcctttatccctgaaattcaggcctgccgtgacagaggcgtcgcgtgactaaaataatggaggtgaggccaggtttttagttttcatgctgatgaaagagctgctggttttcggccgagcgccgtggctcacgcctgtcatcccagcactttgggaggctgaggcgggcagattgcctgagatcaggggtatgagaccagcctggccaacatggtgaaaccccgtctctactaaaaatacaaaaattagcgaggcgtgatggtgcacgcctatagtcccaactactcgggaggctgaggtaggagaattgcctgaacccgggaggcggaggttgcagtgagccaagattgcgtcactgcactccagcctgggcaaccgagcagactcaaaaaaaaaaaaaagaaaaaggaaaaaagaagaggtccagaagcccccagagctccctcaaagctaaacaagaacccttcaatggcacgacaagggaaatcagaaaccagagtgtaccacaaatagtaatggtaggtactgtgtcttagaaactttttcaccggtaaactgatgcaggcgaggtttccttgatggacagaagcctctctgaagaagctattattctcacttctttcccaatggccagctcggaatggcacaattgcccaactgggcgagcccacagagttcccttcttccctctgggagagactttttggttcctcttttgactttcttttttgttgttgtttttgagacagagtctggctctgtcgcccaggctggagtgcagtggcttgatcttggctcacggcaacctccgcctcccaggttccagcaattctcccgcctcagcctccgagtagctgggattacaggcatgcaccacccgcccggctaatttttgtattttttagtagagacggggtttcaccatgttggccaggctggtctcaaactcctgacctcaagtgatccgcctgcctcagtctcccaaagtgctgggatttcaggtgtgagccaccatgcccagccccttttttgactttctttctttcaaccccaccttccttctgcctccctgacatcaagaaggagcatattttgtgatgtcctggggctcccaacaagggggtgcttagtaccccgagaaaacatctcccccaggcgactgtctgtgcccgggcacggaggaaacaagaggagcagaagaccagatgttccctgcattttccatctggctccggacaaaggcaaaggttgaggcagttccacgggaggcgggtggtcaggctgctccatgagccgaagctcccggagaccctgatgacagctgccgaggaaaacaggaaaagaaagtgggcggcagcgttttgtcttcctgcctctgccttccttgggcacaaggctagtgagctgcttccgcagcatcaaagcccagatcagaaggcagggaatgtcggccaggccaggtggctcacgcctgtcaccccagcgctttgggaggccaaggcgggtggatcacctgaggtcaggagtttgagaccagcctgaccaacatggcgaaaccccatgtgtactaaaaatacaaaaattagccgggtgtggtggcgcacgcccatagtcccagctactcgggaggctgaggcaggagaatcgcttgaacctgggacgcggaggttgcagtgagccgagatccccccactgcactccagcctgggcgacagagcaagactccgtctcaaaaaaaaaaaaaaaggcaagggattgtgaagccacgccctgctgcctgtggacctcagctgaggaggccctgccaggccacctcgcccatagcccctctactgtttgggacacccaggcacatgcaggcacatggaaggcaaggaaacagaaaccaatcaaagcggcctcaaatttagaaacagattactgaactacagagctttaaaaaatctgtactcactgttaatgaggtgaaggtcatacacatcccaccaaagccattcagagccagggcgatgaagatgagcacggagagagctgcagggacatggaaagctcgtgagtggagaccccagctgagctccagggaagccgggaccagcccagagtcctgcgcggtgcaggctcccagtaaatccagtaaacgcaggccggggttagtacctgacatctggggagtggaactgcccctttctcaccccctcctctaggcctatttctttttcttttttaatcgagacgtagttttgctcttgtcacccaggctggagtgcaatggcacgatcctggctcactgcaacctctgactcccgggttcaagtgatcctcctgcctcagcctcccaagtagccgggattacaggcatgcgccaccacacccggctaatttttgtatgtcttgccatgttggccaggctggtctcgaactcctggcctcgggtgatctgccgatctcagcctcccaaagcgctaagattacaggcataagccaccatgcccagcctcctcttgcctatttcacaaagcgtgggctcttgaaaaagctgcacacccatcttcttttctccaattaatattagcagtgtccaggcgcagtgactcacacctagaatcccaacactttgggaggctgaagcaggagaattgcttgagcccaggggttcaagaccagcctgggcaacaaagtgagaccccatttctaaaaaaaagttaaaaattagccaggtgaagccaggcgcggtggctcacgcctgtaatcccagcactttgggaggctgaggcaggtggatcacgaggtcaggagatcaagaccatcctggttaacacagtgaaaccccatctctaataaaaatacaaaaaattagccaggcgtggtggcgggtgcccgtggtcccaactacacaggaggctgaggcaggagaatggcgtgaacccgggaggtggaggttgcagtgagctgagattgcgccattgcactccagcccgggcgacagagggagactctgtctcaacaacaacaacaaaaaaattagctagctgtgtgtgtgcgtgcctgtagtcccagctactctggaggctgaagtgggacgatcgcttgagcctgggaggtccagggtgcagtaagctgtgactgcaccactgcactccagccagggtgacagagagagaccctgtctctaaaacaaaacaaaacaaaacaacaacaacaaaaaaacaaacagcagcgagcaggaggcctaagaaaccaaaaatacaggttcctgaaaatcagtagatgagcctggctaagattttggtgaaactcgagtcctcttttggtgtttgctctacaaatccttgaacagggttggggaccaggtggcttctaagccatccttcatgctttggcctgtgctgcctggaggggactcagcttgtgacttctgcacacaccgatgaccatgcccctgcagccggcctggttcttagaacttgcctctcaggttggcatcagtgagggactggcttggtttggtgatgagatggaagttgctcataccctggaagctcctgtctggggtggctgctctctgatctcgccgtctatttgagataagtaactgagtagaggcgtaacaggtgtcccctctaacttgagcagggagcagcaggcccaggacagtgtccaagagcaggtgggcctgggagcagctcagggcactctctccccggtccctgacagaagatggagggagaggacactcaccgtttggtttacttgctccgtacgcaatcagcaagcaggaaaccgcgaagcaggcgctaaaaccaagcagaaacgcaatgttatttaccattatgactttattcagtgttattgttttgtttttgtttttggtttttggtttttcttgagacagagccttgctctgtcacccgggctggagtgcagtggcgcgatctcggctcactgcaacctccgcctcccaggttcaagcatttctcctgcctcagcctcccaagtagctgggatattacaggcgcccaccaccacgcgtggctaatttttttatttttagtggagacagggtttcaccatgttggccaggctggtctcgaactcctggcctcaggtgacccacccaactctgcctcccaaaaagctgggattaccagtgtaagccaccgtgcccagcccattttcatttatatttttgtatatgtattataaagcacattaagaatggcatagggggccgggagccactgcactccagctccagttgcttgggcaacaacagcaaaactccaactcaaaaggaaaaaaaaaaaaaaaagaatggcataggggccaggcacgatggctcacgcctgtaatcccagcactttgggaggccgaggcgggcagatcacaaggtcaggagatcgagaccatcctggctaacacagtgaaaccccgtctctactaaaaatacaaaaaattagccgggcgtggtggcaggcgcctgtggtcccagctactcgggaggctgaggcaggagaatagcgtgaacccgggaggcggagctcgcagtgagccgagatcgcgccgctgcactctagcctgggcgacagagggagactccatctcaataaataaataaataaataaataaataaataaatatgaaaaatataaaaattagctgggtgtggtggcaggcgcctgtaatcccagctactcgggagggtgagacaggagaattgcttgaactggggaggcagaggttgccgtgagccgagatcacgccactgcactccagcctgggcgacacagcaagactccgtcttgaaaaaaaaaaaaaaaaaaagagcacagatatacatcatttataattccatgtgcttattatattgggggtacgtgttgaaaatcttttttctggtggagctataaggtcaaacgggctgtggaaaccagtgttgttggttttttttctcatcagatggatactgtgccagcttcgtaacaaggtttgagggaagcatgtctcacacatgcgagggaaaccccaattatcatgcttatgaactacaaagggatgggaaacacatgttcttagtgacaagcagctccggtccctgggcggcctggagcctggagcttttcttattcggtactggagcacggcgaggaccacagtacctgctgattcggtggcggacggggtaggaactccattctggagggccttcagggagctccacagtacacctgatatcaggtacgaccaggatacccttctgtggggaactcagcccagggggtccacctgcccactccctgccccctaagggacccacactgacctgcccagcagcctgagcttcctcgggccatacttgtccatgacgatacccaggggcagggtgatggcactgagcagaaaggagcccacagtgaaggccaaatttagcatctcgtcctgggcctggcagctgagccagccgttcatccagctcacctcctcgtgccccggctctgctgtgccgcccactgtgccattggtgacattctctgtgtgaagagggaaggaaaccctgacctcagggtcatgacagggattcccaaagatcagaagggcaggtgcccattcagagtccccccactgggaatgccagggctggctggcggcctctcgagggctcaggctaccccgcagcaggcttggatggccatttggcccaagtcccctggagtgaaaatgtagaggttcttaacttttgtgggggccatggaccctttgaaaaatccaataaagacctccccagaaaatgcacaccaaggtttatccacagtttcaggagctttgtgtgtcccttgaagagcaacgaagcccaggctgagagtcccattcgagagcatccgccaccctagaacggcagacctcagggcccagccttggctgtggggccccaggctggtgagaaccttctcacggcagctatgtccgtggggacagactgcagccagtatggaggcagaacccagaccacttgggaagcacaagcactggtctcaccccaatagcctggttctcctctgtccatgtggggagactgcggcgcctccttcaatgggaagtccagctgccttctcaaacatagaacagatgccaccttctccccctgatattttctttttctttttttttttgaggcggagtctcactctgttgcccaggctggagtgcagtagcacgatctcggctcactgcaacctccgcctcccgggttcaagcaattctcctgcctcagcctcccgagtagctgggattacaggcacctgccaccgcgcccggctagtgtttgtatttttagtaaagatggggtttcatcatgttgcccaggctggtctcgaactcctgacctcaggtgatcctctcacctctgcctcccaaagtgctgggatcacaggcgtgagccgccacacccagccgatatgcacctttcttattttccttgccggggtcacagtggtgccatcccgtggccatgcctagacctcgctgggtgctgagtctggtgtgtttgccacacccagcccttaatggcccccttcaaagtccacccagcaccaaaacaacacagaaaggaagagaaaagtgctgtggcagctgaagatgggagggtggaggacgggctgggaacgtggctgaggagctctcctggccgggactgctagttaagagatgctgactaatcctgcagaaaacaggagccgactttgattagacatgaggtcacgctgggagagtcaaggaaacgctcttcttccggtaactgcctgccttccaattgcagccctctggcgccagggctgtagcgccgaggtttgcaaaagcttgctcaggcctctcggggttcctccaaggttactggaaaggatgcgcacaggtggactcgtgcttcatgccaacgtgtggccaaggagccccgccggggccgtgtggatgaagagcgtggaactggaatctggtttctagcttccagtgtttgattctccactttctacctgcatgaccttgctctagctcagtttccttgtccataacatggacatcatataatgataagatccacctcctagagtgtgggggaagatcaatgagaaaaattcagaaaaccttctggagctcacccaggcatagaaagcactcaataatgaatagctacaagttgctgctgttctcgtggttatcatgatcattgctgctattggaggctccggcggggaatcacggcaccatcagctggcacagagccggatgcagtggctgtggggagcacagtcccgtcagcgtgtgtggaagcgcaaagacatgtctaatcccccactgggctgtgagccccgaagggcagggcctgcactgtggtcacttctgtgtccccagtatctcacccaggtcttggcctacaatagctgtttactgaataaataaaaacaacagggccaggtgtggcggctcatgcctgtaatcccagcactttgggaggcagaggcgggtggatcgcccgaggtcaggagttcaagaccagcctggccaacatggtgaagccccgtctctactaaaaattcaaaaattagccaggcatggtggcgcatgcctgtaatcccagctactcaggaggctgaggcaagagaatcattgaacccggtaaacggaggctgcagtgagccaagatcacacaccactgcactccagcctgggcaaatagttagactctgtctcaaaaaaaacaaaaaacaaacaaacaaacaaacagaatcaggccgggtacagtggctcagtctgtaatcccagcccttcgggaggccaaggtgggtggatcacctaaggccaggagttcaagaccagcctggccaatatggtgaaaccccatctctactaaaaatacaaaaattagccgggcatggtgggcgtctataatcacagctactcgggaggctgagacaggagaattgcttgaagccgggaggcggaggttgtggtaagctgagatcacaccactgcactccagcctgggcaacagagtgagaccccgtctcgaaaaacaaaacagaacaaaacaaaacaaaaacaatggcaccagatcacaatggccaaaaagatcgagagaggaatcaacagaaccacgttgaatcgaggggggatttaaggagatcagagccacgaggttaaccatgtggagccacagaaatacaacgtcaccaaccagattcccacctcggccactttctctcggttttccaaaaagaagctctaccacacggtcagccaaacacatggcagacggggtcctcgagcccgtcagggtggagctcagagcggtcatgtacaccgccacagccgacaggcctgggccactcgcccatccacagtggggcagcttctggaaaggaggagctgctttgtgagttggtgttggtttcaaatgtcagctctgccagcagcaaaggaattggctctgaagtcagggaaagagggtctctacaaagcaacagccatttccaggttgacatgcagataggagcaaaccagcacagaggtgacagagaggatggatggagagagcacgccagggcccaggatgggtgacttgtggggacagtgactgcacaggggccgtggaataactgagggcttggggggctgcacgttctactgctgcaagcaggagccacggggacaaggaatggagtgggtgaggcagcactgcctgagtaaaggcaccagggacctccagttaccccagggaggaaccacagctgggtctctaaacccatgggttttctcatctagagccagaagataaaaatcccaaggctaggccaggcacggtggctcacgcctgtaatcccagcactttgggaggccgaggcaggcggaccacttgaggtcaggagtttgagaccagcctggccaacatggtgaaaccccatctctactacaaatacaaaaaaatttagccaggcttggtggcaggtacccgtaaccccaactactttggaggctgaggcaggagaatcgcttgaacccaggaggcagaggttgcagtgagccgagattgtgccactgcactccagcctgggccacagagtgagactctgtctccaaacacacaaacaaacaaacaaaagtcttaaattgattagagatctggtcacccctttaaccacatagggaagaggcaaggtcagggtagaggcaagggtatctgtccttcccatcttttaccctggagcgactacacacaggggcagggaccttgcacgtaggccaacagccttctcgtcttaaacaaatccctgccgatggggccaccaggccctctgcccggccgcctgcctccaggccgtcccgtccagcaacagaggcgcctggggccggggaggtgagcggcttctccttctgcttgtggagcaatttgagagtctccctcctgctggagggaaggaagcccttggtgagcccagaagctctgttgacagtaaacagcccacatgcacccagcagatgcccaaacagacacacccaggctgttcctctccctctggtcccacctgggccaccgtgggtcaggagagagacaaacagattaagcacccaggaagtgccaaggcgtggggtggccctctgctcccagcctggagcttgaccccgggccagcctgctctgctcacccccggccaggctgctctgctcctcacctgcacctgtttattaaacagatgcctcctctggggtggccagaagtggcccagcccagcctggccagagaaggtgaactgagaagacaggcaagagttggtgtggccagtgagtgccaagaacaggaacagggctgcttaggaggagacccagggccagggaggacgtacaccgttcagccccactcacagaagacgcacaagatctttacagaggaatcagggagaaaagagggtgctgtggccccccaggctcccctgaggcaaagaggagcctccccacaccccggggagacaaagggaggggggcctccaagatgatgcttgagggggccaagaagtacctggcttgaggtcccctctaaattcctgagctgcccccttccctgactagtcgctttccgagccccccctccagggtgcgggcccctggacagcccaccgatggcccctgcccaggatctcccgtctctcaaatccttagtctatccggcaacaggaagcagcatctcagtcctcagtccggcaggggagatgtaggtgagaggtcggctcagacacagagcaaacaacaggcaggagggcacggacaggcagaggccgtcctgggctgaccagggcctggcccctgagcagtggtcccagcagcggctgccgtgtgtgcaatgaaagtgtgtgccagctgccatgctcaacgggtgtgcccacgcccaccccatattccccacgaggatactgtcagagtgtccccgagggatgctcagagcaggtaagtcacttgcagaaggtctcatgggggtccctggggaagctgggcttgactccaggctgtcagaccccaaagctcccgctcttaccactcggtctgtgccgatgctggcctacctgggctagaggctcatatcccagagagaaaatgctgagagaacagagccgggaaaaggctgcccatgtgccggcaacaccaggaggccctgaatatcgcttggtgggaatgggactaagactctcccacgaggtccctgagagccagcctaagctggacaggaccttcatggacaccagaagccaggggtggccagtggatgtctgtgagggaaatgaggtcacgaaccaagaaggagggaggctggggcggtgggaagagccaaggccaccagctcttctctgagacgcatcctgaggctgccggccccagcctttaaaccttcttacccattgctatggaatttttaaaattccaaataaactgggggaaaagtttaaaagtcatatttatagcaataaaagtgaaaggctggatttaagaaagctatccggctgggcgcggtggctcacgcctgtaatcccagcattgtgggaggccgaggcgggtggatcacgaggtcaggagatcaagaccatcgtggctaacacggtgaaaccccgtctctactaaaaatacaaaaaaatttagccaggcgtggtggcgggcgcctgcagtcccagctactggggaggctgaggcaggagaatggcgtgaacccgggaggcggaggttgcggtgagccgagatcgcgccactgcactccagcctgggcgacagagcaagactctgtctcaaaaaaaaaaaaactatccacacttgcctgtgggtgtgaggagagactctaaaaagagaggcccttgagctgggcgcagtggctcacgcctgtaatcccagcactttgggaggccaaggctggtagatcacctgaggtcaggagtttgagaccagcctggccaacatggtgaaaccctgtctctactaaaaatacaaaaattagccgggtgtggtggtgggcacctgtaatcccagctatttgggaggctgaggcaggagaatcactttaacccgggagatggagtttgcggtgagctgagatcatgccattgtactccagcctgggcgacagagtgaaactccatctcaaaaaaataaaataaaataaaatacaaatacaaatacaaaaaattagccgggtatggtggcaggcgcctgtaatcccagctacttgggaggctgaggcaggaaaatcgctttaacccgagaggcagaggttacagtgagccgagactgcgccactgcactccagcctgggcgacaagagtgaaactccgttccctcctccccatcccccaagaaaagaggtcctcgaggcagcagagaaatctcctgtccacatctgcagcttcactcagcccgtggggatcaagcctgggcctgcttccccaaggtgggcggcagcccctctgcccttgcagcgatctctgtgccagggcgagctcgcagggacctctgtgccagggtgagaggctctctcccaccaccacaggtggagaaactgcagaggtcaagagcatacaactggggtcggccttcatgcccatggtcagactgtgggtgacttcctcaggcagaggccgtgatgacttctggtttctatgccacccaaacataccagcatgtggcaagccctcagcaattcacacaagcctctaacaggggaattggatggtcgccctcctctatctccctggcttcctcctgtcttgggaataaaattcagtttccccgaatggcctcccagtccctgcagcccccgccccttcccacttctctcctctcctccagggtgtaccctcctctcctccaggctgtaccctcctctcctccagggcgtaccctcctctcctccagggcgtatcctcctctcctccaggctgtaccctcctctcctccaggctgtaccctcctctcctccaggctgtaccctcctctcctccaggctgtaccctcctctcctccaggctgtaccctcctctcctccagggtgtaccctcctctcctccaggctgtaccctcctctcctccagggtgtaccctcctctcctccagggtgtaccctcctctcctgaatcacccctcctcaacctccaggcttccacctgaaccgcagagaggccctcccacccagcaggagccacatctccgctgctgttctagctcctggcgccctgctttcttgggggcccgaccaccccctggaattatacgggttacacaggtatgcgtgtgatgacttgtttcctctgcacccagcacggcaccttcgtcaatgtttactgaatgtttaggttacaagaaagaggggattaacgatccacatgtaggcctggagcggtggctcacgcctataatcccagcaatgtgggagcccgaggtgggtggatcgactgagcccaggagttcaagaccagcctgggcaacatggtgaaacccctatctctacaaaacatttaaaaattaactgggtatggtggcttacacctgtagtcccagcactttgggaggctgaggctggtggatcacttgagcccaggagttttgagaccagcctgagcaacgtgatgaaaccctcatctctacaaaaaatttgaccgggcgtggtggctcacacctgtaatcccagtgctttgggaggccaaggcgggtggatcacctgaggtcaggagttcgagaccagccaggccaacatggtaaaaccacatctctactaaaaaatacaaaaattagccgggcgtggtggtgggcacctgtaatcccaaaaacaaaaacaaaaaactaactgggtttgatggctcatgcttgcaggcccagcactttggaaggctgaggcaggaggatcgcttgagcccaggagtttgagaccagcctaggcaacatggcgagaccctgtctctacaaaaaatacaaaaattagctgagtatggtggcgcacacttgtagtcccagctactgctactcgggaggctgaggcgggaggattgcttgagcccaggagtcaaggccgcagtgagctgtgattgcaacactacattccagactgggcaacagagcgagaccctgtctcaaataaaaaaaaaccatccacaggtagccgcagccccccaggctgaccctgaccctgttgaagcgggggccactggacaacagagaaaacgaagaaagagctcaggagtgggccgtcacgttgccatcccagaggccaagaggacacagctccaggaagccccgtgcttctcgggctgagaacccaactggtctcctgccctcaccagggggacgagggaggcatccagcagccaacacctggaggacgttgtgcaaaacccattgccaacttcccgcacccaggtccccaaacccagcctgccacgtctcccagcaggcaaggaagaacaaactgcggggcagccgagaaatgagctgtttccttccttctgccacctcaccaggctggaacccaacacggtgtctgtggcgagattctggctggagtcgtaagaaagagttctaagaacctttcaacaggttcaggcaaattttctttagagaacaaactaaagcatcgtcctagagtgacacgaagctgacaaatttgcatctcaatcagccggacactgctcaggctttcacaagtctaattcaataaattcaaaaatggcctatctgcttctctgcaattcagccatgcaccaagtttgaaaatgttagactgaagcagaaaccttcaccctaacttcgccaggcactcccagacgagccaaatgcggggatttctggcctgaaagaaaactggtgatgcagactccaagaatcaaggagcagtgtgaccagagagataagctgtgtggaatcagcagccttcccgcccagaacgtgggctcagcatgtttgccagataataagaaaaaccaaaattggaggcaggagcaaaagttcgggataagaagttgatgttcaacccacaatcctgacccttcaccttcactttggtttagtggagttacctgtcaagtctgcccagggcttaaaacaccaactcagcactgcgctggcacaatctctgggactcctcccacttagacagaggaggaagctgaggttgaggcaggaatgaaaggaccagacccaattctgccaaaaccatacaatcaattaaatccgtggacattctattaaaaaaaaacaaaaaacaaaaaacaaacaaaaaacacctagaatctgaccttccgacatcatggtgggttaaaaaaaaaacacacaaaaaaacacctgcccacaacagttctctggtctgggtgagacactaaaagctttctctggggacgatgactttttttctgctttttttttttttttttaaaccctgtgtccagcctgaaagagcccaccagggaggcaagcaggaagggtcacgatctctaaggggggagagaggaaaggagaggaagaagtaaacactccaacctgtgcctttcggggacaggcattaatctcctaacaactcttggccaaagcagaaagcttgttcagggaacaaggtctgactcttcccaactcccaagatttcttgctgatgtggggaaagacctgccaagaacccttaggctattaggaaatatttttgagtggctaaaggctaaaggttagttataaatgatatactttctgtcctctccccgcggcctctgcattctcctgctttctcctgccctgaacctctccagctaagcctccctccctagagactgggacacacaggaatctccggggcagatcagagaagggaaacagggaggcttccacaaaggattacacccagcatgagctggtccaaagctttctcttcctgcaaagagctctagaaagaaaaggcctgctgctggggattcaggaagtcaaacctgggctacctccatctaagggcactctagcactggcgacagggattatgtgagctcagctattatgcagctaccgttgggatcaaggagaaggcagagggaaaatttcctgtcaaggttgcctaagaaggagggtaggaggctagaggctgggggctgctgtggccctcctgtggggctgaatttactgccctgtagtcatcaggaccctccaacagggtatgaaggtgtgaaggtaagtgtgtgttgggtggtgcagatgtcatgtagagaagcatcctcagcctgccttcagcaattccagtgacaaggcaaagaggagagaacaaccctagcatcatttccataaacgttcctttcttctcttccccttcatccccatggggttggaaagccacggagatgtcctcagagcccgtgggggaaatgtcctttggagaatcataaggcagcaaaaatagacaagaaattgtgtccagcaagcacttaggagactccacaatggcctgaggaacgtctagattctagatgagccctccctggggtggaggcaaggccacttcctctcctgctgcaccccagccccttaatctggagttcctctttctcacaagcagacagcaacatgtttactaccagccaagctatgttccagggctgggaggagaggagagcagtccagcactgttcgtagcgggtggaaggaacaccctggacagcaggtggggttctgggtggatggcaggcccaggctctgcggccttgcgcaagacagatcgctctgagcctcgatgtcttcgtccacaaaacaggggcaatgacaagtacccggcagggctgggtgaggatcagatgggccttctgataccctagaggcactgggcaatgcggtgctgtggctcgctaggtcttcgcccccatcccgccccctcccaaagccccagctccaggagccccccgcaaccccaggcgcttgtctcacctggctcggtacacaggtaggagtaaaagccctctgacttgagcatgatgagcagcgagccccagcccaggaggactgccgagaagaggaggttctccagcacggccgtgcaggccatccaccagcggcgccgatgggcagtggccagggtgggcgccatggtgcggcgcggcgcggctccggctccggctccggctctgcaccacctgcgcacagaactcggcgtcagcggccggcccttgcccagcccctgcggccgcccccagcagccccgaccgctgccgcagggctcgggattgccacccctccccggccgcggcggccggtgcgcgcagcagaggaagcgaaccccagccctgcccggacctgggacaccccgagcccgcggccggctcgtaccgctgccctccgctacgacagagccgccccggccaggcagggagacgtctcccgcagctcactccgaggtaaactgaggcatggaggcaagaaggggctaacgcatgctcagggccgtggaactagtcctggcctgcagcaggactgacatcgcctggggccagcatggaacgcagcgtgaggtgggcaggggcagatccgagggctgcctctcccagggaccctgacaggtgccctcccgcccgcgcccgagacccttccccagagctggtttcttcaaccacaagatcagcgcccagacctacggaacggcccgccccggcgcgctcattggccggacggcgcaggaactgccgcgccattggccgccgtctaggtcgctaggcgctgcggccacgcgaacccagcgtgggagacgaggagccggttcaaaccggtggcgcgagccagccgcgcgacccccatctcgggcgttcccccggcaactcgcccgtttccatggcctcggacccccgcgcctccattccccagcccgcatctgttcgtcatctcttccctggcggcccctcatcgctccatctctctcctcgttcccacgttttctccctacgccccttcggcggccgcttctgcccccgcgccctcgccccggccgcgatcccctccctgctgcagctcacccggctcctccggcgtgtgtcgggcccgcccggcgccttttct

SEQ ID NO: 561 - DNA, 31914 bp, Homo sapiens
ggggctgtctgggctcggggcgcggcggcagtcagctctatgttcgcggtcttaacctctcctctggccgagtccttgcaagaagtgaattacccgaccctggtgagtagctgcaggagtcagacctcttggaggcggcggcgccagcagcggcggcaggcacgaggtccaccgcgggcgcctgcgcgctcgcccgccagccaatctggtggccgctttcctccgggcgccctttgacccggcgcccctctggcaggcgctggtggcgcccagcggcgagcctgtagccccctcgattaacctaggctgtcactcttaggcctgttttagtctgcgttagttttactgccttttacactgctttatccccacctcactggcctcgtcgccgcctcctctttgaaacggtacctcctgtcgcctcggattttccttgtctccccgacaaggtggaaatttcgggtcggatggaagcctttttcagcaccttctccttgtgcccccagactgcctctgggccttgagccgaccgggagagtagaaggatcgaggcctgctgggctctgggtgcaacggaaaggtagctgtcgcctctgggcatcgggaggagaccgcccgatggcgaggccgctagagatggtttttcagttcacctgttaacgtgtttggcactgtcatcttagactcttagcctttgctaagtcgggatgcaacagtgctggattagtgtttttgttgttcctttttccaaagaagcaacttgaagtacaggcaggtataactgtttggttttgttgttgtaagaccctacggataagtgttaggagaaaatgtggaagtgctataaaacaacaacaagggggggataatgttgattaagaacttgaaaataagaaaaatgggactggaataggctgttcacgttaaagtattgaggcagtagtttgaaacaaaaatataaagtaaaacctagatattggtgatactgtatcacgttgtttgcaaatcactttcatgacaatacatctatttcaggtgtatcacacctgaaaaaaacatgagtgctgtgaatttgtggattttcaggctcaatgcagaaaaacaccccccaaaacaaaaaatcacaacaatgaaaacaccatttccagagctgttgctgttattcgtgtgacgaatagtgaatgtatgatcataaaatagaataagctgtctttagatgaagtttgggcacagtttatggagtaggtaacagttaatcattgtttattaggtacataatccttaattgaaaacataaccatatagcagcagctttcatcttgtgtcacaaaaataactggtgtatcctctaaatttgatttgtctaataccttaaaggaaggcagaatagcatggacaagaacttgagttcttgagccagactcgatctgctccttgctaggtgattaaccttagattggtttcttggccatttgctggcccagagatttttgaaaaagttaccaactgctcagcttcatcatttgtaaaatgaggttaaaaaaaattctgcggcctggcgcggtgcctcacgcctgtaatcccagcactttgggaggccgaagtgggtggatcatgaggtcaagagatcgagaccatcctggccaaccaacatggtgaaaccctgtctctactaaaaatacaaaaattagctgggcgtcgtagcgtgcgcctgtagtcccagctactctggaggctgaggcaggagaatcgcttgaacccgggaggtggaggttgtagtgagccaagatggcgccactgcacttcagcatggcaacagagtgagactccatctcaaaaacaaaacaaaacaaaacaaaaaacagaaactaaacctcactgaatttctgttaaccagagggtacaagtgtttacaataaaactgacctgggcaaggattgattttgaaactgattttgaaagttccagatgtgtcttctagtattgagttatatttatctccggtggcttcatacaaaataaaattagaagaaaacaatatattttttaaaaaaagcaccagaagtctgtgtgatttaatttagttaattgaaagggaagtctttttggcttttgtgagttacatgataaaagcaaataatttttgaagtactaattcataccaccctgcttctgaatctcttggggtctcttagctagctggatatgtccaataattttttattagacatcactaagcttcaagtcagcatttcaaaggattaaaagcacaaaactcaaaaaatagaagctacaggttcaaaagaacctattgtgtatgagtaatgtaaacagtcttttgaggagaaaacagattttcagtagccaatactttgagtaggtccctgccttggaaagatatatctgcaataaacttgtaatattttctctatggtgacttataatacttttcttttattgaagctaaattagttcctccacccctttcctgcaagatcagacattttaggcatctcaagggtcattgtggttttacagcgttgaagatgattttttttattaaattggatttttaaaattattggatctttacgattctttataatatgttcagtatacaccgtaaacttatcaagtgtgtatacggtcagtagtctatatatacacacacacacagatatacatatatatatatacacacacactgcctgaataccaatgaaacagcaaagagccagaaattaacttttttaaagctgaacacttaatgaacactatgtgaaagatatgttatgctctactagaatgtgaagataaagactccatttctgaaacttaaggagcaatctagtaggtgatataaagataaatgcacagcatgatataatacataaggaatgacaatttggccgggcacggtggctcacacctgtaatcccagcactttgggaggcagaggcgggtggatcacgaggtcaggagatcgagaccatcctggctaacacggtgaaaccccatctctactaaaaatacaaaaaattagccaggcgtggtggcaggcacctgtagtcccagctactcgggaggctgaagcaggagaatggcatgaaccctggaggcggagcttgcagtgagcggagatagtgccactgcactccagcctgggcaacagagtgagacgccgtctcaaaaaaaaaaaaaaaaaagaaatgacaatttaaaaagtaaatactgttaacaataaaatatatgaggaataagtacttttcactgtggaattaggagaggtatcaagaagaggcagcatttcaactttgacttgaaggtgactggtatttcaatagttggtcatatagagaataggcatttagaataaaatgtgttatattttaattgcttgtcggacacccatctttaatcatcatcataaacaattgctcatttatttagtcttatactaagccacatgattttgagagttttacaatattaactaatttcatcctcacaaaaatcctatgagtgaagtaataactcattctatgggtgaggaaaggaactcagaaagatcaggtcagttttgtaggtcagataactaaaaaatggcacagctggaatttgagctcaagcatttgaactacagagctcatattttaaatctcaatgcccatctgtgtttatttaggttgagatgacttaattgagacatggaggttgagccagagccagcagatcatctcttaaaattgagcttgtgtgtcatctataatgatgtgataaacacacattttaattgaatgaatgaagtaatgtaaaatgagaagacagaggatcagcttaagaaattacattcataggcaagagagagagaaaaaaaaacagcttccataaatggacattttgtgctttgtattcatgagtgtatccagaaaatgaacctaagaaattttttagagtttccaatatttcttcacttttcatttatttataaattcattagtatttactgtttgattaaaacattactgtttcaaattgtcttgcatgattcacagaatagttttatcagtaggcaaaacagataccctcttttttaagaaaaggctaagtgatttacccaggatcacacaactaagtgtgactgatttgaatttacatcttaagatttattatatatcttgatctttcatgaatctcgccattcagctgaagtcaacgtttcaaaaatgaatgccttactaatttataaatctgttagttatttctcctttctctgtaactcttccaacattcattaccattgtttttttccttatagaatacctatccaaatgttttccttctgaagtattatgttctacttttagaaaacagagtaagaaaatatcactgttgtctcatccagacataactattttacatgtttaagtatatttccttctatgtgtatctttaatacagatatgatattatatatcatagtagttgatatattacatccaaaatattatttttgcttcatgtctcatcaaaattttccctttcttcaatcaaagggaaatgtttgttgtgatgtcaatgatttgaaaatttcaggacaacaaattacagtggcatgccaaaatggttgtatcatcttttttttttttttttttttttttttttgagacggagtcttgctctgtcgccgaggctggagtgcagtggcgcgatctctgctcactacaagctctgcctcccaggttcacaccattctcctgcctcagcctcccgagtagctgggactacaggtgcccaccaccatgcctggctaattttttgtatttttagtagagatggagtttcaccgtgttaggcaggatggtcttgatctcctgacctcgtgatctgcctgcctcagcctcccaaagtgctgggattacaggcgtgagccaccacgcccagcccatccttttatacctgttagtgcaacaggactgccacagctcacatgtagaaatttcacttcacagagtcatgtagtgcagggtttgaaagactttgtgacttagccctttccagaaataagcaggtatgttaacagctcacattcttctatttactgctgggataaatagcacaaacaatttctgtttacttttcctgcatattcaccatatggtaatattttaccatatttgcttaccattatacacaaacacacatacccttacttattatacgttgcattgtatgtaagccatacattttatatatagtgtatgtatgtggtgtacatatatgtatgaatatgtgtgtatttatgtatatgtgtgtatcctctctttaatatattgtctcatggttcctcgtgattagatctggattaatttttaacaagagtaccacagcagtgattctgtgtttttctcagtacgggttcgctgaagactaatggccatacttatttatccaaattaactgataaagtcaattttgatcactagtttaaattggtgttttggtaggttttccactgttattatttccccatttgtaattaattagatatcttctggaggaacattttgtcagtatgtatatagttattaaaacaaaatctccagacctgtctacctattcctttactaaaagttcatttacatagctttttattagagagggagggaactgatgtgatggaatgcagggatgggtaagagttaggataccaggtaaagtgtcagaaaagatttagtaattaatattgtttcccaagagttttataaatttaaatacatttaattatgtatatataatcatacatatttatatctaaatatatatgacatgtatccatatataacataagatgcacaatatgtaaatacacatatatgtgcatgtatgtgtacatatgcacatacacacgtttatgtatgtacctgcatgccttgatatatttacagtatgcatatcgtatatacagtatacatatatacatatatgacgtatatatgtacacacaccatatttacttaaagtttgaaacagacaaaatacagttaactttagttagatatgcttgtgtgcggtgggaaaactataaagaaagaagaggtgaaatggtaaacacaaaattcaagcagttgcccttaggcagggagaagggcaggactggtgattcagagggagcacgagaagtggaaaggagcttttaagctggcagatttctttttgaatgtttactttatatgttttaaactagacatgtcttttatactattcttttatgttattctttatattattcactattcacaattaaacaagattaaccttaaaaataattcttatgattttagctgttaaagaaatatacttggttagtttagtgtttcttaaatacatgtagaatagtgttgtgggaagtcagggaccccgaacggagggactgactggagctgcagcagaggaacataaattgtgaagatttcatggacatttatcacttccctaagaatactcttataatttcttatgcctgtcttactttaatctcttaatcctcttatcttcgtaaactgaggatgtacgtcacctcaggaccactataattgtgttaactgtacaaattgattgtaaaacgtgtgtttgaacaatatgaaatcagtgcaccttgaaaaagaacagagtaacagcgatttttaagacagcgataaagtctgactgcctgtggggtcgggcaaaaagagccatatttttcttcttgcagagagcctataaatggacgtgcaagtaggagaggtatcactaaattcttttcctagcaaggaacattaatattaagaccctaggaaaagaattgcattcctcgggggaggtctataagcggccgctctgggagtgtctgtcctatgcggttgagataaggactgagatacgccctggtctcctccagtaccccaccctggtgaatttgaggtcagactggttctctgctctcgaaccctgttttctgttgtttaagatgtttatcaagacagtaggtgcacagctgaacatagacccttaccagtagttctgttttgccttttctcctgtttccccagaagcatgtgatctttgttctcctttttgccctttgaagtatgtgatcttgtgagttactccctgttcttggaccccctccccttttgaaattcttaataaaatttgctggttttgtggctcaggtgggcatcatggtcctaccgatatgtgatgtcacccccggtggcccaactgtaaaattcctctctttgtactctctctcttatttctcagactggttgacatttatggaaaatagaaagaacctacgttgaaatattggggatgggttcccccgatagaatagaagcagcagtttgtaggaagtttcacttgtctttcttttctattggagttaagtcttttttaacttaattctctataataacagcaccgtatcatagaactcattttataaagcagtcaatgtcagcattgtgccaaatacctttctaataagaaatctgtatataaaaagacttgaatatttcattcatatggtgtatatgtacctatatacttatactcatatatatatatatatacacacacaacaataatgtcttttcttaatcagccaagaagcactgcattaatatatgtccataaacatacttactaaaacaaaaacacatataataccctttcagaagttataaattactgtttataacctctgttcagtaagattttcagagtcgtaagttaattttatttttggagacgttttcttgcactgtcacccaggctggagtgcagtggcacaatcatggctcactgcagccttgaccttctgggctcaagcaatccacctgcctcagcctcatgagtagctggggaactacaggcacacaccaccatgcctagccaattttttaaaagtttgtgtagggatggggtctccccgtggttgtccaggctggtctcaaactgctgaactcaagtgatcttcctgcctcagccttccaaagtgctgggattacaggcatgagccatcatgcccagcctaatgaattttttgaaaaaattgggaatatcttacttgtgattattctttttttctctactgtcatttaaaaaattttgtctgattctatttcacttcaaaatgttatttaaaatttgtaatttttcccttttatgaaattgttagttaaaaattttttagaaaatctgtttaatgactgggtttttcatacactagtaagtatttcctttttattaactgtgatttgtaaattttacacttagatttagaaaattttagttcaggccaggtgtgtggtgactcatacctgtaatcctagcaatgtgggaggctgagacaggaggatcgcttgagcccaagagttcaagaccagcctggtcaacatagtgagaccttgtctctacaataaataaataaatgatttttaaacagaattttagttcacatacatagaatgttcccttcctacattcagcatacatgtaatctgttcaagtaatgaaaaacatattttaatttcttaaataaaatttcctaaaggttcgtctgactaaacgtaattggcatgtacatggtgatatatccaaatgaatattgccgtttattctagccatagacccttattgtacacatttatatatgatgatataattaatgtcttcactttcttaatttcaccaatatgtgatgaaatcagtattaattattcaatgtaatgaaatttatggattttagttttcgtgttgaatatattggaaaatactgttgataacacttactaattatcttttttcaataaattgcagcaaaacacttactattttggagtttaaagtatgtcatcatggcaaagtttcggagaaggacttgcatcattttggcactttttattctatttattttctctctgatgatgggtttaaaaatgctgagaccaaatacagctacttttggagctccttttggacttgaccttcttccagaacttcatcaacgaactattcatttggggaaaaattttgatttccaaaagagtgacagaatcaacagtgaaacaaataccaagaatttaaaaagtgttgaaatcactatgaaaccttccaaagcctctgaacttaacttggatgaactaccacctctgaacaattatctacatgtattttattacagttggtatggaaatccacaatttgatggtaaatatatacattggaatcatccagtgttagagcattgggaccctagaatagccaagaattatccacaagggagacacaaccctccagatgacattggctccagcttttatcctgaattgggaagttacagttctcgggatccttctgtcatagaaactcacatgagacaaatgcgctcagcttcaattggtaattattgtatatatatatatgtgtgtttgtgtctgtatatatgcatataaatgattttttgtgtaactttactagttaattttctcattattattaattatattgttaagctcatacctccaaattaaactgtatgtatgatcttaaacatccaggcaaccacattttaacactgcccttagtgtatattgtttaatttttacattttggagcatttctggatatattgttgatttctaatttaattcactttctcaattttattaaattatgatttacataaaatacaatgaatttcccactttaagtttatagctcattgatgttactcaaaagtatatacctgtttgaataccaccccaatcaagaagtaaaatatttctatagcccaaaaagtctcatcataattcctttattcaggcctaccttctcccctaccgctgaaaactgtatacatatcagctggatctgatttctatcagatctgatttctatcactggagaatagttgtgagtgttctattactttatgaaaatagagtcattcagcatttgtatgtgtgtatgtcttttgctcagcacaatattttgaactgcacttaactatatcaatagcttagtcatttttattgatgagaagtctcctattgtttgattttggcaaatttgcttttatattcacctgttgataggtgtttgggctttttcaaattttaggcatgtagcatgtaatttagtcctgcttttctgtttcttaaagttattctgtcagtcttaatgtctgtttatttcatttatgtttaatgtaataatgatatgattttaaatctgccatttttctgtttattttccatttgtcccacacgtctgtttctttttttccttctttttcttccttctcttacattacatatgcgtattattctgttttatattttcttctggcttatgttattcatttgttttatttataactgtacctttttacaatacgcccctttaacttaactgattcttattgttgttcccaccgcttctcacctttctcttctccttccttctggcactccaattacatatatttagatagagtcatattgtcccacaggtgaattacagaaaaaatataacttggtgcctgaaaattcttcagtttgttaatatagtctttgtaaaaccttccagtttcagtttcatttatctttttagtgcccctaccagtagagctagaacaagaaattgggtattcttacatttttccagctctacataaaggtatggattcaccatggagctgatatgtatttagagaaacacaagagtctttgatgaacaaaacaatgtagaattctatgaatctatatcagatatgtgcaagatgagttgttttccttgtatggactaacttttttcaagtatttataaaatttaactttatagtatagttagagatttagtttctatgttctgtatgtattatgacataaaatagcttgggtcagttaagacagcattgacttctgtgtggtcaatatgtatgtgtgtgtgtctgtctctactaatttgcttttgggaggagaatcttttcaaatgatattttttctattgtttacaaaaaatttgtgtcacatttaagtctttattcaagactgtcttgatatggctaaaaaaactatgctagattgacagaggaaatggttgttctttaaagttttaattttcatttgcaatttgaatagtatacaatgagggttttttcccctccattataaatataactaatattaatacatatttgtaatacataaacatatataaataatatatgtggtaaatataaattttaaatagaaatatatgtgttacactatttttggtatagtttgtgatcaggaagaaaagtttcagtaaacatttttatgcctattcatatttataaagacctttttccctgtataatattttagtattgtatcatgtatatgaacattaattatttctaaacattgacagtaatacagtcatttcaattttaaatgttgacagcttcactacggatgcaaatattttactttttgatggattttctcctagacaaaattaaaaaataaacttgataataaaagtgacataatcaatttataaataaagaaataatttcttaatgagttaaatattgaattatactcattgttaccaggcagaaaataatttgactgttggaatactgactcaaaaccctaatttaatccatggagctggcatgctgactcaggcattctttggattgaagaagatagtaaatgaaggctgtttaaattgttgtatggttgactgtgctttgactacatatttaacattcatatttttcctttgatataaatggccttctttttatcttaagttgaattgctgtgtgaagtaattatgctgttatatcgcagagtacaagttggttgattttctgcttttacaattaagtgtggttggcataaatcctaatggctcaacccttcattgaaaagaatgataaaattaaaatgaactattaatgttatgtttaaaatccaattattatatataatgtatcagatatattacaatggcatatggtagatttgtatccttttcaagtcttttaagtaaaatattacgtatcatgtattctatcctcttgtattgctgtattacaactctaaaagtaacagatgaatgccttcttttttttatacagtttactaaaactttagtagactggtcagaaaatagcccccattttctgatgtggacatcgtaattcccacaatctgtgaatatattattttatttggcaaaaggggaattagggttgcaggtgcaaaagattgctaatcatctgaacttgagatggcattatccttcattatttgggtacagctaatctagtcacataagtccttataaatagaagaagagggaaaagagagtcagagggatgcacgagagactcgaccccctgttgctatctttgaagatggaacaagaagttcatgagccaaagaatgtggtagcctctacaagcttgaatggcaaggaaagggattctttcctagagcctccagaaaggaatgtcatccagtccaatacctggccttgatcttagcatattaagacccatgtcaacactcctgacatgcaaaactgtaaggtaataaatttacgttgttttaagcaactaaatttgtgatagtttgttatggcaaaatagagaactgctacatttagcaaaacataatgtactctatgactttaaaattatcttcccattgtttcagtttagcactaaatatttattgattttccatgacgttccaagcttgtgctagattctagggacataaaaatgagcaagtcacatttcccagttcctttgttttcatcattgttgctttaaaaacactggatggatttcaacattagaatatttcctgaaagtatgacatatttgttttagtaaggttacaattcttacttctgcatctcctgcctttaaaaatttatacataaaagtagaagtcacaatgagatgaattagacacataaagtttaaatgtacctaataacatctaatatgatgtcataaaatttccttttataataactatttgcattaagtttaaaggttatatttataactgtagagtggtgatattccataaagctttcatattgctatagatgcccaacctttggctacaaaaaaaatttgaaagtattcattgcaaggagacagtctacttgcaaataatatatacttaatgtgtaatgtaaggtcttcaccactgatattccctatgtttccctcccatagtttgctattgtcgtaattctgtcacataagaaatggtattttactatcattgctgtaggccagaggttggcaagcattttctgtaaaggactgcctaatatatatttttgattttgtgagtccctcactctctctctttgcaaccactcagctctatccttatagtgtgaaaatggttataagcaatagatagacaaatatatagatgaattggcctgtaaaaggcaagatttggccgatgggtcatagtttgctgatcactcttttcaataatcagttgtttttcacagtgattaaaagtaagaatgttttttacatttattccatttctactgttccccatccatattttaatgtagatccaagtgtatgtctaatatcatattctttctctcttaaaaatttcttttatcttgttttactggtctccttgcaatgaatattttcaaattttgtttgtagcctttattttgaaagatgtttcatcacctatggaattctcaatgggcaggttttaggggattgttttcttttggaattttgaaaatgtattccatttctttttttcttctttttcttcagtctttcatggtttctgatgagtagtctgccgtaatttaaaaaaatctttttatatcctcattttcttggatggatatgttttgttgttgctgttgttgttttctggctgcatttaatttttttctttttttcttttttctattttgttttttagcagtctaaacatggtatggttacttgttactcctgttattttttgttatttatccttcttggtgttctctgaatttttaatctgttgctttgtgtcttttattaattttgctaaattcttagtgattattgttattgttttatgagatggagtcccaccctgtcgcccaggctggagtgcagtggcctgatctcagctcactgtcactgcaacctctgcctcctgggttcaagcaattctcctgcctcaccctcccaagtagctgggactacagatgtgctccaccacgcgtagctaatttttgtacttttagtagagacaaggtttcaccatgttgtccagtatggtctcgatctcctgagctcgttatccacctgcctgggcctcccaaagtgctaggattacaggcgtcagccaccgtgtccagcctgattattttttcaaataaacctcctacttctgggtttccaattacatgtgtactagaactttgatatttatctcgcaactgttaaatgcattgttctattgttttccccagtcttttttctcattatggtaatttggataaggtaatttcttttgacttgccttgaagtttcctgattatctcctcagctctgttaatgagcctattaaaggcattaattcatctttttaagtagtctttcattcctggcatttctgttttatttgttcttatagttcccatatctctgctgaaatttgccagatcttgtgtgttagctactttgtccattagatcctttaagatattcattacagtaattttatattctctctctgatgattccaacgtatctcatttgtgagtctgtttctattgattgctttgtttcttgtcagtgaattgtttttcttgcttttttttctgtaccttgtaaaattttgttaaaagtatgtcaccctgggtaagatagtgaaaattgtgttacgtctagaaatgagcttgcctttttttctcttaaagctttagtttgaaagaatgtttgagatgttcaaaagaagctctaaatttcctatgaacacataacaagttttctggggctcaaggtatccaaatttatccatcattatactgtcttcttgttattaagtgttatttataatcactttttaggtgttttactctgcatgatgcattctctcatttgtgctttttaaaacaggccttatcctacattttacagatgtggaaacttaagtaaaataacttacctaaagatactcatctatcaaataacagaataagaactcgattctctaggcctatctgatttttataccctatattcttaactgttatcctatttgaatgcatcactttactaacaacaaaaaaaattgactatcaattatattgaaggtcctgtaataagtggcatggaggggtgacatgagcaacatgacatgagtttttgcatttagtttgctaatatttcaagaatggacttcaaagagcatcctagagtttgctaagcaattaggatgacagaaatacagagtaatagattttacttataagtgatactcagttggcttattttatagacacttctctggttactatcaaggattcactgccattgtaaattcccaacactcctcagaagtacgacaatcactggcgtggttcccaggctagtatttattcagtgccacagtccagaagacactgtataatgattaattgggctgtggatcacagtatagggatagaattagatatctggaagtcataattgatgcaataaagaagctgaaatataacaacattgtaagggagaagaaagaacattcctccaaagccatagagtatacttgcaaagaggataaaagaggaagagaaattactagaccaagaatgggatggttaatttattaggagaatcagaataatatggcagcgctatccagtagaattttctgtgatgatgaaaatattctctatctgtgctgcctaaaacagtagatacatagtcatatgtggctattgaacacttgaaacgtagctagttgagtgtgcaagaaaacttaattcttttaaattttaatttatatggtagatatgggtattattttggagagcataggactagaatgtaatcaagcttgaggaagagagtaaagaaatggtggaatggagatgatagtataaagatggaaaagactggctgggtgtggtggctcacgcctgtaatcccagcactttgggaggccgaggtgggaggatcaggagatcaggagatcaagaccatcctggccaacatggtgaaaccccatctctactaaaaatacaaaaattagccaggtgtggtggtgggtgcctgtaatcccagaggagggattctatctgtaatcgatagaatgaggcaggagaatcacttgaacctgggaggcggaggttgcagtgagctgagattgtgccactgcactccagcctggcaacagagcaagattccgtctcaaaaaaaaaaagcaaaagctcatgtgtgtgtacatgtgtatgtgcgtgctaggagaggggtatggttgaagagggagggaaaaatgtgagggaaaaaacagagaatgttgtagttaaaggaacgaatatttcttgaatactgtagtctagtaagtggaattttatgtgtgtacttaaaatatatcctgaaaggtaagaataatctgtgttttgatggtgaggccacagaagcaagaagttaacttgcccttagttcatgtagctgataagtggtgagatatttgaatacatgttcaaagcgcatgcatattctactatactgccctgcctctcacaaaaagaaatagaagagtggtagatgaattaggaaaagggcaaaagtaatgattttctgcatttttaaaggtaagtgctttttatcttttttaaactatgaaggtaatttttagaagtgtgtgtaatggcgatacctgaagttgttgcatgttgctgttgtcttgtttctgccaattcttgtgcatggtgttttattctttgtgttcttaattatctttgattgtatactatttattgttctttatgaaatactttttgtaaataatttgaggcccaggaagaagatgccttcctccagaaaggattttcttttgcttctgcctggtgactgtttagaataccatttctggttaccttaaattaggtctaaagctagaggattgtacaagcattgtgaacctgcagtttaattcactgcttttgagagttggtttacttgtaccaattttgcttggggcaaacagacctccttgctcacttatctttctggtttcacattttcccttcaatttggccaggacatttcttactctcttcagctctttaagacattttctccccgtgttttatataataataatggttattttcatggagagtgcttggtttactattagaccaactgttattttagactagtctgctattattagaaacaggaatcttgttttgtttttacttttatggaagaatgttttgcttataattttcatgtgattcatagcataatctttctgttgtttaatattttttcttattttgttcctttcattttctgcataaaataattttttcgtaggtcccatgttgagaaaactttttgttgtcattcttattttcattggtgatattcttcttataagctgggctagtaatcttacaagattgtaagtgatcgcttataaaatgttggattgtctccagacacttttctcaccagcatttctctctaggatatgccttcctctggctagccagtttccctaaagcctcatatgttataggttattttttctatgtttcgttctagttgccattcttattttcagagtggataggggacataaggattatttttccattaactttgattttgttgtcctagatgggacttacttatttgtacatggcggctagcacaaaacttaggtcttaaaatttagttctccagcagtttcttaccttcaatttcttaatttccatatgcttctcttttggtaccattattatttatttctctgccttaaagagtctgtttatttatctagaaatttgtgcaatctttctaatgactgtccatttctttgtatacgtaatgaggctttgaattaattcatcttaaatattccgtctccagttagtgattttcatgtaatttatgcttctaacacataatttatcagttcaaaaataagtaggcaggcactacagagaggaacagtaattattttactatgttagaatcttctgttaaaaggtattgatctacacaaaaacagcatataaatgtttatagcagttttactcataatgggcaaaaattggaagcaaccaagatgtccttcattaggtgaatgtataaaataaatacaatggcatattatgcagcagtaaaaagaaatgagctatcaagttatgaaaaggtatgaaggaacctaaaaattcaagttgctaaatgaatgaagccagttctaaaaagctacatactttgtaattccaactatatgaccttctggaaaaggcaaaattataggcagcaaaaagcttagttattggcaggggtgagggggagagggaacggggatgaatcagtatagcacaggaggtttatagagctggtaaaactagtttttcagctactctaatggagagcatatggtataatagatttgtcaaaacctgtcgaactgtacaacacaaagtgtcaaccctgatgtaaactatggactttagtgaataaaaatctttcaatattgggtcatcaattgtagcaaatgaaagatgttaattataggagaaaccgtgtggagggttggggcaggtaggaggaagagtatatgagaactccatattttctttgctatttttatgtaaacctaaaacttactctaaaatgtaaagtctgttcacttttacaaaagcttattaatgcctgataaagaggtcataaatattgacaaagtgatcaaatagccatatgtattctgaaggaacttaacaaaaccacctcgtataaatatgttcttctattgttaactctttggtacttactgtgcctttttaagaatatctgcattcatgttcttgtcttttccctttctttttggtcttttctattaggtgtactagccctctcttggtacccacctgatgtaaatgatgaaaatggagaacctactgataacttggtacccactattttggataaagctcataaatataacctaaaggtattttattttattttcaagctatacataagttaattcttttggacaagaggagagtaataacaatttttgaaatagtaattttaattaaaaatgataatgacttagaatcttttaaatactatatttcataaagaaaatttctataataggaatttcaatcttatctaaattatattttagagattctttactatgtttctaatgttttatttttttatagtagaaagggattgaaaggttcttttgtgaagataatatagtagtgaagatttatatgtctaaatatcttagatgtcaaaaatctaaaaacaagtattaaccatgtaactttgcatatttataaagtagttaaaaaataaacttgctcaaatatttttcaaaatccaattttcatttaaaccttatttaatgtgcatacacatacacacctgagtaaatatagaatacagcagaaagatcaagtatatttgatgcagaaattaatgtgtgttgcaaatgagggaacacttctgacagtcttaagattttatttcttttagaaattaatgaatcatggaaacaaataggagtgatgattaaaagtatttaaatagcactacaaaagaaaattttatactgaatagcaagtaaataagcactgtttttaatatccaaagatacattttaaaaattggtcatgtattaggtagcaacattaattctaataaattcataaaaattataaccatagagtctgcattctctgaccacattcagtaccatggaatgttaataattaagtccaaaccatttagaaagtataaaattattaaaattttaataacataattgagaataactctgaaatttaagtgatataaatagcactgagattattgcattatcaataccaatgggacctaaataataagacatagtagaagaaagaactatgatagatgaagtgtgaaattaattaaatagtatacaagtccttcaaaatcagtagtctggataaattaatctttactattgtccacttttggggaaaaaacaataggcaagccattggtgagattaaaaaagaaaagaaattgagaaaacatatcagcaaaaattgaaaagaaatatacctatagtttcagaagagagtttaagattttatatcagtctatttaaaatttatatggtagttttataggaaaatactaaaattaattttttttggtgcagaaagaggtttaaagaatctgaattgactatcctagaaaaaaacgtataaaagataattgaacaaatgtcttccccaaagtgtcaggtttacctctcagttgtattcagaatagttgatttttatgataactgaaatacagtgtcaagtatactcactatctattgctgcataacaaattattccaaaacttggtagcttaaaacaataaacatttgttacctcacacaatttctaagggtcaagcatctggaagtggcttatttgggagtgtctggttcagggtctctgaaggaggttacaggcaagctattggctggtgctgtagtcatctgaggctagaggatccactaacagactttctcatgtggtggatgacagacctcagttctttgcagcaggtgaactggagactctgtacttctatatatgggcctccagcttcactagagtgaaagatctgagagagagtctaatataggggctacagggttgtttttgtttgttttgttttttgacataaatcttggcaatgacgtgttaatacttctgtcccattctgttgttttatctacggataaaacaaccatggcacaatgtgggagggaactgcaaagttatgaataccaggagatgggtatcggggggccatcttgaagaatggcaaccacagaaaacttccaaatttattccacaatagcacaatttttatttaaaactaagaaaggatagaacaagaaagagacagactaatcttaccaatgaaaatagattcaaaattcctagagggaattttgagaagaagtgtttattagcaaggatttaagaatggttccaatcatatgaaatctgaatctaaattcaggtctgcattcaatcctggctcaaccaccttgtagctttataaatgacttgtgtctcagcttcttcatctctaaaatagaaatagcaacaaaaccttccttacacacagaatggttataaagattatattagataatatatgtaaaacatagattgctgtctggcacagagtaagcactaagtaaataaaacttcattgattatttaaagaaggtaaaacatggttatcttaagagatactgaaaattttaggaaataaaaattcattgttaatgaagtccttagtaaccaaagttctttagcttgataaagggtgtctcttagtatcttatttcaaacactatatctgatggatatactacacctgtagtcccagctactactcaggaggctgaggcatgagaattgcttgaacctgggaggcagagattgcagtgagctgagattggtgccactgcactccagcctgggcgacagagtgagagtctatctcaaaaaaaaaaaaaaaagtgatgtaggttcttttaactagagaccactctgagattgcaaccactcttaaaatttgctgaagctttttatttgctctgtaacttcttgcagttatattctaatggaggacaatctggtttgtccaatactggtaattgagccctgtaagatatgttatggaccactgttgaaatatttcgtttcaaataaaaatgtgaaacattagttttgtcttaattttccttttgcagcctagagattgagtagttattggagaatagaaatggaactgtagggagtgagaaagagctaaataggcaagcatttttttatttctgtccataaagctgcctcttctttctgatttactatcctgaaactgttaagacagcatctctcaaattagctgtctagcaagagctgtcacctgccatgtcccttggtgcctttcagtgagttcttattggcatttgaaatctgcaaataggcaagcctccaggttctggtgcccaggctgaggttgggtaagtgattgatttatcttccacaaaacaagcccaagagctgcttttctgtccaggccctgccaaaatcctggaagatggaagctcaagaaactggctattttagtactttcaggaagttttgaaagagaaaatgaaaatgttatgatatatgaggattggttggctttttctcctgtttaaagtgtctgtgtagagaaggagagtgtggcaaagagctcgaccactaattgcctatttaatgttgccagcatacttgatctctctgtgctagggattttatatctaatgatcagaaaaacttggaacacgatagactaatgttttccaaaatttttagaacagtttcttggcctcgtgtatggtgaggaactatgtatagacaaagaatagacctggaatcatgagactggagcttgttctaactgagtagctctggaatcttatattagttccttgatcttcttggcttatccccttcatttgtacaatgacaatgaaaccataagatagttttattggatttgtctatgatttctgttgttgtggaacagacatttttcctaactcaataaaatgcagtaaatcctgtttttttaaagaatggaaaactttcccttttcttgctaatataaggaaattttaatatgtttaatgaatgacagtaccttactagaattattcagtgtgctaaggcaatctgataggaaaagattaatgatgttgtagattgtgtgctgacaaattggagcctccaatgcacataactgaccacatctaaaacttttaagtgtaaaatgcgttcattagtaacatctcttttttcttgctagtcttcaaagcatggaaatactaaatggatggagaatttttagggaatgaatccgtctcacagttaaacttttgttatagttcattcattttgattatataatgtttttactaatattagtcattaaatattttgtaattgtaattttgatttgttaacttcaaccaagagttattttaagtaagtgccttttaaattataaacaaacatgcaagaaaaggaaatgattggtgctttagttatttttcattatctttagcaaatgtgactaggtttttttttggaagtgtaaatgagtgaaactaaaatttaaatcttgatttttcaaagcgatttagtttctgttcttttaaagtatacttgtctgcatgtttgctagagcaaaggctgttgcacttataactgtcatttagtaggctggttttgcagagagtgtaaaaatcagggctggattccttcctctatatcctgcaccattaagaacacagcaacggaacaattttttgagtaagacatgacagaaatatttggtagattccgtcattgtttagcaaataatctggttttccttcccctgcatgcaaagagtaagtatacttcctgccctgttgttgttgggtttggccttatggcttgctttggctgatgagatgtgagaagagataatgtatactatgtgcttgcatgattatgctcttattctcttttataagaaaagcatgcccctttctgcctaggactcagaatgacagacacgtggagctgatttgaaccagcctggagcagaaccatcataagccagttcatagattttatgttcgaaaagcaaatgtttgtcttttagagccactgagattgtggggttgttacatggcattatctaatcaaaacttgactgaattaaatcattcatctaagtaaaagaaaattaggcagattcagtgattttttttttttttttttttttttttttgcttaggattataggggaaagaaccaactcagccctggtgatcttctttcattttaataaatttagtatgttattttaaagtagcatattttctttctactttatgcagaaatcacatttcttatactaggtttatcaacatccattatttctttgcatatggctctagagtcattttatctgcttttcaggcttatgcagatttcaaccatgtgaaacatgaatataagtatgtccgtgattcttttttaaatgattttcacctacatttgaaacatgttatattagtcatggcctctcctttttctttttccttgttaaatgaatattgtgaattcatggcagaaactttgggaatcttacctaaatccagtataagtgacagacttaagagtttaactgttgtttgtttttgcatgcaaatcattagtccatttatttatgcatgcattcattcatttagcacctgctacgtgtcagatacagtcccagatgctgacaatattaagaagaaggatgaagtattatctctttccctaaaatgccttgtaatctactggaggtcagacacaaagacaagtaaatttcaggaagagaaaagtatgaggtattatggcaccacataggagtaggaagacctacctcaattttgttgtggcaggggataggggagtgtgcaggggtgaaggtagagaatagagttggagaaggagaaagttatcagattttcattcaaaaaagttcattttattaaaatttatttattaaagttattaaaatgcagggtagggaagagacaggaaaggtcaaaattaaaaacatgaaatgagggaatgtttatattcttattctttaaagataagaaagacatttcattttatgtatagaattctgttattttaaaatttattttaacattgatctaattgatttttccaaatggaatagagagatggagactagatcacatcattaattaaaattgcaaagtaatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaattgcaaagtaattttattataattaagaaattagaaatacatgagggaaaattttaaatattttatacttatcaatactatatttactttaaatatattgatctgcgctttacaaaaatagcatgctatttgttgtttgcagctgtaaaagcaaattcattttgatataggatatttcaagttggatattgcttaaatatggtgtcctttatgtataaaatggaaatttagaaaacacagtgatgtaactgaaggaagaattacccaaggaaacattatgtaatagtatgaaaatacctatacactaggcaatttgctttcaactgaatttaaaaagcaaataccaaagttattgagaaatctagctgccctagcagttactaccctggcaatactaacaatatgctgcaaaaattaatttgaccttagttttttatgacagaaacttacttttataatattactgtaatctcatttaaagtagaaaattatattttttttaaatattatttaactttaaaattaattatgtgaaaacaagtagcactgattaatgtaaaatacattttgctttaattgggtaattgaaaacagaggagtttcatattgcaatagaagtctctagttccataaatacatcatagagcctgaaacctaaaattaaaacagtatcaatacatttattagactgccataaagatttttagttgatgttggtaagtcagtaaaactaggaataaaagtgaaaatcctcattctttgttttatgaatctgaaatagattgtcatctaagagaagtatcttctgtattttttaccttactagttagaagtagcatacagaatggttttactagccataattagtttgtcttgatttatgtatagccaaccttaagttaaaaaattttagtctgtgcacagtattttaaaaatatttgtaattactgctctctatgtttacatatatatatataatgtatgtatgtgtgcgtatatatgtatgtaggtgtgtgtgtgtgtgtgtgtgtgtgtgtgtgtgtatgggatatccaaaccataaatacctaggcatcatgaaaaatgtcctttataacactagtggatattatttttaagcgatttcattataaattctttaatagaagttaatgtatattattttgtaaaatgctgttttaatgatatggaagaatttatatgtaaataaatttgctaatgacttctatttaaatttaagcttaatggtcacatgcctgaaaaaaatccagatttttctggaccatatttttttggtctttttcctaaaagaaacatatatctgaatatagagtatttcctatatatattatatgggatacaaatatgtaagaaacatttttataaggagtaaacataaaaagaagcattgcacagcagttaagcatttgaactcggaattcagatcatcaatattacctccaacaaactgggtgacctggaacaacttactgaacctttcttaaggttctgtctatctttgattacctcactaagaaaacagaaataccttagggagttgtgaagattaaccaagataataatataaaatgtttagcatgttatttagcagtaaattttattggtaaaaattctctggtagtttctgtgttcaataaatattcatctttaattaaggtgattaaatcagttactttattaaatatattaagtatacttctaattttacattatagataatttatcccctaactgattttattgtttgttttaggttacttttcacatagaaccatatagcaatcgagatgatcaaaacatgtacaaaaatgtcaagtatattatagacaagtgagtttcttcaatatttataaatattgttatattatccagtgataattattgttttaagaatagtacattaaattatatttgagatttgaatgatttatgattattccatttttaataaaattaaattgttattgtaatgaatgtcaccatcatttcgaagaacattgctgaagtttcttataattcactttctttttggaagattgctgtttttactgttttacaggtttataggctatttatgatttctgtagttttgatattttaaaatgacattattttctaaaccttcagaatatagctttatctttttaaaaagaaggttcagattattaaaagtgaactacttcttttaacacagtagacccagagctgatattttcatttatatctagcctgatcaaaaagaatttattaatacagttttcattttttgaaagaattttactgataatagtctgtgacagatgccatagtcttacaaagaaacttgtcagcaacagtagaacatttatcactgatagataaaaaagcagtttaggtattatgtagagtattatttataatgtagagacataggctttttatggcattagtcatcatttgtaaacctcaatatgagatggttaatacttgtttggtaatgcatccagtatctcattttctaatgtgtaaaattaaaaatgcatttttaattattacacttacacaactgattcccctaagaaatggagcagtgtgctcaaactgcactgactccttcattttcagtaaacagtttttgtctgtggcaaattagttgtgaatattcatttcacttttatatatgcttattttctagatatggaaatcatccggccttttacaggtacaagacgaagactggcaatgctcttcctatgttttatgtctatgattcctatattaccaagcctgaaaaatgggccaatctgttaaccacctcagggtctcggagtattcgcaattctccttatgatggactgtttattgcccttctggtagaagaaaaacataagtatgatattcttcaaagtggttttgatggaatttacacatattttgccacaaatggctttacttatggctcatcacatcagaattgggctagcctaaaattattttgtgataaatacaacttaatatttatcccaagtgtgggcccaggatacatagataccagcatccgtccatggaacacgcaaaacactcggaaccgaatcaatgggaagtattatgaaattggtctgagtgccgcacttcagacacgccccagcttaatttctatcacctcttttaatgagtggcatgaaggaactcagattgaaaaagctgttcccaaaagaaccagtaatacagtgtacctagattaccgtcctcataaaccaggtctttacctagaactgactcgcaagtggtctgaaaaatacagtaaggaaagagcaacttatgcattagatcgccagctgcctgtttcttaatgcattgattaaagtttaatagttatcaaaatcacctaatttttaaaaatagctttcgttttgagttctggaaagaaaactgtcaaaatcagtatatactattagttatatttaaaaatatttttttaaattctttacagataatattatacttgttacccttcacaataccacatgagaaaatatctgagacaaaatgtatacaaatatattccttatggcataatttattgcatttctgactgaaatcaaaattctgatttgatggcaattgaattttcattttacaatagataaatgcttgtgctacctaaagcacttagcacacagttaaattatatttacatcctagacccaaataaataggattgtgtgtatatttgggatatctattgaagaaaaaaagaaaaccccttaaagataatgtacatgcttcatgtcatgtctttaaaataatttaatcaactttattgtcttagtatttagactctggataactctacaataatgaggaaattcttaagaataacaaaatcactgtaccttcctctcaattttgctgtgaacctgaaatggctttaaattaatactcttattttttatttaatttaattacataaattaaaccttaccatgaccaaattgtgttaggacggcctgctatctacagcacagtgtgtcatttgcagatttgtggttacctataccacgctaggtgttttgacatgtttagtgtttctgctttacagtgctgaattccatattttagaagctatgaaagtccttttatgaaaaagttactgattgcttctcagttattaggaaaacagttgtttcacaattattatgtagatatgatgcccaaatatcatttttagtatatcttgtcgatctttaagttgttactattgtgttattcatgtctttaaatcagataccaaatattttttaggaaagaaaaatgttattactgtcattaggttgtcttttaatactttaagttattttgacgaaaagtaatagagaaaatttacttagcattttagattctagagacatggaaatgaaaattattttatgtctagagtaggtcctgaagtttggctttacattaagtttagcactgtatcagaatgaagaaactaatattttacataaaaactaatactttcaattttttatatagtaatatccccattttgtaaatgttagacttttatcatacctgtaagttaaaatacttgttatcaataacttgtcatgttgtgacaaattgatcacttgtgtacgaaaaataaatctccttaaaaactaaataaaatgcactgtattcttacagttaatgtttataactatagtaaaaaattaatatatatcctattacataaatgttatttcttaggtgttccattaagaagagcaatagaataatgctaaaaaataatgcctataaatcttcagagtataaagacatccattcagaaacaaaaattagcactaaattttttataaaatagaccagatgacaaaatttattttatttttaaacagtggttttgacacaaattatgttattgaaaagcattattaatgtttaatttatttaaaattttggaatttgccatttctcagagaatgatcaggccttaggaaattaatacagtagtagtaatcattttctaggggaaaataaaagaataaatcactatactgatattttgatacaagcaagcacttacatggtaatcactatatagatccaacctgtggattttcttcttatgtccatttaactagaatatattattttaggtataatttacaaatgtcacacctaataatcttttataatataccatatttcattaaagttttgttagagaagtatctaccacagaggagtttttgtcattgtgtacgttgtgtatttgaacccaccatgacagaaagtaaattttaggaaatagttatgagattaagggaaaatctataaaaacaaggttagcatattctcaacacagataccaccactttctttttcccattatagacatggtgaatccacacagcatacttcatctctgagctttgttgtgattcctcaacacattaccctaaccagccagcagtaacagatttcagagtaagataaagcagattctgtcttcattgcaaaaagttattctcaatggaagaatggcatctgatctcataattactagtttatattaatatagtttttttctccctttttaataaaataattacagtcatccctcagtgtctgtgggggattggttccagttacccctatagataccaaaatctgcagatgctcaagtccctgatataaactggcatagtagttgcatataatctatgcacatcctcctgtatacattaagtcatctctagattatttataacacttaatacaatgtaaatgctatgtagttgttataccatactggttagtgaataattacatgaaaaaaaagagtctgtacatcttcagagtttcagtcggcaatttcttggccatggatgtagaacctacagataaggtgagccaactgcattaggaaataactctaataattctgttaattcttagagaggaaaactttcaaaatcttcctcaggtatttattacaactgcctttaccattttagttgtaacacagtttaaattgttatgataacaagtaaataagagcaaagaatgtatttcttaattcaaaactatacgtttgaattcaatatggtataacttaaagtggtataatacatacaatgcatgaatcataatggattcttttataagttattaatttttatggtttaatcagtctaattgttttgactgttatagaaaccaaatattttactgtttcttttaaggactaatattgtcaaaaactgctgttattaacttcacttgagttgtttaacttccttctgttttaagattgtaattaaaaattactattttgttatatggaatggttaatttttacctaataaaaacatagatgaaatacattg

SEQ ID NO: 562 - DNA, 1193571 bp, Homo sapiens
cgctcgcagtttcgccctctcttccgctaatgattgcattattatgctcccctctctggggggtctcgcccctcttgggtcgctccggagccccggcctcccctggctgcatttcttaaaaatttgggagcctgggagtgagttttctccgaggcgtgtgtgagaggcggcgggggtgttttcctgcgcgaggggcgggtgaagttcattgcccccacttttcccgcgacctttttcggacccgattttggatcgagttgaggggggcgcgggcgttttcggggggcggggggcgcggcggagaatggccgcggggagggctccccggagcctcccagtctcttgatcaaagcattccgctattctgatttattgcttgcttggtgagttatttttttttcctctaaaggagacctgtgtgttcagccattactttgctcggcgctgctcccaggcatctccgaccctcggtgctgtggggagccccacacttgggctcctcgcctctcgccctcgctccccgtccctcctcccctctctccgccccttcccccttttctttctcctctctttcttcccctctctcccttctttcggccgccgtctcccccgcgccctcctcggggcggagggaagccgtgaagggggagggagggctcggtgtcaatttttttttgtgtggctgcggccgtagcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccgggcgctctcactcgcctcgtcgtcgggctccgacaaggaagacaatgggaagcccccgtcctccgccccgtcccggcccagacccccgcggaggaagcggagagagtccacctcggcagaagaggacatcattgatggatttgccatgaccagctttgtcacttttgaagcgctggaggtaagggggaccccccttcccccgggttccctttatgcacgaccccactcggctgcgcccggctctcctgcctccctcgccgcgctccgggctgtctgtctgtctgtctgtctgtctgtctgtctaggctgaggtcttattgttggtggggggagctgggggcgcgggcagacaggcagcaggagggagtcgcaaagccgtgcctggtctcgtttcctcgctcgcctttcccctgcgccccctccctgcaccccctccacagcagatgggcagaaagaaaggggttcgggcatcacaacaatgcgccccctctccacagagagctctgcccccactccttcctcctctccctccccaatcatggcttcttggctggtggaagtctctttgctgggtttggggcgcctgtggacggttctgtgtgctttctacagagtcatatgttcgtgtgtgtgtgtgtgtgtgtgtgtgtgtgtgtgtctgtgtagtatatacctttcccgggtgtcctcgggactggagactgatggggttttgtgatttctttgcgcctccccccattacccccccatattctttttttttttttttttttggtgaagctggggaagggggcgttttctcctggttgggagaaaggagggaggaggggagagaagagggaagggtggaatagctctctgtattctgtatggggttctgttacagaaagggttaattataatattatctatacacatacataggcacatgtgtgtgtgtacatgagcaatttagttaaaggacagaaaaaggtacaccagggaagactggtgggagggaagaataaaatcctagctgctatctgaagggcttgtcaccaattgtccctctccctttccttttttgtgttttcttttttttctttctaagtgattggctttgtgtgtgtctatgtgtgtgtctttctttattccttgggcacctgcagcgttgattttcaaatgcacattttccttccagccaactggctcctagggtagggggaaagggaaaagggagggagggggagactgtccagggttggggggaaactgtctttgcctggacctgtctcctttggtgtggtattggtcattggcctctataaatttaaccgcctaatttcctcccccacctccctgtccccaccccccacacaccatgcacacacacacagaaggctttgagattctgcagagttggtccacctttcttaagcacaaaaccaagatacggtttatagttggcttatagtgtttcatgcacctgatgtgatggtttgaggttcctgaaggaaacttttccctttccatttttttttttgcgttattatggtattgtttcacatgctcagatgcaagctttgttaatgacagcttaaatctcacatacggtaactgtacaggtttagattgctggttctgtttatgtgtttgggtgtcagctttaaatatttttttcaaaggaaggcttcctatcagtgttgtccttttctgtgtgaactgcttttggtttgggctgctggtggtgatggtggtggatggtggccagtggttgggagtaagggaggtattggtggtggtggtggtggtgcaggtggtggtgatggtgatgttggtggtattggtggtggtcgtagattttgatgttagtgattgaatcagttactctctggttctagaattggtgctttattggccaaaattttgagtgttgaggttcaccacttattagaataattccaactgtggctttaagtttgccaaggtgggtggtggttaccatacagtgtgacctctttctgtctctctctcttgttttaaaataggagttgaaatggcagcatgttcctattagaacatgctgcttggaatttggttcatcattgctgtctgtggttgttttggaaagtacttgtaagagctggttacaagtggttctgctttctgcatggttatcctgagctcagcaatcaagaggggccactggattcccacgaacatttttggaggacaagtagggatatatgtgtgtgtgtatatatatatatatatatatgtgtgtgtgtgtgtgtgtgtgtgtgtgtgtgtgtgtgtgtgtgtgtgtgtgtatatctcacttatgcagttctttttgatggttttatttttaacaaataggtatttgactgggcttgtgatatatatctatttatttggcttttgcgagaaaatgtgctcattttaatttattttgtgcctaaaaaacttgtaattttaaaagcagaccaagttcaaaatgtacagttaataccatttctttctttgctctgattatttttttctgctacttttctagattaaaatccaggatattttggttagctgaatactatgtcaccttcatatctaaatatcatatgtctatctatgtgtaggtagaaaaggtctaacttttaaaaaagtttacttaaaattctgtagaaaaaattaaacatacagaagtagacagaacacccaacatccaggtttgagaactaccaactcatatctcatcttgtattttctatatttcatctatttcctctcccacatatgatctcatccatatttctcacacagaaatacttctgtatgaatccctaaaccataatgactccaaaaatcctcagaccccaccaaaacccgcacagcagtattatcacacttaaatgaatgtataacagttcactaatatcaaatatcctgtcagtgtttacattttaagaggcccaacttttgtagggaagccgtaaatacatttgtcagattaaaaacacacaatgggaaatagaaatcatcatatatgtctggttctttggcaaaaggtagttttgttggctgtgtgctatcacattgtgtccatgctggatggtcagaacatatgtgttagtgattgttaaattaaaacctctggtggtccactctattcagtctggaagatttattgaactatcaccaagaaatgtgagggcttattgggaacaggcaactaaactatgagcttggacaaaaatgtgtgttgggggagtgtttgtaaaagttaagaattattatagatgctaagagttatcctaaatacgtagtatgttttcgggccttgtgtttagaaatgaaatcagttgtcaccacatgtcattaaggctgctgctggtatgatattgtgaaaagaaaccagaaatattggcttgcacagctaggtttatagcttgtgccagttcagagcaatagctggcaaacagtggagtagcatactttgtgtgttaatggacacattatttgactccatgattttgttctgagtagctggttttggacttctcttttaaaaaagaggctcctaactcattatgaaatgtgctaatataaatagttccagttcaactgattttactgatactggagtaaaagtgataacttgcctaatgagaacctgcatttttatcttgattattttttgctgttgttggattcttttttgagatgatgaaagctttaggggtagtttgacaagtctcacattttataggcagtgaaactggctgaaacagtttcatattcacagggacacttctcttgagtaattgtgccctgaagttcaagtgtatgattatgaagagcctcatgatagaagataagagggtaggcgaggaggctaaagttgaacatggtgttcttttcattatgcagttgagaagcagaattaacgttggtatatagtatattgtttgtttggatattcttcgagtgacaggatgagagcaaaaatccccagataagatgtctagttttcttaaaaagtggcttttagcaaagtataaatgggaatgttggggtcctactaccatcagtgtgtcctgatgtgttagatagtgttggctttctgctatttgggttttttttctgtgttgtgtctattaggaagccacgtgagtaccatggctgaaaacttgactttgcaaatccattatttttcccctcattcctcttttgtgcactgggttcttagggcagcctccttttgtacagctgaccaagggaagctaagatgaaatttgtggaattagcagaaaagaggccaattggagctttataggcttatgaaagtaaaggaagactcatttctagtggttagagcatcaaaccaagactttgatgcggtcttcacttcctggctctgttttcagggcttcccccacacatcagtagcataagtgggctatacagaatttggtgtacttataacatgccatgttaataggctctcacaatttattatggtcaaatcactttagttgtttaaaaaacaacatgagtcacatgccttctgtcagtctgcagatatttatggagtgcttaatatgtacaaggcactaagaatatagagaaaccaaacataaatctagcgttttgagaaagtatgtagtttagttgataaagccagcacctatgaaataattttgaaacaggtacttgaatgcctgatatcaactaagcgccataggcttttagagacaggctagtgagataggctgaagtgttccagaaggcttcatgggtggggaatgggacctagaagggtgaagtgatttggatatatggggaaggagttggagctagggagagcattctaaaggaataatgaaggcacaggaacaagatgctacatggttaggacttgggggcaaggaaaggctggtggaaatgagtacaaaggtggtaagtaaagagtgcttgttagtggggcaggagacctgtggagacccacatgccaggcttggcctgcctaactagtgtggcctttgaaagttaactttctaaaagcatcatttcctttatccattagtggagaggtttaaactagtttagagtaaagcttctcaagctggaagggaacatagctttacaggatgttcataaattgttttttagtctgaaacagagtgatctaccgccaaatagtttctgaaacttgatgggctagacaaaattaaatggatgccatgttctgtcagaattaaaagtctattgtgtgaatgtgaattttgaatatcagagaaggcaatgtgttgtgcctaatttcctaaatctattttgaccacagagcacttttattctctgcattgtaatctataatccagtatgggaaatactagaaaggatccaaaaaagtccctccagatcttggaatctggtgatctctgagtctggggtgagtgggctgatggtagacgacttggaaaaccaggcacagaagcttgtagtcggtgcgtgggagctgcttcttaagcaggagtggcaaggggagtgaaagtgaggaagatgtaaacagtgagggagactagtccatgtcttttcctgctcccctttcctgcctgacatctgcctttttactgattgttaccaaccccaccaggaggtgaatattggtgagtggttctcattaatagctctttcagtgtgatgatactagcccaattctgatgccaccaagctgcccttcagccaatgttttatcctctttgtcccttctggtttcatatattgctgctctttggcaacctgtaaaaaaaggttggttgggaaaggaggttgacattgatgttaaaacaacgatttcaaattatctgcctttggcttgctgtatatgaagtggtagttcaaaaaagggtcagaaccgctcttttgctgttacatagccaggaaaagctgtggaactgtgtttctgttgcatttttcactttcttttttggaaaatttggccatgggactgtaaaataaatgggtcagttccagcatttgacttctgaaagtatgcatagctttaggatctgagaagggatgagagaatttggaggaaaggaagggtgtgaatagtgtgtgtggttatgaattcaagtattttactgtacttactgagtttcattattttactttataaggcagagcatcacttgaggagtatttatgtgagatgtggttgaacgttgtgatatgatgattccatgcagcttttgttaattgtggagattaactacttgcaccttttttttggaattagaatgtaaatgaatccgtgaatttaaaaaatgaattatgaggttaggaattgagcctttgatcctgagagtagtgttctgtagttctcactgttgaaaaagggttaagaaaacagaacagtaaacatgattcaaggagtgttgagggtgatagattctgagactcttctacaccacagttttatgtattatcaaagataaatggtgattatttagttttaaagaatgttaggattagaaatgaggtccccagatggacacaacaatagttgaggctagctattaggaataatttaggtctaagagctacgagatttggaagcctttggacgagaaggtctgtggcatttcgggtgtttgtgtatgtgtgcacgcacctgtgtgcacgcaaagggtgaaggatggtgggttagtggctttacattttattttattttacccctatcctgtatagtagtcataatatactaaatgcagcctaactttgtaaaagtgtttcatgctgtttttttcctcctcaagaagcaacttttttttttctttcagaattaggattaaacccaatatgctgcagatgtaggataaagaacctagtaatgggagagcaactgttaattttagaaagttctgaaaagattcaggtagatttgaaaacttagatcattgaagtttagaagagcaatatgataatgaatttggtaaaacttgagacaggagaagatcaaaaataattagtgagctggggcagaactgttttctcttatataatcagaacctgttccatgaatgtagacttttttcccctctgggaggtgaagaggacatagaatttaagactggtgagaccctaagtgtgtcttctttcttccaaatctgagctgtgttctccttcgtttcttctaacacaatagcagagtaatgatagtttctattatagctttgcatctgttggtatgcaattaatacatactgtgaggtcacaaagaataggccctttttatgctattagtatgaggaggggaggagtgagttttctagaatttgactgcccctgcttgtttaggaagaaactagacaagtacaggcttctgtgtcttagtcctgttcaggtctctgattccatccattgcaaggggctctggaccctgaaatcatatgaattggtgccttctttgaaggtgtttatttcatatattagtgtatgtggctctcttagggtccagttagattccccgctcacctgctgcccacctccctcctttcctccctttctctctccttcatatccttcttctttctctctcttcctttactgaggtagagctatcaaaattatgaatgctgttaataaaaggtaatgcatttaggacattgtgtatgaaacgcagaaattcaaaaatttttaaatttcattatttgaactgtgacaatctgcttgaggaactctaatttagctctctaaaggtgaattgcttgccacagttttcttggccattacagctcacttttctaatttctcagcttatgtctgaattctagttagtttgtttgccagagcaaaccttataaatgatcaactacatacaaatatttttaaaatgacttaactgtcattttagcttgcactatacctcacggtgccatacccccttgttacctctggagccctggaaaacccatgtgcagtaaaatggagtcacaagagaaaagcccacagtttgtaagtaatggaaaattgctaatgcaagttgggattcatttttggcaaaaagtctttaaattgcaagtattgtgtggctgctattaactgaagcacagcctgcaaatatagattgtgactcttggttacatgggtgaaatctgatattttctttcttttattttgtttttttgagacagtgtctttctttggttgcccaggctggagtgcagtggtatgctcatggctcactgcagccccaaccttcctgggctcaggtgatcttcccacctcaccctcccaagtgctgggactacaggtgcatgccagcatgcccagctaattatgtattttttgtagagatagagttttgccatgttgcccaggctggtttcaaactcctgggctcaagcaatccaccctcctcagcctcccacaatgctgggattacagacgtgaggcactgcacccggcaagaaatctgatattttcaaactgtggctaagttctaaacctgagactgagttttagtcattgccagggacaagttgtgatgacgcctgagggatctcattttccttgttgtccccacacctaccctcgtctgcagcacaaaatctcattttaagtttttgtaaagtttctgatggcagtaatattttagaacttaaaaggaggaattaagagattacagtcccatattataagtatttcttagttgttatgttgaagtagacttcttttttcttgttttcttctagatctctttgttcagttatactcgttggctaaaggttgctggttaaatgttgtttagcgaaatattctatagttaaaatctttacaaagaaaaaagtaagaatgaagatgtggatagcacaataattgaacattagattattacttgttttctagccacatgatagaaattgcagtgacttccacccattctgtctgtacatgttcagttggcaaagagaatgaaggtcctggaccgtgcttttctaagaaatgattttatatagttgacattatactttcactggagcaaaaagggaaacaagcatttgattagtgtgtcttactgcatattgtggtctgctccctcatttgttacggtggtcactatgattgcttgacaattacagttttgagattaatatgcagagctaaatctttaggaggtatcctaaagttaggacctaaactttttcatagcagccttttgatccattttattccagccattgctagttgatgtgctttctaagccgtgtggcatcagaggcacagatgttgtctttagtgatgtagttctacctctcattttgcaaatgaaaacaacagcccacaggggttaattgacctgttcaagatcacactgggagttagaggctctcactgttaccctatgaatctaggagtctgcttcttgtaagttagtactggggagtcccaaggattgggaaccttggaaggagattttttaaaaacaaaaagtcttactacaaatgtggatgagcacccatgattgtaaagcttcccatttcagctaagaaatgttctgatttacacaatatcaagaacctttaaaaagcgttgttctctccctgcgctctctcccagtgtatcaccctgaaattagttggcctttctctgtaggtacattcatcgtttttaaacactgcctcccacctcccttttataaggatgtaaaataaaaaaataaatattagggtggtttctcatcattgaatgtctagtggaaagataaaataattatttggaagtaagatgaccttaatgtggcccatgtaaaatttttaacataatttctttgtgtaaaatattttctttagcctagcaatctgtggaaactcagagcaacttcataacattggtagcaggatgtatggagtgagtgaactttggagtatagtggagttgaaggctcaacgaaaattttcttcgaggaaatacttaaaatattaaatccacatgacgtgttgactaaggcatcttgtctgttcattgctgaaccagaacatttataacaactgtttctcatgtgtatgtattcatagccattcatataatgaaaagaagttttcatgggattgtaataacatatcaagatggatgtaattaaaacagaagcagattgacaccctgaattaaatgtaaaccataaaccaggatacctgagcattgtgccttacatatttgctgtagggggcagtcagccaaatatgcaaataaaaagacattgatgaatcttcctgggtgtgtatgtggttgcagagaacccaactattttattaatcttttatcaagcattgtttagatttgcagcagccatggaatgtattaatttggcagaccaaatagcttaggaccagaaagtaggaaataataaagggaagacatgattgatacgctgtcctataaataacacatgcgactgacaaaggggctgagtaatctttagatctgtgcttcatttcattaatggagttgttaaaccaggatgtttgagttgaacttcaatcagagaggctctgcctcccatttaaaatgcaggcctacctctactcactctctggactgatatgttgacaaaattggtgtaaatcgaatttttgtaaattggatcaaatgcactaggggaatcttgctgtgaaaaatatgagtcctttttatcaactatagtactcctcctctctgcagggaggctgggattttggtggagtgagtctcttcagatgggcattgcttcctctgagacagtttcctgcacgtgttcccggtgctctgttccccgtgctcctggaagacagtgactgtgagatttgcattttttcttcaggttttatacctcacttggtcggtgcttccaggaataattggtggtgatttgaataagcccgcatcattcagatttcagagcttggttttcaagtgcttgctaaggagggctcccagctatgaatatggaatatgatttccatatctgttccattggggagtccaggcgtgtcataaccacttcagagtcatgattgtatcgagacaccctagctgtaatttttctatatgacagttcagttttaaaattgtaaagatgccaaaagcagggctgcattgttattagggaagtcagtgacatctgttatatcttgttaaccaggggaggaaaatgctttaatcaaaacatctaattataccctatgaactgatgaaatatcctttgctaaatttttggaattggccttaatggaagaagctggcctctatcagaactgtgaagtaaatttaccctttttatttggaaaaatatttattcctaaccatagtgacataagggtattttaattgtatcagattacttttatatgtctgttgaaaatagttatttttcagaagttgttcaagccagcatcacgtttttgtttttgtgctctctgactcccttagcatatgaggcccccagagggagtttgtatttccagatgtgagcctaggaggatatgtggtgtcttagagccacctggggagggagcaaatgataattgcaggtgagatgcagggggataattcagcctgtgtgctgggaggtgcgatttcacacctgaatgttgagacctgctgtgttagacacttgtgttgttttaaaatgttttattactctaatatagaaatggaccagattgttccaggtcaccttcagttgaaagaatataaatgtttttaaatattgaagtataatgtgattccagaaatggttcctgtgtttaaaagtagttttacatatatctgaaagcattaaaatctgtttaactcagcatgtctatactgcctctacctctgttgatcattttttaaaaattgtaggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaattgtaaattattttggcaatgtggctttccactttgaatcattcaagcttcaaactgtccagtaaaactatccttttatctatatttcaaaactagaattaattttaactatagctgttagttgtttccagaatcactgacgatgattataatattaatgatagtacattattgatagtcttaatgctgggatatggattatttctgagaaatgattaggtctgagaaatgctttatttcttagttttgggggtatttcatctttctgacatggttttcccatgtatggagatcttggggcccacctgaaggagttttttgaagtgttgactgtgacactatgggcttcatgtttactttgggatctggtgggaagttcaagtgctattaatttttccttggtctgttttatgctttgtaatggctttctgtgtgttttttgggagttaagactagaaccttggaaaagagagagccagagttttctccctatatttctattttaaaacttttttttttttagacatgttctcgctctgttgcccaggctggagtacagtggcgcagtcatggctcactgcagcctcgacctcctgggctgaagtgatcttctcacctcagcctcctgagtagctgggaccacaggcgcgtctcaccacgcctggctaatttattatttgtagagacggagtcttcctatgttgcttaggctggtcttgacctcctgggcttaagcgatcctcccatcttggcctctcaaaagtgctgggattataggcatgagccactgcgcagcattttatttcttatgtattgttattctctctgtattctctgcctaaatgtaacccctgcactctttctgtatatatccttctggggatatttgaggctttcagaactgtttctttcttcactcagtaatctatgcatagtaggtactcagtcattgcttatttacagttgacaacaattccatgaaaagaaatttttgaagagggagctgctatttactattcgccttgtgccaggcattgtgctagcaattttgcattcgttatcccattgacgcaccccatgaaaaaaagaataataatctctgtttgatagttgaagaaactgaagcacagagccgttaaatcaacttggccaggatcagtataagagaggcaagaaatgtagcagtttttgcctgacttgaaagcttgggctccttatccctttactcattttcatacagatgcattttgtgaaagatggccacatggtctctagtagaccacatttgttcattgttgtgctgaaaattgttacaaaggattttctaggtataataataggatttagggaggggagagtacttattgtccaggtctttatttcctttgaaaagttggagcttacagttaggttgctgccactcatacaatatatctgtaacatattcgttgttgttttttctctgtttcactgtttctccctgttataaaatctgaccttttcccgggttatactactcaggtagattttaaaccattgtcaaaggcaaggattcaggctgatgatatagagggttattgtatgtcagtgtctgttctaaacccttgcactcatttatctcactgaattctaaaagtagctctctggaacacaaatgtaaaattggaatgaggactagcatgccctcacagattactgtgcatataagcttatattctgctatagattctgaagtattttgtcttgtctgcttttaaactgttctaggaagcagcacttgtcttgagaatctatttcacaataaaagagaccttgttttgagggctaggtgtatttttttaaaatctattaggaactctattctttctggtaaaagaccacactaaatagctctttttgcttttcttgatatctgtatcttgaagataccaggtgacaaatagtccattgatttcctctgtcattgtttcctttcattattctaagcagatttgcaaattgttctctcccatttcccattccaccctgttaaggtttgtttatgctacaaagagtatgctaatgaatataactgttagatttacttcttaaggaaatcccaactgcatttagagtactgtacatttttgagaaggctcctcctcatttcccctcggctaagatgggcctcctcacaggtcattctctgggacttcacgattcagaactggtccattaccattcatttacaaggaatgggggttagtataaagatacacacacagaataccctcactgggcctgaattttctaaagatttctagatgaatatgaagatcagtcaagttacacacttctctcaagagtcactctccgtctctttctttctttctttctttctttctttctttctttctttctttctttctttttttaagagatgggatctcactctgtttcccaggctggagtgcagcagtaatcatagctcactgcatcctgaaactcctggcctcaagcgatcctcctgctgcagcctcctgaggacctgttggtgtgtgtcaccatgcctggctaattttttaatttttttttgtagagacagggtcttgctgtgttgcccaggcattctcaaactcctgggctcaagtgatcctcctgcctcagcctcccaggtagctgggactgcaggtgtgaaccactacccctgctaattttttttggaggggtagaaatggggtcttgcaatgttacccaggctgatctagaactcctggtctcaagtgcttctcctgccttcacctcccagaatgctgggattacaggtgtgagccactgcgcccatctgagtgtccgtatgaagagaggtggcagtttcttcttggaatcaccatgctctgagacacacagtcttgcctttctctctccaactgtctcaataaacacaattgcccctttgtatgtcccgaatggaaataccatactagaattctattttacagattgtaattgttggggagacccaagtcaaaacatgttctttgaaatttaaatataactgtaaaaggaaccacaaagtctagggctttaaaggtgatcttttatgctttgattttatgtatttgtaaaatacaagttctatattgactctagggcctgtctcagattgtaaacccttagatagtaactgtgtctttttaactgttccttgtatccttccttgcccctctggtggtctataatacccctgttgtgatgattttgattaaagaaacatagtgtgaagatgggctgtcagggatgggtgtcagtttcacttcagggtagtgggtgccatctattttctgattacaggtgaacattactttagcattatttttttttgagacagagtcttgctctatcgcccaggctggagtgcagtggcatgatcttggcctactgcaacctctgccttctgggtttaagcgattctcctgcctcagcctcccgagtagctgggattacaggtgcccaccaccacacctggctaatttttgtatttttagtagagacaggatttctccatgttggccaggttggtctcgaactcctgacctcaggtgatctgcctgcctcagcctcccaaagtgctgggattataggtgtgagccactgcatccggcctattttagcattcttgttgtagatttctacatctgctgcccatatttcagctgtactcttattttgtttagtatggtgtacctgggattagggacagacaaatatgtatgctcagcctgatttggaaattacattgttgaaatacagcccatatggccattgtaaaatggttagtgctgcatataattgcctttccaatgatgtgctttgtcattacttccatcttccaagaagcactcctgtagcatgctgacagcaatagcatcattagaaaacatatggacatgcaaaggcattaaatcgtctttagtttaaggattagattacagtgttagaggataggtcaccaggcttgcaatcgatgactcttgcttagttcagcactgctagactggatgatagagatttgcaaaagtcctatttacttgtctgctgagtgtatttcatatcttccctgcaattgtgagaaggtcctttagctgtgtataagcctctatcacagtattgcagccagttggcttctcaggagtgtttttttcaactattcatgtcctgtgcagaattcttttctaggatgctccctcaacctctgtttttctgaatgtgagcccaaagcaggctaagccaggaattattttatttgggggtcatttagatataaaaagagactaagtggtggagtcaagaaagtaccaggtggctgccatgttgcccaaatatttcctcccttgtacagcatctatctccacatgggtctcaagtccacctcccttcttcctttcccctcttagaagcaatgggattattgcagcctagaggctcagtggtaggtcctagaggccgagggaccatgtgatagagcctggaaagagaccaccccctgaatcctgccctttgtagttggatgttttttccccccacaactagataggtttactatctggctgtaaatattctagggatgcaacagttgtgggacatggtatgatttgaattttcagggtcctttttgtagttgccagtgaatagtaagtgaaatcgcagaatggaacatcattcatcaaatttaatatttcttctttggagtttaacagaaataatgtggatttggggactttcagagtgataagggactttggagatcctcatgggcagtggttttgggtacctcagggtacgctgagtcatttgaggggagatcctgactttattaaatcagaactccacctttacctgtcttctatatttatacttatgtattaggattacattctctttgagaagaaaaaagtgtctggatttgtttattctttcattcaaaaaaaatttattgacagcttctgtgtgctaggcaggcagtactccaggcacaggaagtaccatagtaaattagaaaaaatagatatctattttaatggagtttatattctaacaaaggatggggggacatactgtaaataaacaaatatataatatgttgggaggtgacaggggattttataaagcagggtaaagcaagagtgagaacttagcacagcaggtcctcaaataacattgattcttttcattataatgttgatgagaaaaaaaattgattcctggccagggcaactgtgtggagtttgcaccatctcctcatgtatggtaaaattgctttcattatgcatcgtgtcacgtatttaactgaggactcacttgtatgtgtatgcttacgtgatgctttatccagggtgggttagataaggctcctctgaggaggtgatatttgagcagaaacttgaaggaagcgagggagcaagaaatacagataacccggaggagagctttcaaggaaaggggagaacaagtgtaaaggctttgaggaagaaggagtggcatggtatgtgagcaacacaggagatgttggcggctggaacaaagccattgaggaggggacagagagtggggaggggcctgcagtcactttaactgagtgacgccagaagcttagaaacagcagaaagcaactgtccaaagccctcatttcccaactgaaagtgtttttgaatttccccaaggtcacccagctgatgtataaacaagagcacatctggagctcacgttatattcttttaaagtagcttctcattgtaccttgtgccaccactccaggtcttaggagacatggggcatctttttggagacaagatttgtgtctcctttcctgttagtgggtatggctcctccaagagatgtgcttcaagactctacagaattccagtgcccagtcatcacaaagtgggaaacggctttgccagtgccagaatcaccaccatttggggaattattttaaccacaatggctcatgtttatcacaggcttactgcttgtgatgtttgttgtacccagagctttacatgcattaacacatctaaccctcacaacaactctgtataataggtcacattatcattattttagagatgaggaaattgaggtgcagagaagttaagtaatttctgtatggtcatgcagatagagttgtagagttgggatttgaatttagactatttgcttcagggcctgcactgagcctctgacaaagaggagggggatgagcttgtctctagataaactaattggaatatgctcccctcgcctccattttaagatggttctaggtagggcctagccttgggagtaataccaacttgtcacaacccacttctgtgactccaggtgttagtttgtgtagaggatttcacagccagtctggctcagtactggcaactttgctgattttaggtggattcctgattcagcaggtacctttggtctttctgagctgagtttgactggagcgtttttcaagacctgcatgagagtgtgttacggaatacaggccagtgttttcaagtcagcggacccagttttagctggtctgtcttttttagccccagtgaagtaaaagccccagacaccaccagtgcccataatccataggaatgtaaaatcatctttttagtactggtgcttttgaggaccagtacactatgtgcttgctttaaatttgtctaaaaatgtatgcatatgtagatatgtgtatatatgactatgaaatattttctaggtatggaaaagtataaagcataacatagccaacacccatgtacccaccaccaactttaaaaaaccttatgactttactgtaattttcttaaaattgtaggttatttttagtgagcaggaaccacagtcaaccgtaagttttagagtccaggaggctcaaacctggccacacattagaataccctggggataccctggggagctttaaaaaagtccttgtacctctgggagggtgcaggaagcccccacctctatcatcagaattttaaaaagctccccaaggcgaggattctatcatgcagtcagggtaagagacctgctgtttggagggttgtgtttggtttttcttcactgggttctcagatgcctggtaccaagccatgtgtggtactcctggactttatatttcattttcttaaagcattttttaatgtggttctactttcaagattctggagggtaatgtcctggggagttcctctccttagactcttccctcttcagcaccttatgaggcaagctgcggatatatttacatattcattacaaagcataagcatcaggaacttagagagtaggagtgaggcattagagaggggactaagaaattcagaagtattgggagctactgtctgttgaaagtgtttgagatgagtgaaagttatagcattaccttggaagtcagggggatgcagggttacatttagaaaacctggagtcacacataccttcacaggaaggctctgagctgtgggatggtagttgagggcctttttggtctacatcacaggtttatcagtgaaatatgtggtaagatgtacaaataagatgtgccccaccaccagaatgatcagttctgtgtggacacgtccgtgactgtaccctctttcagaagtgctatcaattatgtgttatgtgtggcctgattatcctctgtgggccttggctccatgcagcacctccatccccgtctgcccactcattcattcaacaaatagttgctgagtttctcttctctatgccaggttctgttctaggcacttgggataaaaacagtgaactaaacaaagcttctgccctcaaggaatgacattctggggatgtgggggagaggtgggtgagtgggtggtgttacattctggtgtcgcattgttttttgatgtgtctaacacagaaaaagatgtgtaactgtaatcctcctttagaaagctctaggggagccatttggcaggtagggaagtgttttgcctaatttggcttaaattatgattttttgattctgaggattttgattacaaatgccttcatgaatctacttcttcaagagaaattaagtgctgagacattaaagcttccagggaccttttgaattggttggattttattagcagcttaaaatgagcatgacatacagtaaggttcaagcttaggggagatgctgaagaaataaggatacttgattttctttccacttgaagtggaatccactaatccatctgtgctcataaatttgagagaaggagggcggaaaacgaaagtttatttctagggctctctactgggcaaggctatcaggttaccttcattgaaaagacttaatcagaagtgaaacttaaatctgttacagtcttccacagctgtccagggaattgggcactgatgaataccgtcagatggacccctgaatagagggaatgccttagaggtcatgtttggagttagtcaataaaatggatctcgagaagaaaatagaaagtttgagggaaaaaaattactggaaaagaaatcttaaagcttttgggttagatgttagatggatgacgaaaacagtgggtgatatgatttcctttctggattaccatcttcatcagatattgttgtcgactacagaaaaaatattcccagcacgtaaggactctttatacctgtgagctcttaaaaagaatcatctaaaatactaaaaaagcaagaatatgttgtttcactagcttttgattcctaaagtagattttgacttccgggtgtgggaaggtgggtggaaaatgagtttttgttaatattcaaaggcatgaaaacatttttaccagtttatgttttcctggtgcatttagaaatctgtggatccttggggatggtgtatgcaggcaaatagagaatccagtacttgtgaatctgcctgaatccacaggtttgggaataagggcagggacttgagggttcacagatgtgaaggttgtacacagaactcatgcagagagatacaagatctttttgttccccctttgattagaaagaataggacatgaaagtacttaattgtcaacttcgtcttcaccataagcccagtattgatgcaaaaatgataataataatgagaacaagcatttattgagtattgggtattctaattgcttaaatcaactcatgtaattctcacagagtggttctatgaggttggtgccgttttgattcctgttttaaaggagaggaaacaggcacatagagtttacacccaaggacgagtgtgtcagtggtggagcctatacattctggctccagaacccgacttgaaccactacataagggaactaaataaatgcttcttaagagttttattctgatgttgcttttactgggactttcactcttttttctacccaacccaccccacccctaccccactcgcctccactttatctttggatgtcttcagaatctataatatatcttaagcttgcaccttattacagatgagaaaatagagagctataaaattatgttatataattgttctgtatgacctagtgaatctttggtagaacagggatgtggaacccaggttttctaatatttaggtcactgctttttctcactgcactgtatggcttccattaaaaatattttaaactaactgaactaaaaatttataaacttaatttgtgtcactcatacttctgtggatgaactacattaaaataactaggtgctgtgagattttgctctagggaggagggtggtagacattttaggagctaacatttgcctctggggttatttgacctcctcctgaggatgtctttctaatctttggtaggcgtacttaaaagtgaggagaaagtatttgaggaaatacaagagccattcgcagactttagtatgatctgtgggtttatggaagggcttttttttttctttctttcttcatttaggccttttttactttaacctccagtggggacacaactaacttaaatcttaaaaacaaataaacaaacaaaaaccctaaatacaagccttctttcgctattgtttggcaaataagatttcacaagagggtagaaagaactgccttgattcttggtgttttagactttcctatagtctagttttttgtttttgtttgttttttcttttggtcctgtgattccttttgttgttacctgtttccttggctaatgctttgtttaaaaacaagtgctctggtattccaaaacaaatttccagcaggcttcccgattgtgttctcagataaaagaccccagggtagtgctttaacttgaattttggttgcctatgcatgcctgagagcaaaattcagtttactaggtggcttccaacccagattaatatggttatatctaaaacgagggaatatacatttgaaacaggaaatgtggattggatttaccctttcaaagagccctaatgtgaatgtaatgagtagagttttgtctggggttagatactgtgggctccagtttgtttttgagtttttagctgaatgaatgactttagtcctgtcattaaacctctggaaatttaaactttcaacaatgtaataatgataatgaaaatagggaaaggctcctagactgtgctgtggaaaaacacatgttcagattttactgaagacccagaatcccatgtggccacagataatttgatttcacagtttctatttctagatatacaggatggggttgccagcagaagttacatagtgataataacatatcagcttcctttttagggaagatattgtaattgtgagaaaaatattcagaaaagccttggccaaatattgtttgtagttggtaagagaatactcagttattaaagcttctgcgaaccttttccaaataattacactttttccctaaaggaatcctcccacctcagcctcctaagtagttgggaccacaggtgctcattaccacacctggatgggtggatggatggagatatatatatatttgtagagacggagtctccttatgttgcctaggctgtgttacattttttgtcacacatgttgggtatggagaatttggagtaggtagtttcagatttgcacatcacaagttcttgccttgtgcagtggtttctaaaccgagttgcatatctatactccatggtaacttggtaaacatactgattcctggaccctgtgtctgatctactaaacattaatccctgctctgtggctctggaacattagtgttttgttttctttttggggtttgtgacagggggacaaggtctcgttctgtcacccaggctggaatgtagtgggacagtcatgactcactgcagtctcaaactcctgggctcaagcagttctcctgccttagcctcccaaaaagctgggactaccaccaccacgcccagcaatttttttttttttttttttttttttgcaggggtagagacagggtttcaccatgttgcccaggctggtcttgaactcctgggctcaaggaatctagctgcctgggcctctcacagtgctgggattatgggtgtgagacactgtgcctggcctggaacattagggttttttgtttgtttgtttgtttgtttttaacatcaagttccagtatagaagtttcagaaacactatttcttaaaatatttttgagtgttttcctggggcagtggtaatggtgatggtttacaataatttatttctatgctatgtaacttttctgaaaagaaaacattcctgtgtatttggttttaaaaccttatttactgtaaaatagaacacatcctggaaaaagtgtagtgtacagctcaatgaatgatccaatgaatgatcacaaagtgaatacccaggtaaccagtactcaggtaaagaaatagaacattgccccctccccacaaaaaatgatttttattagattcctcaaattttcttttctattcctcctcaaatcccaagaaattagagatataagtaaaggttgatgaaacaatataataaggtgtaagtgaaaaaagcattgtcttttggtaggtggtgtttcttaattactcttttcagtaagtttttggtgatgttaagtttgtgttgtttatctatgttttgattcagccttaagccagttcttgacagtgactgtctattaatgctcacagctgatattaagattacgttctaagatctatcttttctgcaatctgtttcactgaaaatattctcatgatagttttgaaaatgcgtaaggacagattatcttctgactctaataaacaagtgagtcttgtcattactgtccaggtaacttaggaaacctgtctcagtagccaggtatctttatctggtacatgataaaatgtggtttcttagttttttttaaaaaaagttccttcctcctctctatccacccagaataatctctcctccattccaacccaatcagaacatttaaagccctgatggtttttcttttttccactgaagaatcattcaattcttagtgagagaaggtctagctgtattaaatagcaagcttgcccattttctttggaaagggatgctcatggtaaaaggacctcaagcaaaccctgcacttaagctgtgtgcaagtggagggagagagctgtctgcagccacctgccagcagctacacatctgtgctctgctagcaagcatgtgggctctgtggatgtgagagctgctccctttcccctctctgcctcatgctcccccatcttagtgatcgccactatcaactaaacaggtgacaagactccaatcaccctgctctgaatggctctccatcttcccaaaagtataccagaggcctgttttgtttcagtacattgattaaataaatattcctgtgtgcacaaaggaactgaaatctgttatggcactctgcagttatctgtccattaatagtggagaaactactgccagttttctcccctcggtgcccccgccccccaccccctttcttgtcactaccacgcagattctcaaaggtgccagtaacagataaattatctgacctctgctttcaggcttgtgtgaagcgggaggagtggtgtcatgctctttggtgaggcatgccgttggggcagtgcccaagtgtatggataataggagagcccgaatgatttagattagaagatgctttcttgctttggggttgtgggacctttgtctctccccttcaattcttagcagaagcggactcagaaaggtctttcaaattagcttgcctctcttttataggaaaagggtgcttctggccctgaagtagttctgtgtgtctactgtcagatgtggaagccacaaagtgcctgtgaaacttggtcccttgcgtttatttacaagtttctttcaaatggcagtggcaggaaggatctttaccatttgggcagatagccctagtggttgatgggagggcttggtggaagggcaggctttgtgaaagatccaagtgtggaatggtaggaattctagccatggtggtgctgactggtttcctttcttttttggcggggcaggggctggggtggagtgttggttaaaagaacacctagataaaaaacatgacggatttcgaaagtgttatttgggctgcgcacggtggctcatacctgtaatcccaatactttgggaggctgaggctggaggatcccttgagtccaggggtttgagaccagcctgggaaaaacagtgagaccctgttctataaaaaatttaaaaattagctggatgtggtggcttacaatggtagtcctgtctactcgggaggctgaggcagtaggatcacctgagcccaggagattgaagctgcagtaagctgggattgcccactgtactccaacccgggtgccagagtggggctctgtctcaaagaagaaaagaaaagaaaaagacagggaagggaaagggaaggagaagaaagaatgacaatggaacataggaaattagggttgtagagaagactctatgaacattattgtggtgtgaaggaatggcatgcagagataagtgtgatggaagggaggtgttgaaatgtttacagctcctaacatctaccaccaaggagggggcacccctttgacagaaacgagagggtgttcctgagtagttgtgacattaaaaaaaattgcagggaaccttgtagctgcatggatggcagagacacataagtagggaaaaatgttggaataggtaaagtgaaatctcttagtgtgtgtgtcttccaactgactgtgggtaattagttggaaatgacattaacctgagcttaattgtaattttgcatagtaacaacataccagctgttcactgtattctttcctggaggtgcgatttaattattattatttttttttgctatcttttaagctccaattttctgttatgttttacttaaaccccgcctggttgccgtgtccacagtccccacagtttagcagtaatgtcatttttgttgctttcatgcccactgtgtgctgagggcttgggatgctcttgattttgctaatgacttggatttataaagggccacattggaaggtcactgagaagcatgggtgattggaaaccttgtgttttgggctcttccacaaggttttagtttattatataaatcatatgcataattctaggcctatcagaggtgctcaaagtatcaagtgaacaagctgaaagagaagttaattactgaacagtgattgttctgatataaccaattattggatcattaaatgtttattaccttttatatgctcctttcccccataagggcagtttcttttttaagtcattaaaacagaaatgggatcttaaaaaaattctgcttaaaaaatttccacgagactgaagtattaaaaaggtcttgtgtgatctgacagctaaatagcctgtttttctttggtctgttgaattagtaattaatgaaatgtattgcctgagcagagaaaataagattagttttgtttaggaagaaaacaaaagcaaaacattaacccccaaatgcaggttaatattaaagtgcagtataagaaatagaaataaaacagtcttcttgaatgataagatgcctaatggtaacatttgtttcattcattcattcgtcactttcttgagcaccaacattatgtttagaaggaatgggtttatgtaaatacagaggaggcaaggtgccctgtccccaaagacacatgggttagcagagcagttaaaccagacactttaggcggccaggcacagtggctcacacctgtaatcccagcactttgggaggctaaggtgggcggatccctgaggttgggagttgaaaaccagcctggccaacatggagaaaccctgtctctattaaaaatacaaaattagccaggcgtggtggcacatgcttgtaatcccagctacttgggaggccgaggcaggagaaacacttgaacccaggaggcggaggttgcggtgaactgagatcacgccattgcactccaacctggacaacaagagtgaaacgccgtctcaaaaaaaccccaaaaaaacaaacaaaaaaaaacaataaaaaaactcagacactttagtagctactgttgcaatgtagaaagtggtaggataataggtacaggggcatttctttggggaggagtggttatgaagacaggttacttctggaggctgaggcatcctgtggattaagagtaggggagagcatggttatgaagatgaatcttgctttttgaggtcacggtgtcctgtggattgagtagaagccccattacttgggttcacagcccagctttgccactacctagctgtgtgaccatttatctcagtttccttgtgtataaaatggaataatagtaatgcaaccctcacaggtttgaggattaaatgagttattatatgtgaagtgcatataacagtttacagcacataatgaacattataatcttaggttgtggttatgtcatttttgtgggataatgtgatagaacttcttaggggagattgcatttgattgaatgatgaggagcggaaagatgtttcaggcatttcttgtattgtcccatgtagccacatacctaatttataatgcctgcagtaatgtgtcggtaatgtgtgcttatgtagtgccattgtcaaaagattacaaagggcatttacagacgtttattctaagaacagtcccctgaaacgagatggtttatgcatattcttctgaagtgtgagagggtgcagagcaagcccatcctgttcttccattgaggtgtgcttggagcctgtgtttgttgtgggtaatttagactcacagagagaggaaacttttaaatcttttaaattatatcttaaattcttaagttatatttgcaaacaaatgtggtaaatagattttaaaaatgttttctgtagcttctagcaatagtggaacttgtttattcctgaggtaccagatcataggcagttgaatttagaggaagtttataataatgaacatttgtcgtaactgtgaggttgccactctgtattagttttcacactgctaaaaagaaattcctgaaactgggtaattttataaagaaaagaggtttaattggctcatcattccacaggctgtacaggaagcatggctggggaggcctcaggaaacttacatggtgaaagttgaaggggaagcaggcgtgtcttcatatggctagagcaggagaaagggagagggggagatgccacacttttaaacaagcagatctcatgagaactctttcacgagaacagcagcaaatggagaaatctgtcccccaggatccagtcacctcctaccaggccccacttccaacattaggggttacaattcaacatgagatttgggagggatacagacccaaactatatcttattatcctcattttacagtgaggaaaccgaggcactgagatgttcaggagtgttgctgaaatcaaaaagaagtgttgacccaggatctaaggtctttattgcatttgcgtaaaccatttcatttgatttgtgtgttttacaataaccctttgagaaaggtcagtcagctgctacgtgcattttgggaagtatcgtttatgagaagttggtggggcatcacagtgagcttagcatggactgaaaattttggggtggctgttgtatacccttttgctacttcaagcaagacacttttgggcctcaagatctataaaataacagagtttggaggaaacattgagtctgtaaactatgaaattcttgtgtagcttggagtgagacccatgtgggaatctttggcagccaccgtttaccaccttaacttttctgagcatgttttattattggtaatatggagctgtggtactccctttcttcagggctgttttgaacataatgcttataaaatacctgacagaccttgctagctctcagccaacggaggtgggattcttgttaattgtttcaaactaggggtcatacaggtagctgagcctgggtgagaagtccagcttcttaactcctctggggctggttctcttcagcacccaagccatattgctggggataaggaagacattttaatgagatgagccccaacttctcattagaagctgcagtcctgattctttctctagatcctatcaggttgccagttgatccagtaagtaatgtagtaaatgtaatggatccagtaaagagtttggggttttcatggagtaatttcctaaaatcaccgcagtcagtagcctgtgagccacatgagggcaggggacttgctctctgtggtgttcaccttgtataatgcaaggtgatgggacagctggcacatagttcggagtctggcagtatttattttgtgaaggaaggaaggaatgaacaacctcagtgagctgtagaaaatggtatgagaaagggaacaggatttttaaaatttcagttttgtgggacagaggaaattgaggcactgaatcaggcaggttatgcccagtctctgtggtcaccaggccttaaaattgggcataatttatacccttgaagatgttgcatggcaataccttctggtgggtggatcacctgaggtcaggagttcgagaccagcctggccaacatggaggggaaaccctgtctctactaaaatacaaaaattagccaggcgtagtggtgcacacctataatcccatctactctggaggctgagacaggagaatggcttgaactctggaggcggaggttgcagtgagccgagatcgtgccacttcactccagcctaggtgacagagcaagactctgtctcaaaacaaaaaccaaaaaacatatttctattgtgaaacaaaattttatccatgtcaggaatttcctctgaactagagtatgttcattcctcttttgtgatttgagtctgtgggagtcggaacttgtcaggaagacttagtgtagctgtgcttctaaggatgtgctattctcacaggcagccgtgctaaccatcttgctgtaaactagccacgagtaaacgtctggttgtgaatcacagcgtgacctttcagggaaaacaaaacaagcaaaccaccaaacacatgaatcagattttctttagtatcaggattgtaaagtctggtatttaacagtttgtcaggcccacttggagcagttgagacaacttcctttctctgtttttgtttgttcaagatgtggaagtgtatatccttctttagcaacatattaggataaaaactttaaagttttcttccactgagttaaactatattagttttcctaactgtcatggactttaaacaattaaagattcctggttaccactcaagacctactgaatcagtctcttggagtgggacccagaaatctattctgaagagcaccctaagtgattctatggttaatcagatttggaagccactgagatacagaatgataatattgtattttctatccacccatttattcttttttttttccttctctgtggtccgaatatccatttgttcttactcatttatccacgtcttgagtagattagaattgattacctatagggcattggtcattttaagaactaggcgtagaaacaagaggtagaacacaatgcctgccccatggggttcacaggtggtctcagaagtttttaactttgggttgagtgttaaaggattcacatacttcccaaaagccaggagcagaagattttgtgtacacacttttttttttttgttttaagctttcatcagattctccaaggggtcagtgacccataaaaggttaagaaccaaggtcttgtgcttgcacagctgttctggaaaaagtagaagagggcagtgtttctgttgccacttaagatgtttttgaccttttgagaggcaacagcggtttgaggactgtacctgttttctgtcctacttaaaatatttaaaaagaagaaaaaatagtttaacatctgggtcagggtcagaacaagaccaagggatatggaaaatagttatttcgtgaactgcatcacatttaatgttaaagagctgctgacagccaaacagcctggtggttagcgtgatggaggaacttcttaagctggatagcataggcaaggttcattccagttttcttacagtatataattagccaaattatggataacaattttcaccccatggatatacataaagactaattgtcttatttttgttccattttagccccagcatgtccattgaattgcttaattccaaaataactttgccagccgtacagctgatacattcttctttatcttctaaaatccccaaataacactgttcatagcaaaacagagttggatattaagaaagaacatctttaactgctgtggaaagtgtttactttgtaaaacactagaaccttgtatgtataatgttcttatccctaaggataactttataattgaatttcaattaaggatgttctcttccttttcctcctcctcttctctctaagttgtactcattgaattcatgtttcaatggggaacaaaaatttttcaaatattgttgttctggtaatgctgcattttaggatctggagagggcagtcagtgggattaaatgttatcaaataggttaaattatttggccatttactttggtatagttcctctggagctcaggaggatgttagaggtctttgttgtcagtgaaatcttgtaaatgtatttttaggctgttcaaatgtctggatcacctattttgaacttttgcatataccaccttacattacttatttttataaagtggacattttatctttataaggttttgccttgctggacagtgattatgtgttctaggtctttatagctttgccattacccggcatactgagcacataacagacactcaataaatatttgattaattggatatgttgattgggtacccaagaaaccagaagatgaaataagtctggagttagaacttgatacatgcttagaaaggtaggaacgtaaaagtggattatgaggtctatctcttaggctgacgtgctctcctttctccttccccatccctctccaccccctctcctcccttctctcttccatcctgcctctcctctccctccccctctcccctctcccctctcccctctgccttctcccctctcccctcttccctctctgttttctttctctttcctttccctttctctttccttaattttcttttctttctgttcatatataggtagtagagccagctcacgtttgctagttctttaaaaatcttaagtatttagaattccacagttacaagaattttatggtagagccacaacactaagttttcatttggaaaatgttaaatgtagtgaaccttgagagaggtttttattagttattgcttttatttatttttaaaataagtttcattgtgtatttgtaagatatataagattataggatgcatagagatagtaaaaaggttactatatatagtgaagcaaattaacatattcatcaccttacataggcaagagcagctaaaatctactcatttagcattaatcccaaatacagtacaattttattacctttagtcctcatgttgtacattaaatctctagacctgttcatcctacatctcctccatttccttcctacccctagtaaccactgttttgttctctgtctctgaatatttgaaaaaaatttttaagattccatatataagtgagatcatgcaatatttttttttctgtgtctggtttatttcacttagtacagtgtccttcaggctcatccacatttgtggcaaatggtaagattgagtttttttaagggctcaataatattcatacacacacacacccacccacacacacacaccccccacagtttatccatttgcctgtcgacagatgcttaggttgtctccatatcttatgaataatccttcagtgaacatgggagtgcagatatctttataagggggagatttcatttcttttgggtaaatgcccagaagagagattgctgggtcatatggaagttctatttttaatttctttagaaacctccatactatttttcacaatggctgtatcaaactacattcccaccaaccgtatacaagagttccttttctccactctttccaacatttgttatctttttactttttgatgtaagagctgtcctaatgggtgtgtagtggtatctcatgaaatggcattgatttgcatttccctgatgagtaatgatgttgagcaccttttcatatgtctattggcagttttatgttttctttggaaaaatgtctattcaggtcttttacccatttcaaaatcagattatttgtttttctactattgagttttgtgagttctttatacactttgcatattaactccttatcagatctagtttgcaaatattgtcttccaatttgtaggctgccatttcattggttatttcttttgctgtgcagaagccttttagtttgctgcagccccatatgtttagttttgcttttgtggtctgagcttttgttatgttatccaaaaaaatcattgccaagacaaagtccaggagtttttcccctgtattctcttctaggagttttattgtttctcgttagttagtgcttttaagaaggaaggaggcctcaccagacttgattattattttttttttttgagacggagtctcgctctgtggcccaggtgggagtgcagtggcgcaatctcggctcactgcaagctccgcctcccgggttcacgccattctcctgcctcagcctcccgagtagctgggactacaggcgcccgccatcacgcccggctaatttttttgtatttttagtagagacagggtttcaccgtgttagccaggatggtctcgatctcctgacctcgtgatccgcccgcctcggcctcccaaagtgctgggattacaagcgtgagccaccgcgcccggcccagacttgattattaaaagacatctgctactcaaatagatgccacccttaatctgtcctaatcaagtaaaatcttgttagttatatttgggtagaggaaatattgtaggctaatgaacagtggctgtcaacagttatcttgaaaatctagacttgtagccttgaaggagagggacccgaactgtgaagagatttgtcactaaccatgctatattggatgtaaacctgggagtggttacaggaggtggcttagggtaatatgtgctggcatctttaagtatttcgggaagagggatttagatccaagtggtcactcctactcccattggagacgcaatttggcattgtgtataaaagaagagtttttctaatagtgctgtgttagggtcctgaattccagctgctgccattcaaacaggctcacttaacactcacctggattattctaatgggaattcaaactgggtattggtgacctttgagggctctccctcccaaagagactatgagtgtgtgatttttcagggcaaaatgttctaagtaaatcaagtcatggttcaaagtctagatccgctccttgtaattttttttttttctttttaaagaactcagtcttgggtgctgtttacttcatatttaagcccatggtccccatgtgtattgaactggcacaaactaaacttgtctgctcctctaggtctcttctcatagtctgagttcttaaaattaaggtcagttaaaagaagcaccttggcattttccttattggagtttgctgtgtgtttgcaaatcaaaatgggaattgattcagtcatttgggctatacaggttttcatctcaagtcacttaagtgaaatccataaggaaagatgttcatgctttacctaccatagggctcactcacctcttttcttaaatacaaaacaaaaagcacctgccagttttaagggactgaaaaggtgttttatgatggctgaaaatacatctgagaataataatatagttatacctagactggtgatacatcattacagtatctgcggggaaaagtagagggtggaagtctgtatgtggggtcagtcttaacaaggaaagctgacatgaatgctctagccctgcagtaccagagggcacctggattaatgttctgggccctaattcagcgtcctgtctctcagacacttggcactgatttgctcatctcagagctgaagtcttaaggactaagaggagagaggaacacatcattttctctgccagaggaggtacttaaactgggaaaggaggaggagaccttaacaaatcaagccttggcaaggaaatctgtcatgaatcagcaatgccttggaaagcctctttcgctgtattttacaaagctaaacacttgtcgctactgacatttctctattgcttaccttgaggatcagctttaggtagcactatgaatggaatgaatccttttttgtgtgtgcccattttgacattaggtaattaatttacaactagctcaattagagtccagcccatacagtgtgtacatggccttttaaagagcctttgttttgacgctaattgaactggttgtagcagagacagccaaacaatttgcattcatctttggcagaacacaagggctctcccttggtatggacagccccattttttattccttctaccaagtctggcactaaagtgatgtgtgcttattttatttttctaatttaaaaaaactttgaagaggacaaaagccacataggtttattgtagaaaaattggaagacatagataagcaaggaagaaaataaagatcatacattatcttttcttcttaagacggagtctcaatctgtcgcccaggctggagtgcagtagagcaatctcggcttactgccgcctccacctcctggattcaagcgattctcctgctgcagcctcctgagtacgtagctaggattacaggtgtgtgccaccacacgtggctaatttttgtattttttgtagagatggggtttcaacatgttggccaggctggtctcgaactcctgacctcaagtgatccgcgcccccccccccccttggcctcccaaagtgctaggattacaggtgtgagtccccacacctggcctggagcacacattagcttaataccaagagaaaaccatttacaacctagtatttttctttctataccttttctgtatatgagggaatgcatgcacctgtgtatgtaactgttttcatgtgttgtttttacaaaatgggaacacagcatacaaactgttttgtagtatgcttttttttcctacttaataagatggaagtgccttgtcattttataaaatgttgtcctacaacatttttttttgagacggagtctcgttctgtcgcccaggctggagtacagtggcgcgatctcggctcactccaagttccgcctcccaggttcacgccattctcctgcctcagcctcctgagtagctgggactacaggcgcctgccaccacgtccggctaattttttgtatttttagtagagacggggtttcaccgtgttagccaggatggtctcgatctcctgacctcgtgatccacctgcctcggcctcccaaagtgctgggattacaggtgtgagccaccgcgcccggcctgtcctataacattttaaatgtctgcataatagtcaattgtgtggatgtaccaaaacatatttaaccaatctgttattattggacacttgagccctttccaggttttcgatgttataactagccttgtgatatatattcatgctactaaatctttgtgaagtcttaattatttgcaaccaataaatttctagatattgaattacttggacaggggcatgcatgttttaacattttttatgcatactgccaaattgcaacaatttccactttcagtaatgacagctttatgtttattcttgatattcaggagtacagtatagagagtattgactcagaagtggattaaatcctgatcagtgattttgctattgcccctgaaatttacgtcagccttataatcttctgttcccagtatcaggtgaaagaggccagtttatatcatatagtacaatataggtttacttatcttgactaatatgtgttatttagttttgaaaaattgtagaataaaagcaggtagctgctgctgtaagacaaaagtgcctttgtttttcgtaaggcaggattctgaaacagtgttttcactatgaataaggaccaacctaaataaatagatgaaaatcaaagcgatagtagatggttttgctaagtatatgaaaaaaatatttggatcttcttgaggcagtgaaacccaagactggaggagcaagatgaactgtggcatcttgtatcaggggtggccttggagaggctgttatacctcgtgtatgtggtctatcattgactgaacatttgttatgctgctcatgattgtatttgcagcacctgaaagtgcagttggacaaatagatgctcattgttgactgaatgaataaatgaatagaatagatacacaggagagtgagatttcagaaaaagacctttcaggtcatctaagaccctccccctaattttattttactttattttttgagacaggttcttgctctgtcacccagactggaatccagtggtgcattcacaactcactgcagcttcgaactcttaggctgaaatgatcctcctgcttcagcctcccaagtagctgggactacaggtgcatgccaccgtgcctggctaattttatttttttgtagagacaaggtcttgctttgctgcccaggctggtctcaaactcctggcctcaatcagtcctcctgcctcagcctcccaagtgctgggactacaggcgtgagccactgtgcttagcccatccagttttctaattaaagacatagaagttcagaaagatgaagtgacatctttctcaagactaagttaatgatcacagcagaagttgtagttctctgtatcaatgtatttctgagattctcatagtactagaattgtatgtttttcccttgatatggtactttgtatgattaaatttcaaaatcaatagtaaaattttaatttcaaatgcagtataagcacaatttccctaactcctctttttttcctctgtttggaaatagcctcagtttttgttaaaattcaacacagtcttaaacttgcatttcttttttccttactttctttctttctataatattttcacctatcctatttcattcacagtggaggttttaatttacttcaagcagtattgccatctggatgtcaaaagacattgaattgacttcttatctgtagatcccaataaaggtctcacctgcctagaaacaaaagatttagtcaggaattgaggaggagcaaagcaaaggcttcaccagaggcccaggtgctacctatctgcccacttgttctttgattgacagtggggcacagaggtgccttgtgtttctctaggaagtagcttttgcatacagtgtttgtttggaacttttcaatttgctagtgctgaataatgtctgcagtaaaagttggtttagggtaaacccggagaaaggaattaaagagaagttttaacatttctattgtttttcttctgtgactttagcctttcccccttcttagtgaattattatagagttttattaaaatgtaagttctggaaattagacaccatggtatttagaccagcatgggatactgtactcttaggttccataatatttcatagtacatctctttattgtatgttaaatgatagcgaagtataataaaatgcacctagagagtacttatctattttatgtcctgtaacattcagtacttgatgcaaatgtagcagatctcgattcaaacaggagcaaaactggttataactcaagagaaaggggataggctcatcttgatggaaagttccctgttggtggcataagttcagcaaaaccatagaatttgaggctctaagggacctttgtaacatctactccaatcttttattttgcagatggggaaagaattagccactggttcagtgtcactcagcaggttaaagaaagacctgtgggcagaacctagaacttaacgcctgctctgctgtgtcttttcattttctgatcacaattgaagcatgtggtctaccctgtctttaaaagagcataccatttgatgtttgttagcttgaaacctgttgtgcccaagggcacctaaaggcttccgtcttgctcccttttcctggatgcccaggtcattctgtgcctctgagggtgggtttggatatggctgaaatgaaagctgtgttgtggcagtgcttagagaattgtctctgatgataggactcttttaagaaagcagtgaaaaagcagtaaggagactgttacttcataaaacaattggctctggacttggagaagacccaggtggcggatggttacatcccttggcagcagctgtctttgctatatctcttacagtcttagagatctgggagtctttggctcttaattttaacctagattcactgtatgatcttggtcaaacgcctcacctcttgggcctcagttaccttgtagtaaattcaaggggagttaaagtggatgatttctatggcaacttccaggccttgaattattatttttataaaagtttttccacatgatcaagtaaccaaacatgtattgctgacagtccattttattactgttttgattggttttcatgagaatttggaaaatgtctgcagactttactgtgatcaggctgctagcaattatttacagagcacccatcaagtgttcagggctataaaagaaatagtgtctagcttcagggagacagaaagacttcttgatctccccagccggggatggagggcattctcttccactggatttaagctctgtgagtgcaggggctttgtctctcttaagtagtgcacagttcagtaaacattggttgcattaatgaaagaatgaatccagttgtcagtcttgcttatatttactgaagatatcccactgagatttattggtttcttcaacccgtaaatgctgctaacttgaatacatttcccagaaagtattccttaccttccatagaaaaatgcggccaggatgctctgaggctatagggaaaaaccataaatattccactcctttcttgaaattcaatttaatattagcatattgaatgccctgagattacctgccttcaaatattttggtttaacccagcatttttgaaattcatttgacctcagaatattgttcattccactctcccatgacacacttgttaatatcccccagaactttgatttgtaaaataaaaaggttgatatagggagtaataatatggaataaatagaagcagcaacattagttaagaataattaattgaacacaatggagcatatacattaagtgctgttcctagcagctctgtgtgaaactgtggtagacttgtagattttttttcttttaaaaatgactatctatgtctcattacagatacaaggttgggtggtagagagattgaaggaagttgcaagtgacctaatagctaatttacagttacggaagttgaatggtagcattttaacttgtgtcaagggctgccctgtcaggtactgcaggggaataacgatgaaagggagtctgtgtctgctccttctggagctggctgtccagtggaggagacagacatgtaaacagattatagcaataaagtactcaaatgtgtaatgaacagaaataggacacaggaaggaatggtattttcccctggtttagaacagggttgctgttcatacaataagcccaaaccacattaactggaacccctctagatcctccagacaaaattctactcatacatcaagattcaaacaactcggcctcttcatgctttcgctgatccagaattaattgcatcatctatattgcctgcagagccttgcttacacctgtgtcataggccttatcataatctgctttgtatgtgaattacttgagggcaggatagagttgtctttgtccctgtatctctggggcctgcagttacagcatggactgcatattcgctgctttgtttagacttggagcaagttattggactgtgaaagctactcactttaagtaaattcagtaaataaaattatgttttatggaagacagattggacaggtggtggtattattagcattttctctcaatgcttaaatatgatttacatttcaagatttcagttacattttttaaggaattcaacaattctgcatcatgaagtattctttcacacaaatgttccatagtcattagtttttacagaacccttttcttatattctgcatttcatctggaatactataagcacaagttcagtttggcattctgttctccactagtgattgagtttgaagcccaaggtcaggatattgattgatgacatttccctttaaagtatttgtatccatttgcaatttggggacagagtgattcccagtatggtgcaggaaataactaaactggaagtcagcctgactcagttttgtagttaattttctttgtgaccttgggcaagtcacttaaccttccaataactgagggagttggcccagaactagcacagtcttctaatgcagacattccacgattctctagggaggattcacttccatagaggtttaaaagtggatacatttttaggttaaatggctttgttcatttagtttttttctccttaacccattttggagcaataagactgtcatggagtaaaaccaaattacctggaactctcaaaaggctgcagttcttatcctattttttttatttttaagggaagggaaaaaaatggcaacaaacaaatttatatccatgagtcaggacaaatccatcccagttttctaacatacacagtgtacataaacatattcaatgaagcactgcagattcttaaccgaaaatggaatatttggtttgacttaccatcctaaatgtgggaagaactgtactttgatatatactttttgagtatttttagcaaaaattgatataagcagttgtcttggttggcaaggacttgtgtataggaacctggctcccagctcagtgacgagtgtattctgtaactttgaataagtcactgaacctttctagatgtcagtgtcctcagctgttagatttgatactgttctgattactaacagatctgtgattagacatttccatgcatttatttcaggcctcttcctgttctcttccttgagagattaacaaatatacccaccccttccctcacacagtctcaggcaattattgatttgtgagggaaaaggggtattttaaaacactttaaatgatacattcaagaaaattatctcgtattggttatcaattgatatataacaacattaccacaaacttagtgccttaaaataatacacatttattatcccacagtttctgtgagtcaggaggagtctgggcacttcttagttgggtcctttgcaaggctgcaatcaagatgttgtcctgggctggggtctcacttacacgcttgactatggaagcataagctactgagcccactgtgattgttggtggaacttatttccttgcagctggaggactagagggacttaatgtttttgctggctaggggctgccctttgctccttgaggccacccacatatccttgtaatgtgtgcttccctaacatggctgctggccccctcagaagcagcaagggagagaacaaggcagtgctgcagtcttttggaatgtaatcacataatcatgtatacataatcatgtatgtccatcatctttgctctactctggttaaaagcaagtcacaggtccctcccacgctcaaggtgagatgatcacacaagggcattgacaaccaggaggcaagggtcatgggggccgtctgaagcatctgtcagccacaccatatttcaggttttttttttttctgtatcttcctttggatctgtgaataagtatctcacttcatactaaagcctcaataaacactgattgacagaaagtctttgtgctcatttaaaacttctcagctccacagagtatttgtaccatgcccttgttttatggagtccccagatactgatgagggcagggtttgagtttgagggctgttcattcttctgcccgccaaccccccaccccgcccccagcacagaactgccagtgttaggtgctcattaagtgtttgtcaaaggattataactgttgttccaattgcagcagtaagtaaatttgaagaagctccctgatattgagtgaattgtattctccaccccccaaattcgtatgttgaagctctaacctccaatgtgatggtagtcccagctaccagagaggctgaggtgagaagattgcttgaagccctggagatgaggctgcagtgagccttgattgtgccactgcactcaacctgggcaacagagtgagaccctgtctgtaaataaatatgtgtgtacagacatacataaggttcacaattcaatttaaaaaagagaaagtgaccatctacaagccaggaagagagcccccaccagaaccctatcatgctggcaccctgatcttggatttccagcctccagaactgtgagaaaatcaggttcgcctgtttaagtcacccagtctttggtatttcgttatggtggcctgagctaagacaggccctgtgttctctgtgtagcaagaggcaggaagctaagcacaaaggttgccagatagcagggactggctggctgttagtgagccagggccagtggcatttaattgcagtcattcccattctttgctgagctttggtcataactatttgtagaggacccctagactttttttttttcttccaggacaaaagtgatccaaaacatactgtcttcagtttttgagcattggactaccaaacaggaacatttaaggaaaacaaaatgttgctgttgtaaagccttgatggtgggaagttatgtagtgaattctcaatttcttcttcctgcatcttgtcttaaaaaaaaaaaaaaacttttaaagtttttgtttgttcatcattcattcattaataagtcaagatgtagagggctcagtagccttcccctagttttctacatttctgactttggtaaacttcctttacttctgcaatttccctaattgtaatattaacatatatctaaaaagaatacaatggttatgtaaacctcctagcacttaataggcactcaagacaatatgacttaactgtataagaatgactaatgtgctatgtttatttatttggcttcattcattttgccagcaatggtgtagtatatatgtagtatatattaaaaatctcttgagtaagagaggtttggaatgggaaaaggaaccaagaaaatctcaccatctttcttctgcttggcagcaagtcttgaattctgttttatttttcttaagagacggggtcttgctctgtgcccagactggagtgcagtggtgctattatagctcactgcagcctcaaactcctgggctcaagtgatcctcctgcctcagctacctgagtagcggagactactggcacctaccaccacacccagttaattttttttttttttttggtagagatgaggtcttgcagtgttgccctggctggtgtcaaacttctgacctcaagtgatcctcctgccttggcctccaaaaatactgagattacaggcatgagccactgtgcctggcagagtcttgaattcttcaacagggcttttgaatattttaaagccacataaaatttcctttttaaaattgcaatgaaaattgtcaagtaaagtgggtcattttttgacctggtgcttaattgtacttagaagcaaatgcatatctgtaagtaaggggaggactcagaagtgatttaaagggaggattgtaaaagagtttgggaagtccatccctttcattttacaggttaggaggctgagggcattgtgcaatgatgtatagtcaggtagagagaggaaacaggaatcataaatcttaccttttgtacaaagtcaatgttttcagtaattttgttgaaaacaaacattaaacaaatttggacctgtaaaatccattgaactggtggaggtcagcctgacctagcaggacatgtggcatctctgttttgtgatgctgtatctgctttgggagtcccagtgcccaatcccctcagtgttgaaaacttagctcctgagtttaaggtggtttctgtggggttatggggcagggggagagggtttggaggaggggaggagcggaaaaagagacttccagtctggggctcctgctgtgttaccttaggggatttagggcctataaaaaacacatttacatctctgaatggcaacagataaataccaacgagcgttaattgaaaaggaggagacccaatggactagaggtcaggactctacagtgatgactggtggcctgggggtgtcagctgaaacggtctggattttttttttttttttttctccttcttcccctacctccttcctgggcttagaaatgctggaaggaagaaggagggaccattagttgaactaagaggtatgttgtttatactgttgttgtggttgtccctgggtggtctgaaattttggaggagggggtagggaaaggccccctaaaccttttttaaactagtataatacaacctgactgctacctgcagtttcccaattacccaattataacacaaatttgcacatttttttaaaaaagcaggctgctactgtttctccttatacaaggattttagtcactgtacatcttgtgtctttaaataatgtattaggaacattttcaagtctgtaagtgcttttttaatgagagtgtgaagattttaatgggactagattgcttttcatgacatttcagagtgacttaattgtaacaatgttgagaggctgtattttaaagtttgctaagtatgtctgtgtggattatagtcagacacttaaaaggacggatggttggatagtggaatcagatagcttttccttactactttctccaaatattagctctttgcaaatatggttataccaaaccaggcacaggtcaggattctcttaaaccttttaattttcagataggaacagaggctaataacagaccaatgtgggtaattttagagacaatttccttaaaacttagttggactgcaatattggtcctaaggcctctcctctctccttttgtagacccaggaggccaggctgtctttgtgtatacttcctgttagtccctgaactctcttccctgtttgctttaaaaacatagtgaccttgaccgggtgcggtggctcacgcctgtaatcccagcatcttgggagggcgaggcaggcggatcacgagatcaggagatcgagaccatcctggctaacacggtgaaaccccgtctctactaaaaaaatacaaaaaattagccgcgcgtagtggcgggcgcctgtagtcccagctgctcgggaagctgaggcaggagaatggcgtgaacccgggaggcggagcttgcagtgagccgagatggcgccactgcactccagcctgggcgatagagcgagactctgtctcaaacaaaacaaaacaaaaaacaaaaacaaagcatagtgaccttgtgcctcatttttttttcaggtatttgagttagcgtttctaaagcattatgactctccagataacagtttaccgttttaatgattggaatttcagactcaatttttttcttatctccaaaacaagaaggttattcagaggtcttttcctatgcaaacattattaggattctagaacctgtggcagacttctcaaaattagatcaaatggtcagacactttcactatctttttttttttttttaatggtcttgctctgtcacctaggctggagtgcagtgccatgagcattgctcactgtagcatcaacttcccagggttgagtgatcctcccatctcagcctccttcctgagtagctgggactacaggcatgcaccagcacacctagctgatttttaaatttttttctagagatgaggtctcactatattgcctaggctggtcttgaactcctgggctcaaacaatcctcctgcctcagcttcccctaagtgctgggattacaggcgtgagccaccacgcccagtctcctcagtgccactcttaatagaagcttgtattagtttccaaggctgccataacaaagtatcacaaactgagtggcttaaaacaacagaaatagtctcatagttttggaggctaggaaatgtgaaattaaggtgttggcaggaccatgtttcctcttaagcctataggggaatctttctttgcctcttcctagcttctggtagtttattgacagtctttggcattctttggcttgcagctgcataatttcaatatttgcctttgttgtctcttagtgttctccttgtgtctttacatggccatcttctggtaaggacatctgccctaatccaccctaatccagtatgccctcgttttaacattggtgtctgaaagaaccttatttctaaataaggtcacattgtgacatactgagggttagggctttaacgtatatttctgaggggacacaattaaacccataacagagttctactttgaaaagtgcctaggagattctgatgcagcctgcatgggttcccaaagcatgattcctgacctatctgtacataattcatcaagagcactaacaaacttacaagacatatatgtataatggtatataagtatgagtgatatacagaagaaaaataaacccaaaactcatgtactcatcaccctgcttaagaagtaaaacattaccagtacctttaaaggctctggaaagcctggggtgtttgtttaaaacataggttctcctctgaggggttaggtcagggaggtttggagcaacaatgtgtattagaattcagtaactttaaaaaaaaaaaaaactccacgtgcattttaaagttggtctttaaaattttactttggagtgggatgggattttttttttctattagcgaatagaaaacgtgcaagaaaagatgtagtaacttttttcatagtgtagtagaacagtctttggctcctcttctttttgtgaggtttcttgagaaatctcacctgtacttggtataattttccaaattaatttagatctctgacccagagagacttagagtgatgcacagtcatgtagggggaggatgtgtatgtgtgaagggacctgttattgattatacgtcttacattcttgcctttcttgtgggattttgtgaagattaatatctgccagataggtttaagtttgcaaaatgccttgagttccttgggggaaactgttacataaatgtaaataaattatgcagcacctgaatttggttgttcatcattttttatagtgtgttttaattaagaacttagtgctatttaagttggatggctggggagagggtttaatcactccaagatggttaagtaagtaggtaggagcaacatttaggctggaacccatggaggaataaatgaacaagactggagaccagtcattttccatggcatttgctgagcggagctgtggattaatgtctcttcttgtacgtgtgtacatggtgctgttagaaaatcagccagtttttcactacactttgtctcggacctgtagataccttggacctctctggttttcctgagtaagctggaaaccctaacaacagccaaaacaaaacaaaaacggagtttgtcttacagtctaggtacttggggagcaagaggcatccagcaaactgcattggcttttggtacactgtgtttctgtagtccaatgagctgggttccaaactacctccttttgcctgttacatacagctttgtgttccagtggatgatactgttccttaactcttaaagagtggacatacgaaacagttgccaacaacccgtggtccagttgtgcctcctttgtttgctgctttgtcagagtctcactgtatgcttttttttttggcctttggcgctgtgagcagagtcacctcatcctcctttccgtggccaactcaaagacttacaacctttctccctcattcctatgtatctacagaacactcactagttgctaactagtggatacatgtgaattatgttttgatgccatagggctgtctagtggaggatacaaacattaaaaaaaaaagctaaatccagcaaatagctataattagatgagggttatagagaataaccacagactctttcagagcatataaggaggcgaatctaacccagtctcggattctggcaaattgcttctgaagagtgactctcagcaaaatctggaaggatcactgggaagaaattagcaaggaaggaggaagaaaagagaacagtgccttctaagaaatataccatgaagtcatttttttcctattcctttctctgcccttttccttccccacacagtcttatgcagcagcacaattttagccatccaaactgggccagttgttttgttacactgtggatggttggagattgagagctatgggaatgggtaggagttaaaaactgaatataaattaggtgacaagagatggcaaaatcatttattgggatgattaacttattaaattgggctattcccatgctgtttttctaaaattgtgctctgatggccattttggaagcctggtactacccacagactggagtatgtcctaagtaggttaagagcttgggaaagatgcttgctgagggagggccttctttgtactctttctatcaataagaaataataaagagttaaagcatcgttacattttagatatactttctcaaactgctgacatcagaattgccaggagcctgttaaaaaggcactttctgtagccttcctatcccaggccttctgaattagaatcttagcagtaggattcctggccactgtaaagtactctattgaaggcgtggattaccagtgggttattcagaggagaactttcatcattttagccccgtgggtccctgcctgatttcctgccatctctcactaccaggaccagctatgtaatttgtgaggccccttatttaaaaagaaatattaggaatttcgagacagtgatggtagagcattaaaccaagtatggggccctttctggatgtaggtccctctgggattgcacgggttgcaagcccatgaagatgttcttgttcaccattcctgtttgcctttttaaaatgctcctgcagtaatgaactgcttattgctccctgtgcatgatactgttttttgcctttgtcccttgggtctcactatgtggcatgctgtgtttcatctcttttctgtcacctgggcttacctcagtttttgcacatactgcgttagaatcctgtgcaagtcgcccgtgctatgctgtgtgctttgagggcccggatctgctcttcctcatctttatattccctgcccttagctgaggctctgccttggtcttctgttaagtgtgctgaaagggatacttttttaacctgaatcttttcttaaaacctaattaggttataggccattgggaatgcagatttggttcagagtgaggagttggaggctgtgttgccctagtagtgtcgtgaggactgcctgggcgtgactggtctgagacagtgtgaggaacggggtgtgaaacaaacttatgacatctctggcaagtagtgcatactctgctgttgacacctttgatagctgctaccctctgataaccagtgtttttttttctggatctctcattgaactctgagtttctgggaacagcagatttttctgagccacaggttcagatgtgttagcagaacctgaggaaatgtttcttgcaccaggaaggtggccattttactccgtggctaatatttggaactagtcatttctggattgtttgaactagcgtgttctggggaattccccaaagctggacgcacttgttaaatgaggttatggctctgtggggtgagaaatagacccgcctactatacttaaaaggactgactgtgtttctgccttcaggtaaccagaggtagttatgaatttgggtgaaacctcttcatctcatgatagactagcaactagaggttcagagaagttacacagaatattcaaggttgattcagatagtgactgaattgggactagaatccatggtttctattctgtggattttgagtaagatcactaatcaacatgtgaaatcttccttgtgtcattcaattagaatttaagtgtcaaatggatggtaaaatcatttcttagcttatgtagatcataaagattagcaaatcaaggcagaaaaagacccccacacatatttgttgccaggtctgcactaatttctggataaaggttagtatatatttggtctacagggtgtgatttgagtgtaagttttttctttagtttttagattattgttcaaagtccccactgacagaatgcagggagacagccttgattagattaggccagattagattaaatcgaatggttaaggcctttggagcctccagcttgtaggagacaccataatggccttcatagcgtccttaaatcctattaggtaagttaatcttattgaagatttcaggtctgcataaagcagtattgctcttatactctctatggtgggctctgcttgttaaggtgagcaggcattttaactttccgggaataagttggttttattggtttggggcaagttaatctaaataacttgaaagtagacacctgtgcctgatagagaggccattccatgtagcaaaataggctgtctcctggcttcccctttgcttggtggctgttagtacctgtgacagggattttttttctttgccctgatttggggaaagagagtcaggtgagatgtgtaataataatgtacggagacagtagtatggttatgacactgaggcactactagatattgagaataaagcactttggaacttaggagctggaagcattcttagctgtcattttttgagtgtttatagttttattataggtgctagttggctcttgcctgtttctacaggtgcagtgaccatttttctgaagcaaaatattcttgttgtcacaggcttttcctcaatttgtgaatttatggacctgcaaagttttacaaacacatgaattatgtcaaattttgtaatgtcttttgaaaaaaagggggaaaagtgtaagaaatttagaccatgtaggtctgaaagtatgcttactacatcgatagtgggggctggaggaactgtgaaaaaagtaatagtaaatttccttttttagatctttgccaaaggtagttttgttagatataaacaacttcaagacccacaagtgactactacacactggattggccttcagagatactgggattttctttccaagtatctttaaaaatgaggttcgtagtgctttagctaggaggctgagtgcccactattaagatcctgtgagttaattggtttggttcacaaactaactcatattgcagtgtatctggctgttttgtggctgggagaaggttcctgcattgaagggactgaagtgacactctgaccttgggacttccagtgctgttgtggagtggggacttccttcttcatgtgggcttgctggctcttcatttattgtcccacctgggctctgcctgttactcttctcaggccaagaagtgagttaggttccttatttaacttttctaatggggcagctctgcatctgtgtcctgtccccaaagactaaagagaaatttcaggtgtgggccagattatggagcctgaagaacagttttatgattgattaatggttttgatttgcttttaggaagaaaagtgcaactagcccattggatgaagatagtatctctctccagcactcctgtatcaagtgtacagtgttctcttcctgtatagcacttgtattttcaagagctagggtcattgagagaacacttctcactcatgagtttcagagcgtagcagagtacacacacctgaagcaagaaatgtaattttctctaagtgtactaagaattactttaattctctgtatgtgcatgcatgtgcccacataatggtggtgggtttggttttttttttttttcatgctccttgaggagaaataacccgttttttgcttttattgattcacgattacctacttttcagggttacctttgttaggaagcagctgctggaagaatgtgtgctcattttgtacttgtgtcctttacttctatgtcctctctgacctgaggctcaccctgcctgccacctcctctgcatcagcccagctttgttcttctgggcctgttgtttccactctatgaagagacctccttacttctctctgtctctacttagtatccatttctgctgaggcagatccagatgggcagaggttggggagggaatttgaatgaggggaaaaattggatcagttaggggaaatttataaaacttctgtattctgtgctaatagttctcagatgctttggaatcataagacgggatgttggtctggcgacctttgagagctgctcttaaccagccagtggacagctatgcttgctttttcttcctgtcaccatctctgcttttcttgcccaatttgccaggaagagtccaccaattcttcataagcccactttttattctctcttttgaagtcatcttgattcacttcctacacctgcagcccccagtcttgcttgatctagctcctaatcttctgcttccctttgggacagaggagaagctgctctcctcgccatgctttgctgacatctccaaggggaaggagagcacaggccctttcatatcctgccccagaccttcacagggagcagtaataatgcctaaaccttattgagtacttaacatgtgcccagcactgtgacaaacacttcacacagattatctcttaaaatattcaggccagcccagtaaagtttatgtactgtcattgtctgtcttcaatttgcagatgaggaagttgatgctcagggaggttcaataacatgccattatgtacacagctgaaatgagtgatgcaatcaagattcaaactaggcagcccagttccagggctcttgtccaactactcagggaaaggttttcgaggtcactgccaggatagctggacttgtgacggttttcctgtttgagatatctacccttttacatcaacctaagcacttactgtctttatattttcaatgaactaagtggggtgttctgggtggtctttgatgatggcaactgtgtgttttaaagaaccagaaagaaaaatgtttagaggtgggcttctttagctgtagtccctcttgactgtgtggtcaaataatagggctcctgacaaggaaataaggctataagtgctcttgctttgtaaagattagttaattggtagaggttgtgtttctgtggttaatttgtgctcctgtcttagcaatacatgagtatccacaggcagcaagtgtgtcgcccagcagccccataaaacaaggcactcttcagcaccagcatcagttgatgcacctgaataacaatagggaagcttgttgaccatttggcacttcacagcctagtaattagaaactgtaaaacaataatacagacatgaagcaaatcctccagttaatgaaaaaaaaatctacaatcttgcattgtggctgagtgcaaaatcacaaccggccgcttatacagcaaagcaaacacttcaggattttggcagctgttttgtggatataaaaagctctaggctctgtattaatttggggcctgtcatattttttaaaaactgaaaacaattacctgactttctagttttttgttgttgttgttgttgttgtttttaatttactgcagtggttctcaaattatggtccccagtccagaagtgtcagcgtcatctgggaacggttagaattgcagattggtggggcccaccccagacctactgaaccagaaattctggcagtgcggggcacagtaatttgtttttacaagtcctccaggtgattctgatggactttaaagtttgagaaacactgagggtgtgggaagggtaatttgggggaagggaagtggagtcccctcttggccccacccagagatgagcttctctgtctagtggtgggatagttggcttgagatgtgatattgagaatatatgaaggctccctactgggtcaggaagttgggggagtgtctcaggggagggccgtgccttcctggggacctgtttaggagaagggtcctgggcagtagcttgttactagcctttcgggaacaatttcaatgtttcagtcaccctctgggctgttgtactattgcagtcagccctgctaggcccacaagttgtatggggcagaggagaagaggcatggggacagaaaccttatatcccaggcaaagccttagcaatgctgctgatgtcatatgctcatcgttgtcaagaattgaaaattaagatagtgatgaggtggtggcaggacaaatttcttcttttcactgtatgtcccctttctcttctggatctcatttccctgcctccagctatcttggcagatgggattatttaataattttcttggggcctgttggcaaatggcccctctgccccttccccagtgtgtggtgaccacaacagtgacatagcttcatttcacagccattaggaatcttgacgcagctgacccctagatctcctggaaaggcctcttgggaaatataagcttgccaccagagtgaagtgaattctcgagtggtattaccacagaggctcaggttcctgatgctccttggagtgctaggttaacagtctctctgttggggaaaaacttgatacaaatagaagatttgctaattttgctcacatttcaaaattgtttaatttgcttactttttttttctctttcagactattgggttttatctatcattccttttattttacaaaaaagaacatagggcatgttggccagataatgtatcctgttttttgatttaatcacccaacatagcatgggaataaaaagctgaatgagatgtagccttgctcctccctgacattgaagagactggcttctgggagaggaaaatgaccaagaaaagaaccacccagatcttgggttcagtttattctctctgtattttcaagtggcagaacttgcttgaatatgtgaatttgatgttggatcacaagcccaacatgtggcttctgtgggcatatgtagttattttggattttattttattttaaagggtctgtgtcctgttggcttttaggaggtgatagttgctgattctcctttcatgtgacattcagggctcatggagaagtcaaaggctcacactggtgttcaccttcctggacttcaggaaagatagtccttttgccagatgaatgggaggatctaagtctgttagatttccatgagtcgtgcagcctttctggatcgggacaggaagactgacccactgtccttcccaggctgcctgccgttcatcttgctttaattaaatacacagctgatgatgtcagcttggctcccggctccttcagctttcccctcagaacaaaacatccgggcagacagttgtgacaattaagtctcaagacccaagcttagtttgttctgaggtagttaagataaatctgcctaagcatctccaaatgcagataaaacctagtgctgattagaggtgaccctctaataaacctgatttgattaggcagaaccagcgaggtgcaggcaaatatttgagactctggccaagctgatattccattgacctttcacttaggggaaaaaacctgtttgatttttttcctatcccagagtacttgaaaattattacctatggcagctaaagcactagggcgaaataaacaggtgagacctgtggacttgcccttaagagtcgcagtcagctaccacctgggttgtgcttgcttcctggcagatcagtggagaatggattttgccggaggtcctggcctggaatgataattaaaaaggatgtttcagaacacacccaggtgcgttctgataaagcctgagcagatgtgggtggtgaaggattttttttttaaagtcaaactttgtttataaaggtaacttctaacaatttattatagaaaagtcaaactagaattgcattagtttgtttatatcaagacctcattagaaattaaggagaaatttccttaattgctccatctctggctcctgtaacagtgggcatacttctcttcttagcatttatcacattgttctgtaattgttggtttaccttcccttttgtcttaaaaagcagggaaattgtataattattcttgatgttgctcaaatgcttggcacctgggccaggtacagggattggcaaagtttggtccacaggccaaaccaggccactacctgtttttatgcggtcatgagctaagaacagtttttgcctttttaaatgattgaaaacaaatcaaaggatatatatttcatgccacgtgaaaattatgtggaatttgaatttcagtgttcataaataaagttttattggaatacagccatgctcattcatttacgttattgcctttggcatcattttgcactacaacagcagaattgagtagttgcagcagaaaccatatggcctgaatagcctaaaatatttgctatctggcacttcacagaagtagtttgttgatccctttcctattatatagcaggcatatagtgtaaatgcttattgtttgaattatttcaaatataaatctgagtttacaaatagagttattctgatcctaaaagtgttcagtgaaagttagatgaatgactgaccaatctatttctcttgttattcatttgtaaccttaggtttaagttttagaggtagtggttcgtttattagagctagacaattatatactatttctcttctgagaaactttataaagagttaatccttattacttttctaggttctgaacctactatatgggatgcagagacaccaagaggcacagagaggttaaactgactaagacacacagtaaagaaatggcatgactcttcatgtcttcatctctttctttgtttgctaaagccattctttgtgatgaaagagaagtcaaatctggagatattcatgagcaaactactgtctgatactatataatgcattatttcttatagacatcagtatctttgtaggctctttggttcattaccagggaaattcatttaaaaaaataataaatatgtggtttaaaaagtaaatactgcagagaatgatagcaattaccaaatgtaaacaatgtggcctttgagaaccactatgaaattgtttagtgaattaaattattatgcttttgctattcacatatccacttccattgactgttaaggaatatgcttcaaggaggacagatgagatataggtaaagtttatttttaagatacttaggtaaaacaaaataaaccagcaactggcagatgtttggtgaccttgaaatctggcttttgttttgagacagtgtctttaaaatgaccagtgccacaaatgtaaacaggggagttggagggcattggagtattcaggaagaaagtgagaaatcagtaatttgtagaacatgactaactggaactattgtttggtctgctggggtttgagggagtagaggaatttgtgaagaaggaaagaaggttaggagatgcatagagcagagaaacaagggtctaagctttcctaggaatctcaggtcagacccttgttaaattttgtccgtatattcattgtttgctgtggaatcttttaggagagtgtaatttttttttctgtttttctcttattaaataatttaaagggatgacattcagggctttgggaagcaattttttttttttttttcaaaacgccgctatacctactaattggatatccatcaggggatggatacttacaacagctctgcatgatagggataatattcctattttatggatgggaaagctgaggcttagttgtttttttttttttttttttttgagatggcatcttgctgtggctgaggcttagtttaattggctttcccgaagttttacagttagcagccagagccaagtttcaaacccaaatctagctgactccaggggccttctgttgtttctactatcccacttcctcagtggttgcatcccagagatttcatcgtttggtgcataaatccagcctaaagccatacttcaccattttgtgtgaataaatctcttcctcattttatgactcagctacctgctttctctttctaacctgttattttgtacatctgatttgttagcttcccatgttcccttagcttccctgcccttagttgttaacccttttgatcaatatctagttgattttgctacttaataacagactttagagggacttcagaggataaaaactagaacctccaccctactgaaaaattacatttggtttgccgttggtagtatgtgccccatccttctgccctggcactccaggggaatcaaaaaggaagagctgagaaacagcattccaggcttagaggctccacattctttgggtttgttggaagacttcttggcagcattgaaagatgcctgtgttttcatactgattttccatcctgggccacctgctttctcccttcctgctgttttccttttgtacctatgtggttggtgcttctggggctttttatagcagctttcatcatttatactactgagttttgcaggcgcttttcttttcaatttttgatgtttgacagtatagacttttatttatttatttttaatatgttcacttctgaacctttttagacttcatggtgacagcctccaggagaggaaaaacaaaacaagggaaattctaggaagaggcagaaggtagttactattgatttctctggatgcagatcctaactgttggcaaatttaaaacttacttattttgagtggaggtggttctgtgttagtgagaagttgatctggaaaagatgctgatttggacatggctgttgtaaaactaatgatgaagcaaaacaaaagaaggaatagtgcattttggccaggcatggtggcctgtaatcccagcactttgggaggctgaggtgggcagatcacgaggtcaggagatcaagaccttcctggctaacacagtgaaaacccgtctctactaaaaatacaaaaagaagttagctgggtgtggtggcgggcacctatagtcccagctacttgggaggcttaggcagggaatggcatgaacccgggaggcggagcttgcggtgagctgagatcgcgccactgcacttcagcctgggcgacagaggaatagtgcgttttcactttttaaccttagttgcacagggtatgttgaaagctactgttggcttcaccatgtcattgggaagtgggaacgctgacaatcaaagcagctaaacaagaagcaactcaggaattatgacattggcggcaagtcttttgcccctcttcagaggtaacactactagatctggagagagttctgtacattcagggaatcttcctgatctctaaaaaatttgagaggactagagaggagtaaagactggaacctggatagattgatttgtgagggacaaagattcagagaagacattttcttgaaggtgatgaacctgctttaccaaaatgttgtaaaaattctaaagaaaagttaattggatcaagttgacaataaatgttagaagggaaaaatcttaaagggtaaaatttgaaagtagaaagtttgtcctgtccacagtgtttgccatttcatagaccaaggtggttgggggaggtggggcaaaattactgtagtttccagtgatcattgccttctctcggtcctataaatgcaggcactatttagcactgaaaccatctggtgttggtggttgtttcttatgtcgtatgacctgcctctataaatacattgtgtataagcttaactgggacagtaattggtgtgatccttttctttttctgatctctaaggtctgaggcccatgaccaagggaaagagaagtgctttttaaaaaaacggacacttttgttgttttggtctcatggtttcactgaggtagtgttccacagtgtaagacaggttaggattgtatgttccagaattatgaacaagagtatccttgggaatgataaaaaccatgctgcagtgttgcatgtgtatttgtgtgttccatgtggaagaccttctgggctgtgtctgtctttgctatttatttatcacctgaaatggtgctgctcaaccactctgtgacagtgttattttaacttgaaatagcatgagggttaggagaaaatacctcatgaatgtgaagggggattctcctgggcgtatgtaattgcaatgatttgaaatgctttcacaggtttgtaggagagggtaatttttcttctttatttgctccttttatcttgttctaaagccagtattacctcctctcccaccgcccatgtatacttcttattcccttctccttccccctccctttctcccactctccatgtaaagaaactctttcctaataagaatcataggtattcagagctttttttttttttttaattaacagttgatttgactttttagtactgtgtaggagatgggaaaagtcagggccatttgatagtaattgcttcctggaagagccgaccaacttattataagggtgaggagtgtttggaggcattattttctggttccaggtgtgttttgagtattgctggtggtgctcagcactcttgacatttggggctggattactgcatgttgcaggagtatcttgtgtattgtaggatgtttagcagcatccctggactctacacaccagataccagtagcacccctcaagtgtgacaaccaaaaatgtctccataggttgccaagtgagggacaggatcactctggttgagaatttctgccttagaaagaggaaaatggattccctggaagcagaggttagccattaaccttatagggctggagccttcatttaaatgctttggtatattgaaagcaccactcaagtatcagtggtgagggcacatttagcttgttgaaattcctgtgtaattcataaatatcatattagctcttggcttcaatttcctaacactagaaatgtagatttttccccttattttcaaaatgaggaggattgtagtaaaatatagtaatctctgaggtcgctcccaacccttacattttatgattttagttataacagacatcttatggaattacacaatataagagttgaaaatgtatttgtgatcatttagccagccctcttctgttagttctatcccgtgtgatttccacaaatagatcagaccagaagaaaatagttgctttttacaagtggatgttattaaatgctcatatttagaatatttatcagaacagacttatattacagtgtttacttttctaactgattgagattcaggtgacttaactgcctaagcttcaactgtctgttgtttggaattaggcttttaaaagttggtctttatattaatattcctatgcctaagctggtactcttattgtcaaatagctttatgctctgttacattaatgagggaaactttgactttccagagtgccttggctgatatattggtgttaaattggtaagctttctatcccaactgctttatttatgctttaaacataaatgaaagcagagaatttttttttttggcctgagaggtagttaagagggaaatctaataccttttatgggtttatatgcttcatatgtgatgtgcccaaccagaaataataagatacaccccagatgtgaaggtaccagctaatataattatgctggagatcattttcaccttttgagggctgaattacattgaattcatttcttcaactctaacaggatttggtatagttacttaaatttgaattgggagctgagatgaagtcccaacacttgtgcttttactggaaggattgggttgtgtataccttttgtatttctgaagcttgataaactataaagccttgagtattcaggttcatggcaaggtttagatggatggggaggtatactctagtagaatctaacagcttagtatgctttctgtgggctcttgcctggaaacccaatctgaaggtatagtgatcagacacaatgctattcttaagccttcttggaaataacaggtgtcttagcctgtggtaaaaaggtaattttgcatgtattaaatattcaaccaagggcatgatctgtgcttattttggcaaacaaatagatcccaaaatgaatcaaacaaattgtaatgcagaacaaatttaaatacttgaggatttgttttagacatttaaactcatattttatcctctgtgtcttcatagtaccctcagaaagaaaagaatctttggaaatgtcagtgaaagggcagtataatctcacactgcagttgtggttccggactcagtctgtgtgcctgtctttcctttcactcctagccacgtgacaacacaaagagggtacttaaagtgtttatttcaccctggaagatttttatagagagcactttttaatgaagcacagcacatggcatcattatcatttctaacacagagaactcattttcaattttgctatcaaagaaaaatgacaaatagagaatgcaagaaaaaccagatggactaactgtattaggagcttagtatgcatattttgtgtcacatattagcattcattaagtcaaaagggaaaaaaatgagttttgcctacatgcattaaaccaataaggctggcaaagttccaagctagctcttgtgaattaattgttttataactgttttaattaaaattgttcagtatatgattaacctaaaagttttaatttccacaaaactgttgaacaaatgagacattaatattttacgttaaccatggcaatattgctgtggttttcagagctctgcttgttcaagcaaagcatggcaagtggtaggtggaaagtaccctgtgtctcatgccactactaagaaaacctgcaaatcagaagcaaattctatacacaagcatttatgtaggcatcgccccaaaccccctgttcagacagtctagttagagctgggcacctgtcataaattgtcaggttgaagaggttaacgatataacatggcaagaatacatttattgtctttttcttccacctggcttcatagtagtgttggtgtaccgtgtgagatccttagattagaaggggttggccagtagggactatgaaatgattgttgttaaattctaggggtttaatttaggatataggtacaaatgttagttctggaatcaaagggaagaaagagaagatttggatgacgcatcacctttacttgaggttctttaggttggcatcaggctaactttggtaaaaccacatcccattttgcaaatggtaaaacagggttggtaaaatttcactgtgtatagctgtggctcctgaaatacacagatttgcatttctgtcactcctccctctccccactttccacatgtacccccatcctaatgtacttcactttgttaaaagatggggatgtctttcctctctcctcccctaagcctttcactttgctctgtggatttgggtcatggtgctgtataaattcaaggtaatgatggtatttgaaccccatagaaggatattttaagagataagattaatactgctcagcataaatgatgataaaactcaggctgtcctaaatgtctaggtagtgatgcattttttaaggcactagactgagcttaccttttaggttgtatgacacttgatataagctgtccttacaggtttaaagctgtaggagtctggaatgcaaaactgaaccacagaagtatattggccttgcacttacatagtcaggatcatacggcattgtgatctatccagatttccagctgcagtcctgatgtggtctcttcattactttgtccagctgtttcttcccagacggtgctctgtgttagccttcccttctgtataatcattctcttccctaaatttttctgtttaacttgttaagcaccagattctgaataaattattcatataatcagtatttttgaagtagttaataatcagagtataataataaattttatgattgtacaggttgccatatttgccagaaatcagctttacacaagtgatttttgagataaatgctttattgggcatgttgctatctgttcatttcttcaggctctcttgatttctattattgtgtgaagttaggccattagaaatgcgcatacctggaccatattatttaggctcttcagagaactgccatcacggagttagagtgctatgtccttggtaaatggaaagtaagagccctcaatttaataatacagtattttatagtcaaataatacatctggcttttgtaaaaccttaaaagtaatctggtatcttaatgtttcattatacatatgcatatatgtgtgtgtatactcacatgcatatatacagacatacatatgtgtacatatatttacacatatacgtacacacagtcatacacatataaaaagcttctctaagaatttggagcgaggaaaaaatgtctgtcttctgaccaacatgtatacattcttctaactctcatgtgtttgtttagtgaatgaatgaatactatgtaattaggtaagagaactattgccttaccctggaaattcgaatcgtaattcagtaaacaattttaggtacccatcctaagtacttgttgatcaaatactattactcttttgcttggtgagtattatttttcatctacttttaacaggttcttctttggttaaaaactgacttctaaaataaaacaaacagaaaacctacttacttctaagccgtgatatgtctgtattggaaaataggcactggcattgcaccatgttccccatgataaggaaacaataagaggaatcatgcgtatggttcctgtcctgtaaagtctaatgggtggctcacacctgtaatcccaacactttgagaggtgaaggcaggaggattgcttgagctcaggagttccagaccagcctaggcaacatagcaagactcccatcttgacaaaaaataaaaaattacctgggtgtggtggtgtacacctatagtcatagctagtcgggaggctgaggtgggaggatcgcttgagcccagcatattgaggctgcagtgagtcatgatcatgcccctgcactccagcctgggcgagagagtgagactctatccccaaaaacaaaacaaaacaaaatacagtacatgtctggcaagaaggagaagtacctagctcagtccattttctactgaaaatgggtaatatataaagaaaaggaatttatttcttacagttgttggaggctgagaaatccaaggttgaggggccacatctggtgatggccttctcactggtggggactctacaaagtcctgaggtggcacagggcatcatgtgcaagggggctgaacatctagttcagatctctcttctgataaagccgctatccctactcccacaataacccattaatccaccagggcagagcccccatgacccagtcacctcttaaagactgtatctctccatgttgctacattgaggattaagtttcaatgtgagttttggagcagatgaacattcaaaccatagcagtgccaaaatcaagcttttgttttgttgtgtttttttttttttttttttttgagatggagtcttgctctgtcgcccaggctggagtgcagtgagatgttgtcttggctcattgcagcctatgcctcctgggttcaaacgattctcctgcctcagcctcctgcgtagttgggattacaggtgcacgccaccacacctggctcatttttgtatttttagtagagatggggtttcgccatattggccaggctggtctcaaactcctgatctcaggtgatctgcctgccttggcctcccaaagtgctaggattacaggtgtgagccactgcacccagcccaaaatcaagattttgacagtggggctgtaatagtagtttggaatatacttcatttattctagttcttttctctattttattacctttctgaatgtgctctctgctcccctggggcccattcccaatccagtagcggcaattaccattgggataaacctcctacctctgaggcccacagttttcctgaccatctctctacagcctcacttccacctctacctctccataaaacaatgtgtatacttctgttcatcagctaaatcactatacctatcttacttgtttttctgatgcaacaagcagccttccaaaaataccaccaagtctaataatccttttgctgtttagtacatcttttgtttgaggcttactgtcacatgacagatgatgacaggcaacaaatgactgtttaaatggtcaacagatgtgcccatccaggtgactctcctaatagttgacacacagtgggtggagggattgggttgttccagatattccctgttgttgggctagcttgctcttggtgattatagtttgacttattttgcttttattcagtttttgtggttctgttttgctacttggttttgatacatgtaggtagtgtgggttccattttggtatgtgaaatttcatatcatgaagaaagttatgattataatgtagcgttagtaattcccagtggtcattcccaaaaaatattttctgagaatgccaggtgtatataaaagttatttttgaaagtacacatgtagtgtgccacaccctctatcaaaacaggcccacattactgaaagaaggagggaaactacccatccactattactttacagtacttaaaatatgcagacaaatacattttagcacgtggtgatctttgtgaggatatcctgtcaatcaagagagtaaatatcttttctctttcccatgaacctagcaaccaatttgcttatagttccttcaaagctgttgttaagattattttgtggctggttatgtcacttggctagaaaaatggtactggaattaagtcagctttagccctatgctgcccatctttcttaacttatggtcagccatatgtttagaccagatgaggtaggaggtatgattggatacaagtacattcctggaaaagataaccaaaatcatgttctactaaaagtgaattactgtgtttttttccttcacataagaacagcatcttcatacctatggcaagaacctgtcatttttttttctgatcacatatgtaaaaatcatttgttggtagtagcaattaacataaaagtcaggttagtgatgtggttggggtgagggagatttgaccattgagagacacacaagggggcttttgaggtactgtaatgttctctttattaaccatacctgtggttgcaatggtgttcattttataattcttctgaaaaacagacatgttttctacattctgctgtatgtgtaatatattttgctatatacgtatgttttactggagaagaatttcaaaaatacctaaatagcacaaagtagaaaatgttatcagtaatcctaacactaagaaataatcgcaatttttttggacatgtatcttcccagtgttttggggacaaataaaaataataatgtatatctactcccatgagttaagattttaagaatgcatacatgtatgtatgtatgtgtatgtacaatatatatgtgtgtgtatatatatataagtatatacaaacctgactttttgatttattatattgtaatattttgacatgaggtttcaggattctatagagttaattttaatagccatatagagtaccattgtttggctatatcatattatttgcccaatcctgtattctctaacatttgcttgtttctaatatttatgtgttataaataacatgtatttatcttgtaggtatttaaaatttaaataggctaaatgggacccttctttatgtagtatgtagatatttcataaaaggtacattttgttgggaaagataactctggcttcaaatgctttttgaaagatgatttttttcccctcaaagaaaattgaaaacaatttcactttttttttccttttatgaagcatgtgtgtgtcatttgttgtaagaaggatatggccctgacatcttcatactcgattgttctctgtgaagttattttatttattcacttattgaactcatttattgaacaccatttgtatgccaggtgctttgttccagatctgaggatatagagatggagacctggtttctgctttcacagcctggcgacataatggatagcagggtttgggatgttgtctgtccatagactcttgagtttatggatccaaatgtttttgcttagattactttgctgtgatttttattattagacaggtgatttaggagcttatgtaccagagaggctgttgctttcctccctccccagcccttccacccccagactgtatgttcttctttaaggttgagtcttggaattcagaacttggtgagcaagacctgactagaacagaaatggaaatgaccttttcatgcacagcatgagcatgacagagaatgggctgtgtgttaactcctctctgatattgctgaggtcctttccagccctaaaattctgtgatttttctgatacttgggcctttgaagatcctaatacccaatcctttctcaaacattaaatttgtagcagaggggaaaaattaaattcctcctttttgagacaccagctgaactttgcagtataaatagactcaagagtgaaagaaaggagaaaagtgcattcacccatcccaggaaatcagatggggattgagagtgtgtctgttcatcttctgtaaacaaaaccattagtaacatggttgttttttacttgatccctcaaaaaaaaaaaaaaaaaaaaaaaaaaaaaaaaaaaagcagctgggtaccgtggcacgtgctgtgtaatcccagcactttgagaggctgaggctggaggatggcttgaacccaggagttggttaccaatctgggtaacataatcagaccctatctctacaaaaagattaaaaaattagccaagtgtggctttccaactacttgggaagctgaagtgggaggatcgcctgagcctgggaactcaaggctgcagtgagctatgattgtactagcactgtactccagcctgggtgactgatcgagaccctgtctcaaaaaaaaagcatcgttttagggtttctatttgaatagacatttctgtggcttgagtttcgagttaggaatgttttggcatagaaaaacctgttggcccagaaacatctggcatcattcacaatcaggccaaagtaaaggaaaactaattttttaggtagaatgttggcacctggaagaatggaggctgtaagttcttttgctggcaaagtataaaaagaaatgtttagtggacaggtgtgtgagttaaactctagagtataactaagcagtgtggctgcccattttttacttgatttgcttgtgcttctaccaccttcttaatgtgtccctggaatgcctacatgtaaaaggattctgatggagaagaaacttctagaccttaagtgactgtcctggttccagcactcatttagttgcataaccttgggcaaatctctcaagaaatctgttccgtcttctgtagaatggggtaataaacacttactcagcctgtttcacaacattgttggaaagattaagaaagcatatatgaaagtatgtactataaggtgatacttaggtattataaaaaaagtgaacagggatcagcacaaaatgttttggctgctgctgctgctggtgtgtgtgtgtgtgtgtgtgtgtgtgtgtgtgtgtgtctgtgtgtgtgtgttttgtgtctctgtgcctttgtctgtgtttctctaccaccttagatttggcagccctagtatctaagtgtgaaagtttgggatggatctcagggtttttttggtaatgatgactgactggtatggctattgaataaaatattgaagatgctattggtcctttaggacaattagttttgtctctctcctttaaggtcatttggatgaagcagcagtttgtgtagaggatactagtttttaagatatttttgtcctattttattttattttattttattttattttcactgttattccacaaaaatctttgagctggcttacaaaaatgtgtacaatgcaacagaattaaaataagtagaaaaggaattggggcactgggaaatgggtagggaaaatacaataaagccatgttaaggcttctgggcagaaacatgcaaggcagggtctgaggcagtaggttgagggggggtcccatattcagcttcccagagagtagaacaaagaggggaacgtaacttttctttttcttttttttttttggaaatggagtttcattcttgttgcttaggctgaagtgcagtggcacgatctcagctcactgcaacctccgcctcccaggttcaagcaattctcctgcctcagcctcctgagtagctgagatcacaggcatgcaccaccatgcctggctaattttgtatttttagtagagacggggtttctccatgttggtcagtccgatctcgaactcccgacctcaggtgatccacccgcctcagcctcccaaagtgttgggattatagatgtgagccactgtgccctgctggaactaacttttcttgagaaactttgtcaatggagaagatgtgtccatgaactctatcttggatatacttatcaatacacacaacggtgatttgtgaacagttgcttttataccgtcaatgcaaattaataacactgagacaaagcatgatttcaggaaagagtaactataaggggtcaagatcatgtgtctcacctagatagctcaaaggactggcttgagccaaggacaatttttagaacatgtcgaggagaggataagctacctgtcctcaggcagtctaccacaaatactctttatctcagctgggagctgacatctctccctgaaaggtttccagtgatattgtggcacaatttgttggccagaatcctagagacccagggatggagatgccagtgctgtcttgagagttcagtgtcttccctgttggcatcttctctttcttggttctggcatatctggttcaaggattagacacatgaattgatttagttctttgctggagagggcagcaaaatgccagttgtgatttttgggcttggctatgttgggaaccactgggaatttgtggactgccaataactcattttgtactagcttttgggtgaccattcagtggctgttatttcaattcatagttcagagtgactgtatttagacccatcatgtttctagagttttttcctagattcaaatcatggtaaatgctttcattagataatttagcttatgccctttttcctacttttatgtttccctgttgttactagccctagatacttaaaaaaattttttttggaaaggactgtgtgtttttagatatggggattgtattctgtgctttagtggggcacagaaggagactgtctggttaaggcaagagattgtggtgctaaaaaaggaaatttggcaggcctgttcctggtacttttagtaagtaaagaaagagaatgacaggctggctggggattgtattaaagggagccctgatcctcatatgaccttattccctgaacctagaaagatggtctgcctatgtggcagttattctatggcgctaaagacagttttgttctgctttctgccatgtatatttaggggcctaacggagagatagaaacctgttaaggaataatcatggatgttcaggcctattgcttccttcacttatccagaagccagcctcaccaatgtccatgggcaagtttgtgttcacacaagttgcttgtaacaagagggaagattctcattaagaagttggccctaaaatcaggatagaatcaggctatatttgtgtttctgtcaatagtctgaattccttattggtagaaaggtcttataattatggggtaactttgccaactaatagtactggggtttgatgtgggttacttacatcagaagtcacatcaactttttgacattagtttctattccaccatgtgctccagggaaaaggagattgatgtggactattaagccaaaaatgagaatctgttattgaaacccagaagtctgaaataagggtttagtgattgttttgtttagacacaaacttttcttcatagatgctttaacttcctaagtgagtttatatatttttctaaatatgtaatcttttaaaaatattgcaaatatttaatttatgtatttgccatttaacaggtaaaacagcaccaggaagtcttgctcctgttttgcaaaggcacatttagagagtgacagaggtttcccactgtgtctgggacaagcctcccagtgtgtctgggacaagcctgaaaagagtgccattttgtctccctgaccatttcactgattctgtacttgttgtttatgaaacttcattatgtaacagacaaaaaagcaatttcatgagcaattcctggaataggcaagtggacaaaaatttctcaggtaccttctctggaggctgtttgtcttccattctggctgcctctcttgagaactggagtggcatagtggttaagaccaggggctctggagactgcctggatctgggtgctggtctgactcttgagctgtgggaccttaacttctctgtgcttactgtccttacctgtgagatggagatgattggagtctccaccatgtcaatgtatcaacacttctaaattatttagagcagtgcctgagacattgtaaacacttaatatatgttggttgttattgtaattttaataataatagctattaaattattattctatggctgtcatgcctgagagttcatcacaggggcatgggtgggtgggtagggaataagggctgagaatctaatcagttatttttaatttattgggcaaaaatgaatcaaataaccgtggcaggcataatgaaattgaggtattcagtgtgtggtgaggatgaactgttttatcacagttcctctggtgtggcctgtgtgctttgattgcaggtcagatggctagggaaaagagtagtcaagctgaatgctctgtggtgaggctgtgagagggacaagaaacgtgggtcaggacagaaggcgtactgcaggaacagattccgaagtgtgtgcacagcatcctataatttgggctcctgtgtattttctttagttggttgcatttgttaatatgttagtctggtgtctttaaccctgtgactgacagttgacaatggtgtagctctttaaaagaggtgaaactggtctgaccacagtttacccttgatagtgctttcactttggcaacaagacagagggagaaagtccctgcttctctgctctgggaatcttaccaaatcaataaggagtctctggtagcactaacctcttttaaatagcctaagtgtgagatcctgacctttttttctgtatgtggcctacttccttgatgagaagctggcttttatattagaacttttttagacgtacatgaaacttgaatcttgctatttgtttccattgttgcttttaaaaaataattttacaaatttattctaataatatactaacgtattttgtctccaggactagtgaaactttttaagatttttaacagattcatctagacacctaaatctctctaggacttgatccttctccacccagcagaatactgtactgtgctgtgatcatttctcagggtggttttggctgagggtttttttttttttttttttttgagatggagtcttgctctgtatcccaggctggagtgcagtggtgtggtctcatctctgcaacctctgcctcccgggttcaagacattcacctgccttagcctcccaagaaactgggattacaggtgtgcgccaccacacctggctaatttttgtatttttagtggagacggggtttctctatgctggccaggttggtctcgaactcctgacctcaggtggtcctcctgtcttggcctcccacagtgctgggattacaggtgtgagccactgtgtccggccttggctgaggtttgactctttgcacccacagtcccatgatgtgtgtacttgtatgtatatatattcacatctgaggactgacatcatttcgcagaccgggaaactaagtgtgaggagtacattttaaaataatttttacattatatattggcagatcatccatgtgcttgtagaaggtattatattggtaagctgcaggtagacaggaagactgaaagagaaggtagaacctgcttggatcccagtctgtgcatacctaaggagttgagttggcaattcctgaaccaaaggttctggtgttcagaaatatctccagttattcagaaggatggcatgacattctaaaaataagaaattatttgtagtcacatcagtgtgtaatataccttacagaatattagaagggagatgaagcatttggggattcaaaggaactagttgtagacccttaggtatggccctgagactacctagggtggcttttgtagcaatctaaacctgtatcctgggatgttagcatctctgaacaaaccttttctctcccctccattgagatcactttctttaaagtctttatgcatttagagagttgctgaggcaaggccatgtcctggtttgctctttttaaaatgcagatgtttctagaaatgactataaactgagtcctgagccacctcttgtaacttttcaggtcttggtctgggggaagataaagaaatggaggtcttatgcttcacaatttggtttaagtcaactatggcaaggtatcttgacttaaataagtgtgacttaagtaagtctgacaatttaaatattagaatggtaagacatttttgtgcctctatagccatatgtccatcttggggaggaaaaactgaaaataaacgatgattacttttcagtattctgtggaaatcttacttctctttttagttaatttttcagtggataggctccctacctgccagccctaaattcttatttattcctgaaactctggtttttttcttttttcttttttttttttaaagtattctgaaactgttttctgaccatgcttcatatattgaagtagatttttttcacagaagggtaaaggaagtgcattatgtttcatatgtagatgcttttcaagaacacacagcttctcatcattcattttaacagtggacaattttggtgcctgtttatggagattccttgggaattatcagctgatagaaaatttctgaagagagatagaaaatctaatctatttggatgtcttgttaaatggagctttttgagtataagggtttctgaagaaatataggctgtcagagctgatagagtttagagagtctctgtgtaccattctttataaataaagacagccaaaagcccagagaagtgaggtgcttgatgttaagatttagttagtggccccctactggtctctgagctgcccatcactctaccttgactaatagtgataactgatgtttctggcaacaaatccaaggtacaagttttccagggtcttcaaaggaaagctacattatattaaagttcatgctgaatatcttttattgtgttctgatagtttgaaaattggttatttttgtactgttgtaaaactatagtgcttaactggaaaccccagcattaacccagcctttgccagcgtttcccttctataggatgagaaagttgttgaagagtgaggaaaaaagatggtatcttgtccttaacaaaaggtctacgtggatgaaaggagaaactgacacttattgttagggaaatggtaatgcttacatgatgatctaatctgggtttgagtttcgtttttgaagtcaccagtttttattttggtgtttttcagatattcttatagccttcctggggagatttattttttggagacatcgctcacattgtttactcctctaggttaaatgtactaggccatctgttgttaattttgtagttgtattaaattccatcctttggctggattttaagcaccaaaagcaaacttagacagaagcaggagcatttgcaaattacatagctttgagcctaaatggtggtttttataagtgcagttttcaaatgggctgagattctattttgagttttgggatcagtaatttaaacacagggacctctacgagttctctggaaaagcccattttgagaccctgaacagttgttatgccaaagcaagctcttggggtaaggttggcagtgatgctgctgataaattacttttaagatgcttggggctgaaggacaatgattttgtaatagtgttttaagttctcaggctgacctatgaaatctggaagtgctcatctgaaaggccagtattctttctgacaggcacaggaaaaactcgtcccctgcttgatcctcatgcaagcatttcttggaggaagccaggcctgtgggtcttgggggccagaacagagacactgagagcaacactactggcattttgaatttctgctgaggctgcaaaaacatttcaagggaaatctgaagttatcccttcactgtctacagcctcttgaattgacttctgggtgttacagatgggaccagcgtgtgtaaaagcagaatttatattctatttggatatcagaatcaagtttctctttttaaaataattttatggtaagtcgtggtttctctgatatgatttctgttgtgagcggaacaaaaatcatggcgaaatggtgttattacttaaccaaattgcctcgtgtacagacaggctgaactggtgctttgcctagagttggcctggagttttcagaaactcaattgtggcctttataaggctgtgcctggggttgtatttccaatctctctcaacttttgttcttgtggaagggaggaagtagagctgtgacagatatattgccagatagcacacaatagcacacaaaacgagaaagacacggcgtgagccattcatggagacagatttacgctctgtgctgccctcaaaccatagatccatctatttcagagaaacaacttgcccactgtattatatttcagacagggacatggcttagaagagagatgctgactccttctgtttagcttttgccgataatgctgcacgttttgctgtagaattacttttgtggggatgggaaagtatgtttggcaaaggaaggcctgtctctagattggaagtggaagaagggagatatcaggagagtaattggccatgctgtcgccatagtgaagtatatgtgtatatttttgctgggttttgtttccagccaactatattatcaggtgttggattttttaaacttacttcacaataagaaaaacaaagctagagagattgtgactggccaaggccagaatgtttggcattcgtagtttctctttagttctctctgtaggaccatttcctggagttacagaagaattgaccagtgtgtcagtgtctttcatgtacattaatgggcgatagtattggtagtggttaatataatagcatgggttctggaaccagtctgccaggatttacattcaggctcaacaatgccttagctacatgcctcagttatcttacctataaaatggggattccaggtcttaccttataaggcagctctgagaattgtttagttaatattgaggcagttataactaagtgttcagtaaacttagctattgcattttaaaatttgtgttgattttatggaaataaatgatgatgtgtgatacctggtagattgttcggcagacatttcaaatgtaaaaaaataactctgtctgcattgaaatctttctagattgatagttttaaataatgaaaaaaatacttctgggaatgatctacatttggaagaaatcaggaaagagaagactgtgtgtacttttgcatttctatgttttgggcttgtaagatatgtgattgtatatttcatgtcagtaataatttattttggggagtagaagcaaatgtcagttacatacatcatctatggaatagatttttagttttatttattttaactggatgaaatggttgagtgttgccttacttggttgaatttagacatttgagaaaatttttttttaacttttgtgacacacaaggacctttgaatgaaatcagtccccttttcttcctttaaaaaaacttataagaattaccatttcttgactaaacagttgttttcttttaacattatatacttgtctctacatagatactacattttttagttagatgtgttttggaagagcattgactttttttcctgttacattggaaaaatttaatggcacgtgtatgttattcttatcatgaagtgggtttaggcatgctgccttatactaaatagaaatcctatagtagttgtttttcagaagtaatccattgattcaagtcattcattgattcatttatgaatacttaagtatggttacataggtagggattgtcagaattggcttttgagcattttgtttagcagttataatccaggtggcaaatatactgtctgattcaattacttgcatgaaatcactttaaacagctacttaagatgagttgtccctaggcctgtctttatctacttattgtgcatgtgtgctagcatacacgcattatcattgttgttttttattgtgttaaaaaaatattacaaagtgtaccatcttaaccattttaaagtgtagatacttcagtagtgttaagtatagtcatttcattgtgaaacagagctccagaaatttttcatcttgtgaatatgaaactctataccccttaaacaacaactcccctcccttgttccctccagcccctggtaagcaccattctcatttctctttctatgaatctgagtattttattttattttttattttttgagacgggctctctgtgttgctcaggctggagtgcagtggtatggtttcggctcactgcagcatccatcccccaggttcaagtgattctcctgcctcaccctcctgagtagctgggattacgggctcgcgccaccatacccagctaatttttgtatttttagtagagacagggtttcaccatattggccaggctggccttgaactcctgacctcaagtaatccgccagcctcagcctcccaaagtgctgggattacaggcatgaaccaccacacccagctgaatttgagtattttagatacctcatctaaatggaattacatagtatttgtctttttgtgactgacttatttcacttagcacaatgtcttcaaagttcatgtaccatatgacagaattttctttcttaagactgaatactgttccattgaatgtatataccacatttgtttatctccttatcctgtgatggacatttgagttgttttcacctcttggctattgtgaattagtgcttctatgaacacgagtgtgcaaatttctcttcaagatcctgctatcacttcttctgcatatgtacctggaagtgtgggattgctggatcatatggcagttttatttttaatttttgaggaacctctgtactgctttctataggagtcataccattttgcagtgtcaccaacagtgcacatgttccccagtcttttaaacagccccttccagactgacagagtggctacatacagaacagggcagctttgaagattagggtggcctgttccaagcttcttcagactcctcgggactggctaattatttttgttaaggtcatactgctggaccagggcctataggttggcactgacttacgcatagaatgttggcctgggtgttgatagacttaggctgcaattgctatgagtgatcttaggcaagttacctccactctgttccctgccattgtcatctgtagatgaggtggttatgcttctctctatttcttaatttgttccaaaatcttattgtttgttgtagaatccaggcatctaaaaaatatactgtgtgtagcttcgtgtaattatttgatagactggatttctttttgcaccagatagttcggtttttttgttaaatgtctcctttttcttttcttactctttaactgccccaaatactaagtgacgaggatggagaccttggcaattgagtgctatcagtgagtctgaatgcctgggttcaaatcctccatttactagatgtgtgaccttggagaatgtaacaaactgttgtttcacagtttctccatctgtgaaatggaaataataatacgtttgtgagacttaggtgagttaatgcctgtaaagtgctttgcatgtgtctagcccatagtaagcactcattaaactcttaattatcatataatatgctaattatgatggtggtaaatgagtgaggtcatcttccattttggtcatactccacatttgggtagctttagactttctgaagatactatttcctgtaatgtttctttgtaggtggggaggatatacctattacacagttagaaaaactgaacagtagagattatgctttatatggctgggattaaaacttcagtgtcgtgtttagagcctagtacttcctggcctggcatgttgtcctacacttaatgactgtggggcctgagtgggttctaatgttagaatctggtaagaactcttcctgacctctttgcccatttataaacagccttccagggtgacctgagtaagatcattttctagctgtgtaatcctggtggtatgaaaacactggatgtctatagttttttagaactgtgacttagtactaatactagcctcttcaatactcatactcttaaggcttaatatttgtctctttattgatttacatatttgaaacctagacagtcttttcaaaggtgagtagatattttatatgtctgccttctggtcggtagcagcagttgtgcagttactcagctgttggcagttctgttacttaatacagaggcagagagcgaaagacttattcagaaacaaaacctctgcttgaaaagttctcaaggccagccatggtggttcggcctgcagtcccaagctggtgtggcctgcagtcccagcactttgggaggctgaggtgggaggatcacttgatcccaagagtttgaggctgtagtgagccattgatatggctccgttgtctggagaaacacccagggtctctggtctcgtgctgagaaaatcagcaacatagatacacatggagtggtttaaggagcggaaagtttaataggcaagaaagaagaaaacagctccaccgtacagagggaagagggctcagaacggaaaacccccattgctggggggaatgccgtaggttatattgggaggctggatgaggcggtatctgatttgtatagggcccaggggattggtttgaccaggcttgtcattcacatagcccatgaaaaactggccctcctatcctagtcttttaatatgcaaacgcagctacctggctggttgccatgatgtcctgcccacatagtctctacctggctggtcgccatgatgtcctgcacacgtggcaacaaaaagtggcaggaaccgccatactgggtggacctggcttttagttgcctgcatttgcatatcaatgcttgcaggtctggtttttcagtctgctttctgttagaaaagaaatgttttgggggctgctttttcagtaaaagaaaaagcctcaccgaggactcttttaccctctctatctgcttaaaataattcttaataactcctgtaataccatgattgtgccactgcactccagcctgtgtgacagagcaaaaactatgaccctgtgtctaaaaaacccccaaaaacccaaaaccaaaaaacgagactgggcgcaatggctcacacctgtaatcccagcactttgggaggctgaggcgggtggatcacttgaggccaggagttcaagatcagcctggcctgttacatagtgaaaccctgtctctactaaaaaaaaaaccaaaaaacaaaaattggtctggcatggtagtacacgcctataatcccagccacttgggaggctgaggtaggagaatcacttgaacctgggaggtggaggttgcagtgagccgagattgtgccactgcacttcagcctgggcagtagagttaatgagactccgtgtcaaaaaacaaaaaacaaaacaaatgttctcaagtcatgttcaagagataatggcggacataatggaacctccctaaatctgattttctccagctataaaatgaagggcccagatcaggggatgcttaagggctttgcaagttctaagactcagccatcttgagattggaaacagccctgtaggttcttagggcatgatgaagacctttgaggagaagtattttaacagctttgtgtcttggggaggaagagtcatggggaggtgattaggtgggcattaaaggagcaactggagaaaggagagactaggaggctgttttgataatccacatgtgaggtagactgccccttcctgagtgcctgaggggcacttgcaccttgggacagggtcaaggttttctctgagatagcagctcccacaggcctaggagccttctttcatgagcttgctgccctggttcatgagggagggattgatggatctctgccccgttctgtttttttgctagcactgtcttcacaccctgttgccgtttatgttttttgatgaatgattaattagaaaaataatcatttgtaaattgtgagtgaaccagacatttggccctgactgtagggaaatggcgcctctgagccgggtgtagcttgcagccagtacatcagagctccagtattcccagaccagtgatgaatttacatgaagttccttttcagcatgttaatgactgttacagctgagtaactagcgaaaaataatagcaaatgggaagagtaaatatttaatgcttttatatcttttagcttactgtggaatatgtattttgatttaggaaggacatgagagtcttagagacattagagacaatgttagtgtgtctgagcctcattccttgtttccttttctttctttgcacttaattaaattaaaaggataaagtgagttgttgtgagatggattttactaggggagtggtttttctgtaagttttaggtcacaagatgcgtctttcctggcagttaaaatctgtatgttcagactacctcattgattacgtgcctggtgtgtacagggactcatattgtttctaaaattcagctttcatcattttactctcctgcttaaaaactttagtgactccacaccgcttctgggctgaaagatatactcagtagcctggcttttaagggagggcctctgtgctgtgagtccagcctcttttcaggctctctccctaaggcagctccatgtggctacattgctcaagccacagtggttgactccctgttcctgtaacttgctggaggcttcctcacctttgcacctctgctcagatcattttggggcatgaaatgatcttgtctttttctctatctaaagcctgcttttcctccaaggctcagttctagacgtttctgtgactactctgactggataggagcctgttcattttggaatatagagaaaattgaaagtaggtcacagttctctattccttccagtttgccacctctctaccacagacaattaataatgaaccctacttttccccacttcctgtttggccaccatctagtcttagacaaactaagctatttgtccaggtaaacaagtagttgtggactacagaaatttctgaagattagaattgaagttagtagggaaacaggcctcaaggatagtgccatattttctgagagcagatgattttcagacaaaaggttttaccaacagcattcatataaagtactgctttagtctgagtttgcaatggtagaagtagagtatctaaagaaaggatccatgccctttttttttttttttttaaatagagacaatgtctcactatgttgctcaggctggtctggaattcctgagctcaagtgatcctcctaaagtgctagaattacaggcatgagccaccacacatggccaatccatgcctttttactctgttgtagagactgtcttggagtgttgagttcagacccagataaaacaataatctttagaggaaatgaccaagatgaccagaggtaggtctgaaaacatgaaggccgtgtgggtaagagagaacaagggagtccatgccttctgttttcaaatatttaggaggctactgtcaggaaggagggatattagacttcatgtatggaaccatggagtgagaacaaagattgctgggtgtaggttataccaaagataaattttatgccaatataagaaataattttctcatagtgctgtgataaaatgaatttccccaggagatagtttcccaagtaggaagggatatgaacaacaggagctgatatttgaatcgtgaatatacgtggccttatagtaaaaggaccacagatactcgaatgtcagacctttaggaacaagtcattttctactgtaggattttggagggttcataatagaaagtaacacatctccttgtgtctaaaaataggaataaatcctaatatgaaccaaaaaatatattaggtacagttttctgagttgatattgaaatgatgaaaaagaaagagatctgggactgggggttcttaacacactgggtttagggacctcaagaatattgtttaagaatgacgagagatttgcaatttccaaggagtcataagcagtttcaaaaagttgaatgtttttgaggaacttaaaattctgttgttttcaaaatactatagaaaagtaatattacaaaattgtcttgacataagtaatttgggtatgctgtataaaggcttctaagaattaagaaacatggcccgggttgcaaattttaatgcatgactacctttttttctatagaatatagcttttgtcagattctcagcagtggctctgatccagaaaacattaagaaccactggtcatgagtggtgattttcagcttttttggtcttaacccacttaggtgggacagaagctccttatctcacctataccatccagcatcaagataagcacacgttaatatgaaccatatacatattttgttttataaaagtatcccataagctttaaaaatgtaattttgtcatacttaccttggtatagtagattgtaagttatttagagactataaagtcacagatgaatgtttacaagtactctttttggagttgggcttattctatctatgtcttctttagcagtggggatttggattattcttaaccataacacatacaagtctcattattggaaaattacaggacagaaacaaatgctgtaaatatgcaccactgcgcatcatgagattaaacagacaattttcaaaaagtcaaatttctaatgataaaattaaagtaagtaatttatatttaaaaagcaggaatagcagcaatgcaaactgtgattgacttaagaccacagtgaggttacagtgataataaatcattcttctggagaattgtgagaattttctaactgttggtgtgtgtaagtgcaaggtaggcactttgcataattgtatagtagctgacattcttgatatgccagtttcaagtcctttatatactttgctaacttgctgatattaatttattaatacaggtttttaggactcccctctcttatctaaggtaactagcttattaaagctcatattaaagaaaacaagtatctgtggaaatgttcttgtgggtaccagtgattctagagccttacgttaagaaacactagtctaatggatcaatgtataggtaaatgatattagacattttgagtaggattaagatccaggagactatctgaataatgacctttctctctctttctttttaaaatatggtcatcctaacgcgtatgataacccagatactctttctttttaaatacccttttatttaccaaccctcttaaacctggccctgaagttaagatcaacagctatgtgtgaataatttttttccttctcctttgctttgcttttcctatcaaattgaaataccctgccactttcttccctctctgaaaacacaaaagaggattaagccatataatggactatttatgtgtcaaattaaacgttttactctgaggctgtttctgagttatgcgagcagtaaaaatatgtattaagctgccaagccttttaaaaaatgcatgttatttagctgatagcctgtaacagtctgatggacccataatggtgttttgagtaaatacgcatttgaacaatttatgaaacttatgtttacatgtgtattaaacagcctgggtagggagtgaccaaaagttattaccagttgacagctgttgtctggtgaccaatttgaaatgaattggtggattcccttcagtgcggagtaaacaggtttcccagtcaggggagcatgctgaataattatcagtgtgtggggcctcagccctggaggcctgtgtgttggttgaatgaggtgctggaataaaatgtctcaactctacagtgaagttgcaccttagattcacatttatgatctagtttattttgtacttggaaatttataattatgttcacagagtacaggctgtgcataacaatatattctgcccttgggaagagggttcatgtttgtttatttcctttttttcttttttaactgacatataatcgtacatatttatggggtacatagtgatgttcaatacatacaatgtatagtgatcagatcagggtaattagcattccatcatctcaaacatttatcatttctttttgttgggtgcatttagtattttccttctagctatttgacaatacgtaatatattattgttaactatagtcatcttccagtgctatagaacactataatagaacttactcctatttagctgtagttttgtatcctttaacagagctctccctatcttccccacacccccttgtttatttctttgacattatccatctagggaaatgatcttgaaatttttatgatgtgtccatatcaacaatacatattttatatttgttcacttcaaaattatatgcatatttacatgtgtaaattttattccaaaattaggagtttaaaggattgagataaaaattaattacatatagataatttgattttctttttgtacctgaatgaatcctctttggcactgtctgggatgtgcagattttgccttggagattaaggcgagtgtcttgaaacctttgtgtaatgaaaagggcattgtggattatagtcattcataaacctgggcaaatcattcagctaccttgaggtctagtttcctcatttgtagaatatggatccctgcctggggggtttcataaagactactgatagtaaatgtcaggtgtctaccttgaccacaaaatcacttcctcagagaggctttccctgacctcttttctccatgatagctcctcttttcttcctgatcactctctaactccttaccttttaattaattaattaattaatttttttttttttttttttttttttgagacggagtctctctctgtcgcctaggctggagtgcagtggcgcgatcttggcttaatgcaacttccacctcctgggttcaagcgattcttctgcctcagctttccgagtagctgggactacaggtgcgtgccaccatgcccagctaatttttgtagagacagggtttcaccgtattggccaggctggtcttgaactcctgacctcgtgatctgcctgccttggcctcctgaagtgctgggattacaggcgtgagccaccgcacccggccttttatttatttatttatttatttatttatttatttatttatttatttatttatttgagacagagtctctctctgtcggccaggctggagtgtagtggcatgatcttgactcactgcaacctctatctcccaggctcaagtaattctcctgcctcagcctcccgagtagctaggattacaggcatgtgccaccatgcccggcttaattttgtatttttttttttttttcagtagagatggggtttcaccatgtcggtcggccaggctggtcttgaactcctgacctcaggtaatctgcctgccttggcctcccaaagtgctgggattataggcgtgagccactgcgcccggccaactccttacttctatttaaaacaactttttaccatctgaatgaatattatttaagtttctactggattgtaagctttgtaaggggagatatttttaaaattttacttttttggtctgttactgctgtatccataactcctagaatagcatgtgcatggcacatagtaggtactcagtaaatattagtcatgatttgaatatttcataacttagtagttgactaataaatagaggctgttactgttttcatggagtatcctacatataatatagttggtgttctaggatagaagacataattctctatgtatgaattgctctcactgtcacaggatccttagggtgtcacttttccagctggaaacctctgtggcctatggtgcctttgcccaagttttgctccggcctgctgggcttgttccacccactcagctgggcaggctgtgctcaggttttgctgccggcctgaatcccatgcctgccaagtgtgagcaggcgcagagcggcaaggggtgtgtgagcaagtgcagggtccggccactggcacagccaggcatgctggctgtggggtgggcagctccatatgaggctgtggctggaccaggtgtactgcaagcagcttccactgtgggcactggggaatgcggtggcacctggaagcttggagactccaggaaccacagaaccccaaacagggtgtcacagtcctggcttgtagagccactaggtttgggcttcctgaagggctgcaactcttctctctttctcgtcacctgcaatgtggctattgggggttgtgttacacccctttcagtcccgcaattcagcgggtgctgagttttgtcctgcatccaggaagaatgagatacgtggacaaccagagggtgagcaaggcggagaggggcttcatttaagtgacagaagagctcttaggagatcagaagtgggtagctcccttccacagcaggtcatcctgacgagtttccagctgtcagcagagaggagacccatagtgggtaagtgctttccatagtcaggttgtcctgacaagttgaggagacccaaagtgggtatctccttcctgcagctggtagtcctgacatctgcctgagtctacctgagtccgagggtttttatgggctcggaagggaggaagtatgtgctgattggtccatgggtggccatgagtgggcctggagaaagcaccgtaagttcttattccaagccacggactccagctggaactggcagcctggcccctaggcttcaggccatccctggcttgaagttggggtttcacaggggacctacccctttccgcccaggaacctgtctgcctcccaccgtcaacaagctgtccattgtgtctaggctgtttgtgcagagaggggtgtctgcagacccatgccaagctaccctcagcacccacccccatcctccacttccctcctgcacctgtttgcagccaaagtccagagggggccgaggtggcagagggctggtgtgtcaacatcacctgagctactgtacacctgactgggtcgcggcagtgcccagtctcagccacaactttgctctgcaccagagcaggtgccgggagtggggagaggccagggagtgggagcatgtacttccaagcctatgggagttgggcccccgagaacacagggatgcctgggtccagagccacagctgggcagctgcagctgtgcccaggagtgcagggctcccaccctgctaactcggtatggggtggggctcctgtcttttcctggctgtgcctcccctgctgcagcatgggccgctgctgccatcatcagtgggacccaaggcaggaagtgttttttcctgtagggaggatagatttttttttgtctcttacaggtagcatctggcaggcatgtagaagttagacatgaagcctccacccatggatctgagccaagtagactgacctgtgtaagcttcagatgcctcagtcttggtctccttagctccctgtttttgtcaactgtgccatccagctgagcaccttagagcttgaagctgagagcttcagcggggccagtgcctacaagggctgtgtgtatatgctttagaggtgggagaattgtgctgccagtgggcgtttggcccactaaggagaacacctgtgacctctgcaatcttccctacccctggcattccaagtgccattccaagtctgtagagataatagaacaaacgtaattttttgtgtggttggcaacgaagactggaggagaataaccacacctttggaagacttcggtggtcctttgaaatgaggagtttttatagaaacacttatcattttaaagacctaccatttttaaggtcactcttctgctagggctgtgaaatacagacatatgaaatgttttccagtgttgctctggtacttacgtgtgtgatgattttattggagaaatggatgaatatgaggttggagagtctttacatgtatgaactatcaaatatacagttcagtagcctgaaaacattaacaaatagcttttatttattgtatccttatgtctttcaatttggttcttatctgttgtctcttcagttgatgcaaatttgtgctcaacttttcctgaggggaaatggagagatactttcttggattagcttatgatcttgaacttgactattttaaagagtcatggtatataccaatctggattgtgtttaggatggggcttgggggatggtttctttgttctcttttggcccacgtcttctaacaacccatttgtttagggggttttatgctgcttagagtgagctgagaatgtgctcaagcacataattttagcctgtttttcaggtttacatgaaaaatgtaacaggcttctgaaacccctctaggttccagctttcaagaggctggtcaggaatgcactgaccgagagacttccctcaaaattaatttataaacacgctagaactttcctcaccttaattttgagaaaaagatctctctcatggcattttcaagtgttatggtagatggaaataatgaggaaactgtggcaccttgaacagagtgagaggtttagagttgtatagaccttagtacaaattttgactctgtcattaattacctgttctgtcatgagtgagttacttaacattccctgagcctcagtttcagcatctgtacagtgaggattctatttatttcatactgttgtggagacttgagcaacagagtgtgaaaacatctgtcagcgcctggtgtattttggacattctgtaaatcttagcagcccatttccccattctgggggtaaagccacaggacttttttggcaaatagttgagatacttggtgccaaaaggaaatttaactcatgccatgacaagtttttttgtataaggatgggattctggaaacatgataattttttctcttggccatatggattagcaaaggctttagaaaactacaaaaaagactaatttgttgcctctggatgtgtgtgttattttgggctgttaatatacttgactgcttgtttcaaggactggaaccttttcttttacctttaagattcctgcattttcatgtgctcattcagctgggatttgtgtttcatagaactggtagtattggaggtagaggagatactgtgatatcatatctctctctctgtctgtctctctctctctctcccactgaagaagagaagacaaaatttagagaatttgagacttgctcaaagttgtgtagctagttagcgataaagctggaattgcaccagatttgatttccatgacattgctttagcctggtggttctcaaagcatggttattggaccagcagcatcccttgggaatttgttagatatgcaaattcatgagatccccattcccttatcagaaattttaatacgctgtgtagggtgattctaatgcctgctaaaacttgggaaccactactgtggtctttacactattgggcagggagatgggagactacaggtagatttgctgaatttcatgggcaacactaggttttcattttaccttattgttctgccatttagatgtctcctcttaaaacatttttacttgcagtgatggcttccttagactcgtgtgtgattgttgctggggcagttaggtggaactaataggtgttgcttgttgattccctgctaccaagtactagttttgaaatttgagtattcattaaaaacaaatagggatttctgtgtctcactcctggaaattctgactcagtgggggtaaggattaggaatgtttaatttttgaaagccctgcaggtaattttttttctactttttaaaaattataatttttattttctttactgttcttttaagacatcctgttatagcatctgcaggtgattttgatgcccagccatgtttggggaaaaaagtttgggttctgagtgaaaatagaaaacgtaatgacatggaaaggaagtcaggggataagaaaagctctatggccagccatggtggctcacacctgtaatcccagcactttgggaggctgagatgggcagatggcttgggctcacgagtttgagaccagcctaggcaacatggcaaaaccatgttcctattcaggaacaaagaatagatcacaaattaaactctgtgggttttcataagtggaaagttggctttcgttgttctgtatttgggtgcttagtggacaggagttatctaaaagaagtaattatagttgtaatgcggaccctcaaagttgaaagtagattgaaatccattattttacaaggtggccttactatttatagtttgactgtaggtatggcagtgagagataaaattactttttctagctttgcaaaacgccaaacgtctttgaaattaagagtaaaaggggtttaaaatatgtactgctttataaagcaggaaaaccccactggaacattttgggtgtttacagaaatgggtattccatgggagagaacgtggtaacctatgttttgtcatcatttgtttaatcactgaaaatatattaacaggccaggcatggtagctcatgcctgtaatcccagcgctttggcaggctgaggtgggaggattgcttgagcccaggagtttgagatcagcttgggaaacacagtgagactccatttctacaaaaaaagaaaaaagaaaaaaaagtcacatgtggtggcacacccctgtggtcccagctactttggaggctaaggtgggaggatagctcgagccccagagatcaaggccgccgtgaactgtgatcgcaccactgcactccaggctgagcaacagatcaagactcttgtataaaaaagaaaaaaaatttttttaaaaatataaatatagattaacaaagtaacagggaatataatattttcaggttggtcatatagaggaaatactatattgtgttattcagcttaataaaatataaaacaaaaaaattattaactgtttgaaaaattgtagtcagatatttgattaggggtaggtcctgatttggatgaatttgaatcacattcgactaaatattgtgctttttaatactcactttaaaaacaaaattaattgggcaaatgttcatatccattttaaaaaactatcctcttaaaactagattgatagtagacattaataggcttgatgttgtttataatattttgctatattttaagagcatgcttttgtatattttctgttttagtgaagcattttaaaaatgcccccctcccacaactgcaggaataaatctaacagattttgaccaaaattactctaattttgaatttcttgaaactgggtatggaaactagacattaaaaaaaatctttatttttaagcacggtttcttggtcagtagcttctgtattacgggagaacacaagaaggggccttcttgacactcaagaaatgctctttttccatctacaaataggaagacaccctttgtggtatttttgttttgtgggccctgaatgaaaacgtattatgatcagttttaaaaattgctgcccctttaatatctgaatatattcgtggctagtgaagcacatgcatctgtcagatcatgggtgagaattcacttttctttttgcgatttctccagccacaaggacaaatttagttttgcagagcagtttgacacctctagaagcctgcggttagcctcggtgcacctctagcagctgcataggctcaagaggacctctgttcttccctttttggtttggttaccttacccctcctcagggaaaggccaagagactcagcacttcctccccaagtgagtttccttagtaacgtcagccttctctaatgctggccaagggtgtctttgctgggctgttttccctccaaaatagactcactggggtatagaattttttttttacgtgaagggtatagaattattttcagaatagcagcagggtaattaggctcattgttgacatgtcattgaagtctccatgtgacaaaattgctcctccctctttgagcactctgaatactcttaccctcttatctcgatctgctctttagaaataccagcagataatctgggagaaggccaccatagccatgcacagagtggggagaatgaggagatctttgctgaatgtcttttagttgtttgagttggagataaatgcagaatgacctccattttgccctaagaacctgaccttcttgtcactttgtgtaacattaattttctaatgtgttctggtcaatttgtaaaaagattttttttctagtgtctcagctgttggtttgacttttgtattttcattggtaaaatatgtatgtctttgctgtgagcagagagaaacagattaataaaaaccactgaaccagcattgcatatgtaattaattaacaccaccaggaaagctggttcatggttgtgtgtaaacttatttccaaacatctaaaaaacgtttagagttatcttattcagttgtctcacttctaagggataggttaggaagctgtaacgtatgtgtatgcacagaaactgttggacaatgattctcaaactttacttttcattaaaatcgtctggagggcttattaaaatgtagattgctagacctcatccatagtttctgattcagtatgcctgggtggggccttaaaatttgcatttctcatgtggccccaggcattgctgatgctactagtccaaggaccttactctgagaatcagttttaggatgtagatcttatgttcctctttgccaagggcaaatgaactgaattgtataggcttccttttcttttacaagaagcattgcctcttctaagtagacatccaccaaatatttatgtactgtatccatggtgccatgcactgagctaggtgcactggggataaataaaatgatctctgccttggggaactcacagttgagagaggattaaattaagaaacccaccaatcgtgattcaatatgagaagtgctgtggtgatgtcaggggtaggctttctagatttgctatgaggtgcagtctgagctttttctcagactgtcttagctttatacctacagaaataagtgaaagaaaatgaatcttctgcagcttaggattttgttagtgctcagatcagtttcctctcgtccttgactttgggcatcccaagctctgtattcagacactcctgaactggcattgtgagctctccaccccagcttttgtggaagagtccttcctccatttttaaattacaatttcagacactgtccactgtggcagcaggatttgtaacaagaccaagttaagtgatcttggctgaactgatttatgagacagcttcaaaaattcatgaggtaccatgggaactttctgtagtggatcagcatgccgcttttccttcacttcttcaagtagatcagacattttgtgataacacggcagtttatagtggagccttctagattatggctctgctgattaagacactaagacagacctgaagacaaagagaagggagaacaggatgttacttttagaaactcctgttatcctaagcttgagcagggactttgggtaaaatacatctatgtataactcaatttatacatagaactctctagggcaagtttttctccagtggtgatctgatatggagtgtcttggccattaataatggtcccataattttaagcacaataaaatgttaggtgtgtatatgcgaaaaattgagtgacatagtagttgtctctcctctctttgtgaaaaccggtagacaggaacgaaggatgtggccaaaaccagtgacaggttatggtgctttccctattttattgattgctcatttctagtctctaaccttatttgctacttattgatctagtagaaaagcaaataattttccctagatagtattttgttgagctgggctttgatgacttgtctaccaaagggtttttaaaaagtacttacctgctgagtggcagcctgtctaccatttaatgttattatctgtgagcctgggggttccttcttagtaggatcactgatgtcataggctgcctctttattctgcctactttcctgcaagataccacacatgcccgtggtctgctttaatggcctcacagtgcacacagccttagacttaacacaagaaacatatgagtgatcccattggagataatgtgttgccgagtcaatttgggtcagcatctgccaacatgtcaaattttcacactaggttgtattttgagatttttattcatgcttttgggttcaaatttactcacaaataagttttgaacttttaagtgctaaaactgctgagttcttgactatctgcacttggggaggggaaggttaaagataaggggtgggtatgtatgggaaggaaacagtagcacagatcatctaacataggaggtaagatagatttcccaatgtcatatataactttgactatatattttttcctatgtttacattctcctgtttatgattatactcttttggttcatattaaattggtgtttatctcctaggaatatatatggcgaggtgtgtcataggaagcaatagaaaaagaatttggagactggtcacttataattcttgaataatataactatgtagagttaaaagcaaagattgatcctgtcattcatgggattgatgggcatttttgctggtatcttattattgttcatttctgagtaggtaatatattaatatgatcccaaaagcaaaattgtattaagaagtatatagaggaatgtctcactctcatccctggacctatgtgccccattcttcaggcttttataactactttattagtctctattacatcttttgtaatttcttaaatagtgtgtgtactctcctatttgtgtatgctctcgctttttctgccctttgttataccatatttagcatactataagcactgttctgcatcttgctgttttgtagttaccaatatatcttggagatcattccatctcactacagagagagcttccgtattcctttttatagctgcttaatatttcattgtatagctgtaccataatttacttaacctgtctgacactttggttatttacaatcttttgctcttacaagtgatgctgcagtgataatgttttttttttttttttttttttcccgagacagaatctcactcttgcccaggctggggtgcagtggcacaatctcggctcactgcaacctctgcctctcaggttcaagcaattcttctgcctcagcctcctgaatagctggaattacaggtgcccgccgccacacctggctaatttttgtatatttagtaaagacggggtttcgccatgttgtccaggcttgtctcagactcctgacctcaagtgatctgcccgcctcggcctcccaaagtgctgggattacaggcatacagtgaataatcttgatcatatggcatttcatcctgggtgtgtgttcagttgtaggataaattcccagaagtgaaattgttacagtgaatgtgcatttgtaattttgatagtcactgctaaatccctctgtagaggtcgtactaatttatattcccatctgtttaagagtagagatttccccgcagtcttgtcaacagggtggtggtgttaaacttttgaatttttgccaatctgataggagaaaattggtatctcaaagtggtttcaatttgcatttcttattatgagtaatgttgagcattatttactatgtccaagatctgatagtatttccttttgtgtcatcaacagtctggttatatttctttcctgttttttctatttgattattgctatttttttttaatttttaaaataagctattttggaatacttatagacttaccaaaaagttgcaaagattacggggattttttttttcttttcttatgccctcattagctcgttaattgggttagatggtttgaggaaggacaggtctcctggaattctgtggcttgtcataggtttgtcagcccaaataaggatgcacatccaattcacgactcctggctgcctctggggattttccatatggagtgacagacttgggaaattctgctgagcttctgactagcctccattatgaggcatataattcagagcccatcttccattattcttcttttactagtatcaattattaactagaaaggttattgaagtgaaaaccttgcctcaagtttgtatttcttgagatttacttccaataataaatgtggttttcaagtgactgaatctttcatagaccaagtttcgagcacattaaatatttggtggttttgcgtcctctctgcctcacatgctaattgagaggatgagtagctataatttttctggagcttcaggctgtcattctgtcctgttaattggttcttggagtaaggagctaaaatgtggaggcagaaatgctttcccagatagaaacatgccttgaagctttgtgtcctgtaagggtccacatagcctggaagttaagaatactggctctggaataaaaccttgtggattcagattcctgctttgccactgctagatgtatcacctcggacaagttacctaacctctttgtacctcactctctccctgtttataaaatagggattagaacagtacctgcctcatctagtagttgtgaagattaaatgtgatgagacatgtaaagtgcttggtacaggcctagaacattgtaagtgctcaataaatactggccgaaaagtcgtacagggcagtggtttcagaggccatgcaataaaatagtgggttatgttgcatttgacttttgttgattaacctttcttcttcctctattctttaccttgtgaggcacttaacctactaactgaaatgccattcattcagccagtatttgagtgctcagcaagtgccagactctaaacaagatgatgtgtaagatgctgcaaggagccctcgtgccttgcagcctgagcacaagtgcctataaacgcaaggctggttgtcgtcattgccatccccagtatactttgagaatacaaaagaatgtgaggtcactctcctttgactggggtgacgaggacatgcattgtgaaagggggaactgttagaactgggagccattcgtaagtgaaataaggataagagggatattatcagcattgatgctaattagcatttctgtagcattttgcagtttgggaaacattttatgtattttattttatctcagtctcataaaagagcttgaggtattattatctccagtttacgactgaagagatggggagtcaaataggttatctgattctcccaatgccatacagctccttggtggtggagttggggtttgagtccaggtctcctgactctgaatctccacgtgcttccctctggtctcttgagtgaaataacccgtactagcaagaaagagaagagtatgtcggcaaaagagaaacctggaatagttgccaattgtccctaggttcagatcacatacttctagggcatcagagctagaaggaacatgagatcagtgcatcctctttatttgactaatgaaaacattgatgtgcttgtgagggacttcgagaggtcaatgtggtgctggaagcagctcaatggagagggtagacagttccccttggatgctcatgtgtggtcttctggggattgattagttgctggtaaggaaggagctcattttggggaaagtaggtacatagattcatagagggaaaacctttattcagaagcaggcagtttttctgcaatatcttcctgggaaacacaaataaaagggctgtagtttagtattcagatgtggttctggttgtgcaaggataaggagaaaaggcagaggcagggtgagaaggaaggaaaatgaatgactgatttgaaaggtcagtgagaagtctgtgaaaggtacatacttagggtctgtagggcagtcatttgaaatccaggatacttagtatatatataggaggacttcgtagtagttctctgactggaagaggactgggctgccttgtgtgtgtgagctttcatcatgggggcagtggttactacatgctatttctaagaattgcacttgtggggtgatttctactttgggtaggaggttattctaggtagagctagtgtggatcagcaacatcagcaccacctgggatcttgttagaaatgcagatttggggactcctaccctagacttactgaatcagaatctccagtgggtgcagttcaagaatgtgtattttaacaagatctccaagtcattggtctgcatgttcaatgtttggaagcattgctctagtgcagaggctctccaagatcctcctttgggttctcggcttatgtgattaatgtgccattcaccaaacatttattgaatttcacttatgtaggcacagcacaaagccaactctcacatggatcctgcttgcattctagttgaggagacaggattgtttacaagtaactattaggttggtgcaaaataattgaagtttttgccattactttcaatggcaatttcagtggcaaaaaccatggttacttttgtaccaacagtataaaaacagtgttaaaggctagtacaggaggcacagagaatgcctgtgaaagtggagggtggacgttttcataggtgtgtgcgggagcaggtggcatgcatggtagggggaatcattacttctgtgcaggactcctgagtaattttaatctgtggtttgctgctgtgcaaacccagaggcctgtctacaacttgtttaacctcccccagcccttgactgggtttactttattggcctgataagtagtataaaaattggcagagctattaagatgactcatggaaggatatcctcagcatctccttttggatctcctcacacctgcactgcttcttcttaaatgcctgaatatccaccactttgtaaaagaaaaaaattgatttgtcactgaatttccatgcctcagcctgagagaaatgtaaatgttgtactggcctttagtactctgccttcaagcctagatttagagctgatcattatacttttagagtaggctaggtatgaaaatagcagcaggttgaagagtcagaggaagctgtttgctctcatctgctggtttggtcagggtggaagtacgaatattaatacagtccacttaaacaataaaatagctcccagggaagaggaactataaacttcagtaaatatcagagatgttaaatgctaaaaataaaagctctctgcagttgtttggctctttaaagagattgtttattggtcaagagtgctagtctgtttggtcatgttttgctagctttttaaaatgcatgtatgtaaatgaattagaatataagttaattaagcagggcagtgtttctagaatgtgaaaatagtaacctggctagttaatttaattaagtccttggtaattttcttttagaaacaagtttcatcttgggaggtcacaacgtcctggctgctgtgcttctgagctttaccttgactccatcctctcctctctgtcatccttttctctggctctgtcacttgcatttgccccctgacttgtcaccctgacttcatttcctctctcccagctgtttacagtgctatcacagtggtctttcagaaatcccaaactctgctgttgaactgggttctaaaaaccttcagagacttcatgttgtccataggatacactgttttctgaactccttagtgtgccatattaggctctctacagtctggctctaaaatacaattttttttttttttgagacggagtctcactctgtcgcccaggctggagtgcggtggtgcgatctctgctcactgcaagctccgcctcccaagttcacaccattctcctgcctcagcctcccgagtagctgggattacaggcgcctgccaccacgcccggctaatttttttgtatttttagtagagacgggatttcatcgtgctaaccaggatggtcttgatcttctgacctcgtgatctgcccatctcggcctcccaaagtacaggcatgagccacggcacccggcctctaaaataccattatagcctaattttcaggcttactttttcttgtggtccaggccacaggactatctgctattctcaatacaaataaaatataaccagtagccaccctgcagtagtagggacaattcaggtgcctcgacaagcattgtctgattacactattcaatacaggatcaaagagttttgtcatttgcccaaggtcatgtaccttgtgttagagctgagattcatattcagtattttgatattctgactcagtttcctgctttcatgtctctgtgctttccttgtatgttttctttctttttttctttttgaggcagggtcttgttctgtcacccaggctagagtgcagtggcacaatcacaactcactgcagcctcaacctcccaggctcaagtgatcctctcacctcagcctccccagtagctgggactacaggtgcacaccaccatgcccggctaatttttgtactttttgtagagacggggtttcaccgtgttgcccatgctagtctcaaactcgtcagctcaagctctctgcctgcctcggcctcccacagtgttgggattacaggcgtgagccattgtgcctggcctccttatgtcttctatgcctagactgtctcctaccctttttctttgcagacttggaaatgtataggtgttaggtattcctaacaatgtgcgtgcataggtcatcgggcctatctcaatttagcctgatagtgtaaatactagtactactactacctagtgctagtactaagagctgatcccagatcttaatttttcttcatttctcctccaaataataggcggtttataagtattatggaatgaatgcatggatggatgaaaggatgactggatagatggatggtcagtcccagtggttgggtccgtttgtgatttgaccaagttcaaggctgtagaattgctatgtggaaagaatgcatattatttcagctatatcaaatagcacctagggacggcctgactgacagggaacaaattgtcagccctcatttggatccaagtggaaattaatctgaagaatttggaatgggcctattcgtgggaaattgcttatttttataagagtttattttctgatttgtggctatattcgttggctagggccactgtaacaaagaccaggtgacttaaacaatagaaatgtattttctctcagctctggaggctagaaggctgagatcaaggtgttgagaggtttggtttcttctgaggccaatctctttgtcttgcagatggctaccttgctgtgtccttacatggtcttccctctaggtgcacatatccgtgttcagatttcctcttcctttaaagacagccgccatactggattagagcccaccataaagacctcattttaattaattacctctttaaagaccttctctccaaatacggtttcattctgaggtactgggggttaggacttcaacctacaaattttgaggatacctcattcacctctacccaacccatcccctctgccttttcctcttgttgtctttcttctggcagttttgtttcactcaagggcagtcaggaagagaagtaaagatagaggaaaaggaaatttattttgggtgcagttcaggaggtgtagctggggttggggatgggcagtggctgaagctattggtggaaatgagattttgatattgcctatagattagtattgtcctggaacattctgtgctggtttcctggacagccgatagctggctgtgtgtgttggagggcccagggaatatctgttctgttagtaagtgagggggaaattgataatcctgcagccggcctggagaagtaaggactctatctttgtctgtcagctcttcctcccagaagtagctcagagacttgctgagcacacctagggtagaggccaggatagttgagttttggacgctctgccttggctaacaccttgcctggcatctagcagatgcttatgaaatgtttgtcaaattgaattacttaatttacttgactcaaatattttgttcttctccaaaccttttatgaggagttttttctccacctttgtttgttaattcccaaacttctctccagttctcagttgtggcttatgtcttttctttcctttctctttgtaattatcaggtaatttattaaatggagacaagcttaactagacattaaataattgcaggtgtgcagctgaactgagccgctgtcctttaactaggaaatcacagctgcttgtgttgtattgtgtgatgagattacacttcacctcatttggttacacgatatcttgcttattgtaaggtaaaagaatgttgaagcttctgctctaagcagtacacaaaggctggtatgttcccaggaaaccaacgtaaaaagtacttggaggtcaggtctggagcctttgcaacctctgatgcttctcttttcttggaatttttcatttcctttgcctttttctgtatagagaacacctgaattactccttaacttgagacctgtttcacattttaaaattttcttttggtcaccttaactgtaaaagcaagatttttctgtttccttctaagagattagcagtgggtccattggttagctctttttttgctttcattatcagacctcatctgcatactttttatacaaatttgccccattggtaagaattgtagcttttatgaatgttaattttagtcataggttaaattgtgatgtcaccagtctgttttctttggctagtttcatagtttgtgactattgctagaggtagacactagttatatagcaagtacctagcttattacagaactcagagtatgctgctaataaaggattgcttgattgcttgaagggtatgcaggtgtaagaaatattcatctttcaattggtgtcaaaatttttatttaaaaaaaaagtcatgctgccacttcccagctttgtaactttgggcatgccactgaaatatcttaatcattagatttatcatctaggtagttgtgagggttaaagaaattcaacaaatatttgaatgaactatcttttgtgcctttctggatgctagggatatatttgtgaacaaagcagaataaattcctatccttgcgggattaacatatatgaatctggttttgactgtcaactggatggagtccaattggtgggagaacatgatacctaccatttatgaaaaactctttaaactgaaatatgtgcctaataacactaactttctttattagggacattttaaccccatttgggctttgcagagtaggtcttagagaaagcccttctccatacttgttcgttcagtcgtgtatcatgtacagccatccattttatggttttggctgttgtaaataaaatggctagagcctgtgcatctggagttgtggtgactcttagtcttgggatgcgtgcctcttcctctcggtcgttgctttataggctgtctctgaggttccagaaggggctcagagaatgagctccaactgacatgtttgagcctttgagtctcttcatgaaagctcagtttgttcaagtaaaatctgaatggctcagagaggacactgtggtgtttagcttaccaagcccagtgtgatatcactggtttgttaatatctacagaaacacacacaggaaaaatattctagagcatcatattgctcacctcctctaaattcttttttcatggatgatcgaaagaaaaacctttttgagtctctctcttcttttttgtgaatgactaatagaaagaagacgacactggtaactttcagaagcattgtgatagcattctgatggtgggattatgatgttcagacatgggagggtattagcaaccaaacatcatttcctttaggggactggaggtagtggtcatctgtgagtctagagctgtcttcgagggaagtgagcagtggctcttccaaggacacagagatgtcaggcacctctctcatgcatgcaagtgctacatattatgtccacagtatctggagtatttaaaccaggaataacacgtagtctttattattggaagaaataaattaggtcagagttagtatgccatcgtgtgatgccagtttgtattctttattttctgtacttgcttctagagagggagtaaatactatgagataatgaagaaagacatgtttttgtgacttttctgatttaggacactttatgttgtggaggttttttgaaggatttggaatttggttgcttattgagaacctcttgagaaaatcagattatctctgatacacaaccagtcctacattgagttttttccatttattgctgtagagacatgaacatttatttttattgaagctgagagaggggtgttacatggttgtttatcagctctgccaaaagtagctcagacatccctgatgactcagctgatgcccttgctgcctgattgggtgcttgtgtactaagtacttgtttccttgttgagggctaggaatatgtcacaaagccccattgctgtggggattgttgcagtgagcagacttagcggaactgcacaaggctggctagaggccaggtttagactaccttggaagaattggcttaagggcagaggagaggtttagaaaactcctttcttcctctttggtggcattaatctttgcgaaaccaggctcagactccttttgcacctttcccaggaatggggtagcatagatcttcttcctatgtgaatcacagaaagggactttgtgtgggtgctgtgtgttcattgtaaaccactggtgctgctatctaggtggagttaaagttgataccagcagagtaagttagcctgagcaggaggatggagttctgcagtacagccggaaattttcacttcatagtgtttctactgtaacttctcaccctgtgttgaaaaaggcacacctggccattcgcatagtttggatacgttttaacccataagagtgctgtccttaaagatgatgaaaagagacattttagctccttggaaataagcacatttctgaaaccacccgtctgagtgcacacttgtgcagataaacaggtacttttgtttatgctctgactcaagtggaaagggcaaaataagagattttccttctcctgagtcttttcactgtgaggattttgtcctttaaataaaataaaccggaactgtaacctttattatgggaggagtgtggaggagttaggaatgaggcaaaatgccctccctgtttctcagataactcttgctaccgtctgagcagtgtttatttaacagatttaatgcattgcctcaatagcatcacacgaaacatgtcaccccccctttttagtttcttcccttcaaaaattttcttaaaaatgccagaaccttaccaagtcacttaaataaatcagtccaagtatgaaatgatctctgaagtgacttaacacaaatgattctgactttactacttgggagactcttttttgatggccagccctctaaattgtaggaagatcattttctagctccctattgtcaaaaaacaaagcaaaatcaaattaaataagtcccttaattcccataagtaattttaaaattatctcttgtatatactttacttgtgtgcagcttgcaactgaatatcattgtgagagctatagtttgtcagggtttagatcttaattagctcatgagattgcatccttttgaagctgtataccacaggttgttggctagttttccaaaagcaattaaaatgcccactgttataattaagcctgttactagttgtatgttctagttataaaatatatttggcaattaaggaaactgagattgaggcttttggcttggctctttgagatgcagtagactggcttccaccttgatctgttaggatgactggtgcggatgcctggatgatgggacatgtcttagtccttgagtacctatctttatgagtaagagcaaccacaggtttttacaagaaagctaaagttagagaatgtgactcgtgtcctcacatatgccgattatgtcctacttggtatacaggagtcaaaacctaaacttctaagttgcagtctcttagctgagaagtcctttttaaagaagcattcccttatctttaagaagatggctcgactctgactgtgaacatttaatctgttaaactaacacctccattgcgctgtttaaatttctgtctggttgttgaaaagaaggtgtgggagaaatgttgcaggtacatgtggttaatgtctgtttctgaactgtatttcatttaggagttgttaagctgtgtgcccaccatctcagagacagatttgtctgaactggcctgtggaggaagatctcattgtcagggctggtctcaatggcagatacagttctcagtggtgtgctttgcgtgtcgtgtcttttattcttcctttcctcctgctcacccttaggaatgtttcctttttgtgccttaacaccagaacggtatggtggctgagaccatgggacaaatgcgtcacttagtgggcagatagaaatcagtatttaaagtatgattgaggtttttgtgtttattttgaaattcatttagtacacagggaagaaaacagcacttggcttatgtggttctatcccattgctttgcctgtttgtgcccccgtgcaattaacatgaaaatgatagtttaagaatgagctcattaacatttagaactgggtaggaacagggcttcataggatgttaaaatcagagaaaaagagaaaagagcaggtgctttgtaaatactatgtggttttgagaaatagtagaaagttgggtcttattttaaatttccttttttccagagtccctttaaagttgtgattaatgatatacattattttctttattgggcaaaatattagaattattagagatacatttttcttgggaaaaccactgtggttctctggacatttctatgttaactgtgtcatatattagtatagaataaattcacaggcttgtgggtctgaggacatttgcttgtttcctttaaatcaatttatacaagcacttcctatgcttccttcctaacaaattttccataatttatttctggcctcgtaaaaatagagggaaaataaccaatcaaattattagctcgattccttacatgagttcttcaatttttcctaggtaccaaacaaaataaaaccagtctttgtaacaaagattattggttctgaggaaatgactatccacaaagtgtacatttgtgtgtaatatgtggtatgcattatgtgtggtattttacagttaaaatacaacataattaccataaaataatgtatatgaaatgagttgtaacaataagataagattgacttttaaaaataaacaaccaagaataaacacagcagaattcctaatcagccttactcataggtcaaatttagctttgatgtcctttcctccataagccatatttaggcatcaattcagtataatactccttctttgtgctcccatatcgcacttcatccttccctcatcatggcacttactgtgctgtgttgcttgtttggctaattccttcatttggctataaactattaggatatgagcagacatggtgcctttttcactttgtcctctgaattctttttttaaaaattgaagtaaaattgacatgtaataaaccttggatatttagtatacaatgtgttaagttttagcttagtgttgtccatgaaaccatctcacagtgaggatcatgaacacatttcccaaagtttcttcacgctcctttggaatacttacttctacttctcttctttccttgtcttgagacaaccattgacctggtttctatcattgtagattaattgacacttccaacaattacgtgtaaatgaatctcatatagtatgtactgttttcttttccttggcttctttcacttagcataattaagattcatctatgttgtagtgtatattgataatttcctttttattgctgagtagtattccattgtatggatacaccaaagtttgtttatctatttttaaattgctgagcatttgagtaataccagctttttgcagttataaataaagctgctatgaatactagaatacaagtcttcgtatgggtatctacttttgtttctcttgggtgattatgtagggtggaatggctgggtaaatgggcaggtgtatgtttaactttacatgaaactgccacagttttctcaagtgttagtaccattttacattcccactagcagtgtatgacagttctagttccttcacatttgtgccaacacttgatatagttgatattggtaagattttagccattctaataggcatgtagtaaaatctcgttgtggtttacattttcctttccctactgactagatgttgagcatcttttcatgcttttgctgtccatatatcttcttttgaaaaccatctgttcaaatcttttgcccatgaaaaaaaccttagttgtttgttttcttattgagtttcaagagcttttgtttgtttttattgacacatgattatatgtatttacaggggacagtgtgatgtttcaatatatgtgtacattatgtaaaaattaaatcagggtatttagcatatctaccacctcatacatttatcgtttctttgtgacaacattgaaaattctctgattttgaatactacaatatacaacccatctttggtatcaaattttgaaatatacaatccaatatcattaactatagttaccctatagtgcaagagaacaccagaaattattcctcctatctgtaatcttgtacctgttgaccaatctctcttatgttcccctgctttcccttcccagcctcagtaactactattctgctttcaagagtttttttttttttttttgagagggagtgtcgctcttcttgcccaggctggagtgcagtggtgcaatctcagttcactgaaatctctgcctcccaggttaaagagatcctcctgtctcagcctcctgactagctgggattacaggtatgtgccaccatgcctggctcattattgtatttttagtagagatggggtttcatcacgttgtgtaagctggtctcgaactcctgacctcaggtgatccacatgcctcgccctccgaaagtgctgggattacaagtgtgaaccactgtgcccggccttaagagttctttacgtgttcttaattgaggtgttttattaaatgtatgatttgcagataatattcttccagcctgtggtttgtattttcattgacttaacggtgtcttttgaataatagaggttttaaattttgatgaagtcccaataccagtttgttcttttatggagtatgcttttggtctcataactaagaaatctttgccaatttagggttacaaagtttcttctagaagttttgtcatgttaagttttacatttaggtctatgattcattttgaattaatttttgtatatggattgaattttttttttttgagatggggttttgctctgttaccaagtctggagtgtgcagtggtatgatcacagctcactgcagccttgacctcctgggttcaagtgatcctcccacatcatcccctcaagctgtagctgggactacaggcatgcaccaacacacccagctaattgtgcatgtgtgtgtatatgtgtgtgtgtgtgtgtgtgtgtgtgtgtgtgtgtgtgtgtagagaccaagtctccctatgttgcctgggctggtctcaaactcctaggctcaatcgatcctcctgcctcagcctcccgaagtattgagattacaggtatgagccactacacccagtgtaaattttttttccatataggtatctaattatgtcagcatcatttgttgaaaagactgtccttttccattgaattgcctttctgcctttgtcaaaaattagttgtctatatatgtgtgatctatgtaaaaattccttattctgttccattggtcagtgtgtctgtcccttcccaaataccccacagttttgattactgaagctttatattaaatcctaaaattgaacagtgtgagactttcaactttgctgtttttcatccttcttttaactcttctactggttcctttacctttccatagaaattttagaatcagcttttctgtatccacaaaaatgtccttctgggatcctgattgaaattaaattaaatttgtataccagtttggggagaattgtttattgtgttgagtcttctaattcacagtcattctccatttattttggtctttctgtaaattttttagcagtattcttgtagtcagtattcagcatactttatatatatatatattatgtttactctttttatgtaactttaattcaaaaggtacagagactctcccttagtgctgttcttaagacatgtttatatgacatctttccattagtatctttggtcgtgttcctgcagtatcctcagttgtgctcaccactgcttaactcacctttgcagccaagtttcattttgagtcaaatctaccagaggaggtcatttaccacctgagaaatccctcacttagttttaacagaaataaataactttaaaacaattgatacagctccttctttggcttgtataattttcttcaggcataagtaaaaaaaaaaaaaaaaaaaggaaaaagtgatttcaaacatgttcagagtaactgtaatccagctgtggttgaaagaagaattttgagtggttaaagagctgactgaccatgttggtggctcttgaaacactatcagcttttcttaaccagaaggcaatcaaggacatacttgaggtcgggaacagatatttcataggccactggagtgctgcagtggaaggattccctccagatccttggttcacagacagggaaggtgaagcctgaggagacttggttacttggtttccttggaggatcatatgctcagtgagctcttcctgaaaaccagccctgttcccatcagaaactgcagagacatagtacttcccattcagcaggttacatggagtcagcgtaggcagtcaaaatggagagatgaaggattggtgttgggtaatgagagcaagggatggtcatagaactcagagatgataatgtgaccaacaggatcattattcaaatttcccaagaggcacaaatgtagatgatgattgctttcataagctagtggagttaatttctgtcagacactattctaagtgattttgtatatgaactcatttaattttctcaacaaccttgtaaggtataggtaccgtaattatttcattttgtgaatgagcagaaattaagcacagaggtgccagagatcttttctcataggtgatgaaggtaggagaggaacccaggcagtctggctatagagcacagagtcttaaccactacactgtctggctgatggcaaagagcatgtctattaagaaagcctatggggaaatggtcgccaaatccttctctaattcttggggaccctgagtttcagggttttttttggttttagaaataagggaaactcctgtcaaatgataagattgacatttttcatttttgaagttctaaatgtaaagctctttgaaatgtataggttttcagatactctgtgtgtctgtgtgtgtgtgtttgtgtgtgtgtgtctgtgtgtgtgtgtgtgtataagttcagctcctttaaaagccccatctctgtcacaatcacatttttttttcacaccgcattccaccctactaatactcagagcttagattagggaggtgactaggatactgttaattaaaactatatgacctgattagacaaattaagagaaattttcgatagggaaaagaagcaggacaaggactgaacttctgagagatagtgaaaaatcaaggtgtttttcttattctcagtcacttcacattttacttctgacactagatgtgtggtggattttccccacacaccaagcagttctccagaagacatcaattaattagctgaacttattcaatttaattttgaccctatataccaggcattctgatactgtctacctggagatagtatcagatctcacaatctcagggctcagtcccacacaactgcccccgacttcagacaccaattgcaagttccaggtgatgtgtacttctgaccaaccagctattaatcggggttctcatgaccccctcctcaggtttgattaatttgctggagtgactcagagaacccgggggggaaaaatttgcttatgtttgcccacttattattaagaatattacaaaggatacagatatgaacagccaaatggaagagatgcgtagggcaagataggagagaaggggagtgagtggacttctatgccttccgtggacttgtcacccttctggaaactgcacgtgtttagctcttgcgaagctcatttaaaccctgtccttttgggtttttatggaaaatttattacataggcaggatcgattacatccttagccattagtgactgattcaacttttagcctcctctcttatttgttttaaacgtttgtttccaaagtttttttctcccctttgaggaggacagattcaggcttacatcaaaatggaattaaatgtgcctttgatttggaatggggcaacaagagccgcctgcatggctgtgtatatttatttatatggggtcaggtaaaagcacttttaaaataagcaagtattagagatcagaggttatggagcagctgctggctctggctgacaaagcattcctggtggcatttgccactagctctctgggtgtgggcattagagagtgtgagagttggcctgatggcctttgtgtttgtggccctgtgtggaaactttatagcatttcagccgttctaatctgtgcaggcacagagccacagctgaccataactcttaggggaaatgaggacagaaaagttgaacagcactgtgtgctgtgtagagtatggagaccagaatgaagggtgcagaatgaaaggaaaaaaaattttttttgaagtatcctgcttcagggtttctattgtttgggaaactattcctatagaaatgacatttgtgctttgtgaagggggtggaggtagattttctggagtgtaattttctggagtgtttccttattgaagggggaaaacaaatgattggaaaggctcttcctctgtttctctcatgcatccctacacccccaatatatgcagtgtccttgtttttgttaaatacagaagctatacagagggcagttagagttcatccaccgttttactcattggatgggattattaagagataagaccatttattgcttagcatgagaatcttactgtcccggccagcaaaggaggccaaagatttcatctgaactttacctcttcaattcaagccaccaaagatttattgggagtctactatgtaccaggcataacatatggcatataaaggctaattttaacaattatattgccgtttatgttgttggtttggatagaaaccctgtcttccactaatccttacttttcctataatacaaagattatcattgatgaaacatattacagattattattttaagctatttagcaaatattagacattttcttagagaatgtttgagcatatcagaaattgtggtggatatgttagtttcctatttgctgcaataataaattaccacaaacatagtgacttaaaaacaacacaaacttttatcttacatttttgtaggctagaagtccaacatggatctcattgggctaaaatcgaggtgtcagggggctgtgttcctcgtggaggctctgggacaaattctatgacctcatctttttccagcatctagaggcttccctgaactcctaggtgtatggctcttcccttcatcttcaaagccagcaacagcagattgagcccttcttaaaatgccatctctttgtttctcttttccatagttacatcttcctcttccacttttaagaacccttgattacattgggcccaccctgacaatccaggataatccccttattttaagatctgctggttagcatccttaattccatctccaaccttaattcccctttgctatgtgtagtaacatattcacaggttccaggaattaaatggacatggacatctttggggagccattatttctacctgttacagtagggtggactttccccaaactttgctctttccccactcaaatgaaattgtatagtgccctctattaattctttgcaaaataaattgttacctatgaatgtgtcttgtgcgagtggtgggtggtttatcactgcttaaagcctcactcttcttcattgtgacaaaaccccagccacttagttttgtacaatcccagtgttcaaggaagctagagatcctcttagccagcccgcccgcaggggttttgcacacacattgttacatctcttcaaaatggctgtcccacctttgcttacatgaaatggcctgccttggcaaataaacctctttgaacagttctgtttttgttagatagttcctgctttaatttaggggaaaatatttctctttgtgggtttgtagaacctattggttcttgttttactctctggggtcatattgaataaatctaatttcttctttcacacttgaagcccttgagattttttttaaagacagttctcatatcccccaagtatcagacttaaaaatctcaatttcttcaactgggtctcacataaaactgtcttgagacttctctccatcctgttccttctcctgagtatgatacaacatgaagaaggggaggctgaaggaagatttaataggaggctttaaatgctggggggaattgtcatacagaaaaagctggtaaggtctttacatttaccatggaaacaagaaatcacaggctcatattgtggctaaggagatttaattagcaggaaacctgtcttaaccttatggatttggtgtcaggaaacctgtcttaaccttgtggatcatgcaatggactgcctgctatgggaagttgagggatcttttgccttagtgtaagacaagtcttcaagctcagaattcgtatattttgtgtaagagacgttgcttttagttaaatgttttgcttaaagtattcttgtcattgcttgtcatctatgcctgatgcctgaatttccctcttgtgttggttcattggatgtaaggcatcatcatgactgctgttaatcatagggggaaggaatatggttcagggctttatgaaggaagggaaacagtggcatagcacaggataattaatagcaagtggagtgacagtttgattccctggtagggaccctggcattgttgaaggaaaaaaaaatcactttattctttcatagagagaggcagctgtaattctggttggatggaatccaattaaaaggaactgacatgcaaattgatgatgagacagtgtgagcatagaagtagtccaagaagagttttgtaagaaatggcagagaagagtgtaagtaatttggcatggtaatgtgtgtaagaaaatggaaagctgatgggttggctacctgaacaattatgtctggaatctcagccagcagagaacaggagactggttggtttggtagagttgttaacaaaactttctggtgttttgagttttggtctacattttaggaattatagcctttcataatagaatgaatataaatcaacccttgagggttataggctttcaaattggtggtggttaaatataatattctcaagattctatgatgggagtcccagcctggctcttggaaagaagatctcattgtacaggtgtacttcacctgacctaatgatgtgttctcaaagatttgtgtgagaattggctcctaaatttaggatgaaataggagagcttgccatttctagtaatgctattatgaatcattttctaatgtaaaaaatccttttataaccacagtcatgcccaatttatcttttaagtaaattcataagtccacatattagatttgtttaaaccaaaggtatttttctttgaaatgaaataattgtaggggcacataacagttaagctttagagtaacagaggaaaaattgggtaagattttataagtcagtatattgctttttagggaggaaattctgcctaagaagtcagacagcttctgctgttattacgggaaaaggagaaggctgcccaacgtatttcagggagatttactaggatctcttgggaactgcagtagaaatcactacgaaatattttgaggatagaggaaacaggacaacagcgtttactaggttttattctgaagaaagccaaagaaggtggaatggagttcatcttgagaaagcggtagaagattgagaagctaagaaaagacttacacagcagcaaaaagaagaagagactggagtagtgggcagagttttcagttagcaagagagcaccatccaattgttatgctggtcagcagcaaggaacattaatgaaggagatgaagaatgaccagggtcagtttttgttcatccaggtttgagcagggtgttgcttatgatgctccatgcagttttgcctcccacaatctctctctgatctttgcctcctgatctgctcaagtactgcagcagcaatgcattctctactgaaggctgtcacgtttacttttcactgtgcctagaatgctcttaccctcaagcctccctccttcacttgattcaggttgctgctagaagctcccttatcagagagacctttagtgaccattctgtctgaaggaggcagacactcttcccttattccgcttttcttcatagcactcattatcacctcacacatggttgtttaatgtttccccaattttctctgctagaagtaagttctttgagagttcagcttcagtttcttttgcccatcagtgtattcccagtacctaatttatataaaaatttgtggaatggatttttagggtatctcttgcctatcacagtgagaagagctgagaatgaagaatacaggactcagtccttgtcctgtgttatgcaatgtattacatagttatagtaagtataacagcctgagcacagagtgctgtgagctttgagaaataagctagagatggtcatcacagaactggatcttgaatgataaagaggagttttgttctgtggtggagacaaggaatgatcttctaggctatcaaagcagggtgagtgaagttggagagatgtagaaatgagttttgtgtttggatgtcattgagtgattttgatttggctgctagagcacaggtacatgggaaagcatgacaaaggggcctgagaggtagggttggggaggacatgtgaaacatatgttgagatctgattggtaaagttattgataggcgtttggaccttgtcttttgggaagcagggaagtagcaatatccaaaagagagtgcttaaggatggattggaagagggaagattatagaggggatagagagcaaagcaggatgtgactttcccagccttgaaatgcatgagaaagtttgggatcctcacaatgaagggcaaaaaaaaaaaaaataaaaagcaattctgtttatggatgtatagcaatatattgtgtataggtggtggctattagaagactagtagttcttggaactgttcctttttttctcacaatagtagttaagctgtgtcattgggatacaaagggaaggagaaggctatttccattcttagaatagaaaaattggaaaatgccttggcaaatggaggtattcttattctacattttttttttttttttgagaccaagtctcgctttgtcacccaggctggagtgtagtggagccatgtgagctcactgcaacctccgccttctgggctcaaacgctaccacacccagctaatttttttatttttgttttttaagagctggaaatttgctatgttgcccaggctggtcttgaactcctgggctcgagtgatccgcctgccttgtccccgcaaagtgctgggattacaggtgtgcaccactgtgcctggccataccttacaggttaagcagctatgtggccttgtgcatttcatttaactgtgtttcatttgtcctttcatggagatagactttgttgatatcctttcatcgttgatgtgcagaacaaagtatgctgcttgggaaattataaacatactttcatttgaaatattgggtaatatcaggagtcctttgctttaatagaagtagatctggaattgcttttttttttttcttggaatatggtaacaccaaagcatctgagctactcacacccatttccagaggaaaacatgatcatttccaggagatggcctgcagttttaaagctttttgctgcttgttttctacatgtcaaaacacatcccatttcagcagttggtgagcgctaccatagaactgttcagaagcaagagggaggattgagtcatgttgtacgtgcagctgcatattaacctgcaggtcatagcagtccctgatccaaaggactgtctgacactttatccccgttcttactgccttcatcattcacagcagccagtgtaggactctcccactttagccttgatcatttggagtagcagaatcgtggtcttgtgtatatatagagtgttatataggccatgtgattctcggagacctttttaggaagtttgagcaaccttacatattggaattctttcctctttttgagaaggaggaaagaaatgtatgttttataaggattgctttgaaatagatccattttgcagggtttaactcaagcaaagaacagactagcttaatggttaatattaagttactggagtttgaatgcctaggtcccaattcaagcttcaccattattagctatatgaccattagccagttttctcatttgttagatgatgataattacaggaagatactgtatcttcccacagagtggtccagaggaatgaatgagtaaatacatgtaaatcacttagactaaggactggtattatggattctctgactgttagctgttttattcctgattttctcatagccactggcatttctaagaccttgcaagaaccactggtcaacttttctgcctgctatgtttaactagtagaagtcagaaagtgacttggtggcagagtgctagaaatgattcattgggtggactattgagcttcacaccccagtccactggcatcatgtaagaaacaactcattacactctaacggtagtttagtgaaatggatgagtagtcttagtctgcctcctcaggctgcaacagaaagtcaagccaagcagccaggaatgtctgggaatcacctggagagaggacagacatctgcagcacagtggaaggtgatagatgagtgggacccaggaataaactacagaagcagtgtggattgtgttgattctagcaagcaggagggggtctccatggtatttctgagtataagccaaggaaatgtgttaatgtggggggaaaaaaatcaccgaactgggagagagtcagactacctcgggtgtgacctttgccctgtcaccaacatattgtatgtcacatccccatggggcgagtcacattttctttctaactctgtttctttgtctgtaaaatgattaaatgatttcttgactctttcttttctagattctttttaacgatttcattagcttttaataactatgtgaggaaaggagagcaacctgctatagaccttggcctgtgtgagtctttaattttgttttttgttatttcaaagaagttcttgttcaaaagaccatgagacatttcatcattggactttttagggagttgtctctttaatctctcatatttccttttttccctacaaatgatatccacagtactgctgttgtcttgtgctctctggatcagcacttttccagagaaatgaaaacactgcacttttaacggcacagaaagcaaaattactgtagcatcaggattcaaggttacagaattggttaactttctggtttgttttgctgagctgaatgaaaaagatttgatcgaatgttactgcttagggataaatattaataaccacaaactctcttagtgatcattgtccccccttttgcagaaaatttcaaattatggtctaggacttagattgtgattgtcagctgaatatgggcgtgaaaaatgtggaataaccagataaaggacccttaattggttgtagaggaacaactttttggggatccatgtccagagagggaattggttctggattattgatttgtatcattactttgattaagtgtctagcagttgctgtagacctttataacattatataatagaaatggtattagaaaaaagtcatcaaaggtaggatttttttaaagatataagaaccgaagtttttaatcttcagtccttcatagagaagaatttattaggtttgagagttctcagtaccaagtaaattctaactgcagacttaaaacatatgaatacactcacatatagtcaccccatcctctggcctggttttgttctctattatagttgactttgctttaggggaaaggagggagagtattggtattaatttatttgaaaaattagcaggagtatatcaaacacttactgtatgccaggacttaccatgataaataagaggtggacccctgtccttatggagcccacttgaatcaaaaagtaaacatatgagcatgcaaatagatggctgtaagaatgtgatgggcatgccattttttctagcaggttgcctaccacatagtctatatgtgttagagatacacattaggtacacagaagagggtccatttgtggcatagagagagattagaggaatcttcatgaaggaagtgacatgatgatgatgttttgaatgacaggaaggagtatgcaaaaaaaggcagggttgacattccagacagaaagactagtatggaccaagacatgtggacatggaaatggtttgctccttttggggtcctgaaggtaataagtgcaatgaggctggagaactgggtttgtcttaaggggctatgggaaatgagggtcagagtgtaggctcttatgaaggctgtctggtcagacttgaggggaaggtatgctggtaaattgcactgagaatagttcctagctgtcccatatttcagcatctcctgaaatagatgtgtactgtgatgtacaagttccaggatacaatcagttcatgagtatccagttaatgtacctgcaggatttgggcagcaatatatgtagggtgttgtgtgaaaatattggatatgaacaattacaatcttggcttgcacaagaaatcattgtgatgcaggagggaagggtagaaaagttagattattttttttcccctctaatgcagtgcctctcaactttgttacaaattagaattacctggggatcttttttttaggatattgtttacatgcagtgaaatgcacagatcttaagtgtacacatcaatgaattttggcaaatatacatacccatgtagcacacttacccatcaagttatagaccatagtcagaacctgaaaaagttttttagtttccggtttgaatcaattcctgcccacccctcccatatgtaaccactgttctgattcgtgttaacatagtttagttttgcctgttcttgaatttcatgtgaatggaattatacaagtatgtgctctattgtgtttgccttcttctgttaacataatgtttttgagattgttctatattgttacatgtcagttttttttaattgctgaatagtaccctgttgtacagatataccacaatttgtttaatcattttcctgttggtagacatttaaattgtttcagatttttggctattatgaataaagctgtaatgatcagtcttgtacaagttttttttttttttggcagacataggtcatgatttttttttaacgtaagtgcctaattgtggaattttgttataggtatgtcagtgtatgtttaactttataagaaactgccaaacagttttccaaagtggttgtaccattttacattccctcctgcattgtatgagagttcttgttgttccatactgtcaaacatttggtatgataagtctttttaattctagccattctaatgggcataatatggtatttcagtatggttttaatttacatttctctgatgatttatgatgttgagcactgttttcttttgtgaagtgtgtggtcaagttttttttgaccattttcaatttggttatctttatgttattgatttatagggctctttatatactttggatacaagtcccttgccagatatacataatgtgagtacttctttcagtctgttacttgcctttttagttcctaatgacatctttggataagcagaattttttaattttgatgaagtatagtttatcttatttttccattatatattttgtgtcttttgtatcctcactaagaaatcttttcttaccctaggttatagaaatattcatctttgttttcttctagaagctttatttatcttttggtgtatgttccatcacaaatttttgagtgtgatatgaggtaagggtagaggttcattttctccatatgtttatctagtcgttccagcactatttgttgaaagaccttactttctccattgaatgtccctggcacctccgttgaaaatcagttgcttgagggccaggtgcagtagctcacacctgtaatcccagcactttggggggatgaggcgggtggatcacgaggtcaggagttcaagaccagcctggccaatatggtgaaaccccgtctctactaaaaatacaaaaagtagccaggtatggtggtgggcacctgtaatcccagctacatgggaggccgaggcaggagaatagcttgaacctgggaggcggaggttgcagtgagctgagatcgcgccactgcactccagcctgggagacagagtgagactccacctcaaaaataaaaataaaaaaaataaaaaatcagttgcttgtttatgtctatttctgtttaggtctatttctggactctgtgttctgcttcactgatttatttgtctgtcatcccagtatcacactgtcttgtttatctagctttatagtaagtcttgaaatgcagtagtgtgaatcctcccactttgttttcttttcaaggttgtttttactattgtaggcccttttcttttttatataaggtttagaatcaaattgtccagttcttaaaaagaaaggtagctagggtactttaccttacaaaatcccttgatacccagaccatacttcatcccagttaaatcagaatcatttagaaatgaacagaatctcgttcattccctagattcttctgagtgcagccaaaattgagaacctatgtactaatgggattttagtgtggtacactaaagaagatactgtcatggattgctgggatggaagccattccagtggaatgtatgcataggagctgatgtgggcccctacacgaaagaaattgttgatgtttatggaaccaggagagctgaatgaggaagagaaggagcaggagtgagaagccctgtggtcaaggtagtagagttccctctccctggggcacatggagccccattgctgaggcgctgccttgtgtggctcctattcctgattattcagggtattcccaccctaaacctgctgcagtgcagccaacaaaccaccaacttgaaatctagggaatactcttagtagagcgtgtaaatgtactattttaaagaatagctttcccctggattagggaaatgcttgtgaaatctgcatagtgatgaacagggtaggcacattctagaagtgcctgtgtgggttttttgctttttgagttttttctgtctttttaatgtaatgtctttagacaaacattgagtcatccattcttcccaagggtaggtagttcagtcagaagtgatgttttcccaaaaggctttaaagaaaaacgggacaaaaagttacgctcaagtaatatgttctttgggagcactcaaagtatgcaggctggtaggttgcttgcttgtggcttttttttttttttttttaatttaaacacacattttcctctttgaaaagagaggttggaactagtcagctgagtccctctttctgaaatacacgttccctaaacagctgtagagaattaatttcagtcaaagatagcagagctttaatctcagctttctgctcagtgttatggaaaatcctttctagaaaatagccagtgtctacctgctatgggatgttaaaaaattcaaacgaacattggattttttagtgttttcctagtagaaacagcatggaaaatcctttagtgagctagattttacagtgcacacagaaagcaagtatctatgatacatttataattttgtgtgtgtcacatgttggttgtactattttcttattcctaatagaattgaaatataccatgtccaattccaaaccttattttttttgtgtgtgaagggttgaagcattttagacaagaaagagctttgatactagcaactttaaactcatttataggatatatatacatatataatacatacatatgtatgctctttcaaggcagaggaagaaggtaggcagagtatgagaggagagttgcttttctttctcaacttatgattgtatttaacacatactcgcatgcacacacacattcttttaatagcattttttttttgtagtgagagaaaacttatctttaagaagtctctaatctattatgggattaagagttttaaatgtcccccaacacccccccccccatttttatacttttatttctacgatttatatgtcacgtgaacatcactttttggtggtgtgattatatcggaatacttttgtattttgcttaacattaaaaaagccatttcttacattgctatatcatgatagtaatttaatggcagcataatagtacctcaaattgtgccatactttatattcttctgttgtaagttttctattttgtgctgttaaacctcaaagaacttatttgtgcatagaatccctcttaatttcttcagtacatcctctgtgtagaatagtcacaaggtgcattttgttttttccttatctgtgtacagtttacactgtatatgatcctcagtgatatagggtgtatttaccttaagaatgatcattatttacatttctagggataaaaagctactggatttctttcataactgtattatttaaaaagttgttcttcccctttatttttgtgcacaaatttgagccacatttatgtttgtcttttaatgggttatgggttcaaatttttttcttaactggtatgtttttttttgttgttgttgttttaatttttttttttttttttttttttttagaaactaggtcttcctaagtaagttgtctggtttggtctcgaactcctaggctcaaagtgatactcccacctcagccgcctgtgtagctgggagtccaggtgtgtgccactgcacttggcaatatgtaactctttgtgatatttgtcatgagtattttttccaagttttttctttttttattttagtgccattgtgcctggcaatatgtaaccctttgtaatatttgtcgtaccttttccaagtttgttcttttttattttagtttttcattacaaagcagtttatgaagttttttatattttcttctgttgccttaagatgaacaaacttgtcatcccttctgagatctaacatcaattctgtccccacctgccccccaatatttcctgtggtttaattaaaagcaatttttaaaatccatctgagtttctgtcgatacatatgccctctccttacctgctgtgctatgaggaaaggtgggctaaatcaggagctcgtgttattcatatcttgggagaggaatagaaacagccagtactccaatctcagcttcctgtaatgtctacaagtcagtgtttgctcatctataaagctgggatgagaataacaaatgtacagagaatttttttaatgcacttaagccttctcttaagcactgttaagaacttcagttgaaagtgtttaaaataccaaatagctgtaacctttgattgttaatatgtgtgcaccatcatttcttggatttttctcaatagctagagaccacatgggatctttggtgttttccaaaatgaaccaccatgctattacctgcagacattaagggtctgattatacaaagaaactgagagttgaggatgtccatcagaaatacactgtttcaaagtcagatctgagtacttggtgaagactttggggactacttaatagtaatgattactagaaaaataaacactggcaatatagatagtggttaaaaaacatgggctttgggctgggcatagttgctcatgcctgtaatcctggcactttgggaggccaaggtgggaggatcacttgaacccgtttgagaccagcctgggcaacatgccgaaaccctgtctgtataaaaaatacaaaaattagccaggtgtggtggtatgcaccttaagttctagctatctggggaactgaggtagaaggatcgcttgagcctgggaggtcgaggctgcagtgagccatgatcatgacactgcactctagcctggaagacatagcccaaccctgtctcaaaaacaaaacaaaacaaataaacaaaaaacgtgggctttgacagagagacttgtttaacttaattaaacaagtgccacttaagtgatttggggtgagtaattttagctctctaaactcagtttcctccactgtaaaatggggataatattgatgagtggtttaattaagaaaatgtatgtgaaatattgagcatggtgcctgacccatagcaaatgctaagtaagtagtagctgttattacttttattaacaagtaacatttgtataacatttatgacctacagagccctttcacatgctgtttcttatttgtgaactgagtgttttatacagaatgggtttttaaatgttccataggctttttattcatggcttcaagaggttgttccctttttgggacctgtacagcttgtgtatactcagttggcatttgtcacgtatcttcatgccagtgtctttgtatctgaattctaaaactgcgtgaacacaaaggttatgtcttttgtcttattcatctgggttgtcactggaacagagtcaggagacattcctatttattatgtgcgtaatcgtaggcaagtcaatctctggcttgccaaagctgtcctttcctcatctgtaaaatgggtaacaagtttcttgtgaagattacgttaaataatgcattaggaagcactttgtatagaaaattacaaatagttttttgttttttgttttttttttccgccatgcctcactagcctagtatcacagtagatgctgtaaggttggaggttgttaggaaggctatagagccaagtcttaactttagtgtcacaatacctttgttaaacaatgaaattcagtctttgggggctagttgtcatgctgggtgctgtgccaggctaattaatactttggtaccttgcctttaaagtacttactgctgctgtctccctccctcccctttggtattcattatttatagtataaaacatttgctgcttgctgttgtaaaggtgggggatggggtgtagttacacataggtgctcagagcaggttcaatgatttaaccctacatgaggaagtaaacttaatctacataaaatatggatttgggggtgtgtgatctctgtggtcagtctggaggagtgtgcgtgaggtgtgtcagccactaagcaaacaatggagtgctggctctgtggactcttggctgagtcagcattgtttcccatggaatttctttttctcttagcccacaggtgtatttatgtgtcctggtatttcttcgtttttattttcccccaatttgatttcataaatgatagtgcaaagtgttggctatggttaatttcagtaaataaggcccaaatatgaggtatctgtttctctcttgagtaaaaaataaagtcatgttatggggaataaaagcaaaagcatttaataaaaaaatccctttgttcattttagaaaatggtacctttgttaattccttaagagacaatttattatattctgacactatctttgaatagtcaaagaaggcatgatgtctcaatttaaatttcttcttcctggcacagcttttattctgcaaggtttgtgcttttaggaagagggtattgtttctcataggagagtagagtgcctagtggacagaaaaaggtaaagattgtcatttccttgaacatagattggtgtttaatttctacttaagggtgtcttttgagaagaacagagcccactctgtttagcagcttgctttttgctaatcatgtggtgcatggtgtgttttcatctagtccgttccattaagtcttatttatgctttggggatatggataattggctacggctcaggtgaggtgcataggtgatgtgtcatttctctcctgaggggatagagatgacaggcttcttttagataatcactgtcagtggctgggacccaggaacctttggtattcacctgtttagtcagtggggggcaaatttgatgcaagagcagagagggaactgtttttaaactatgtatatagtcactatgtgattaactctttggtggccctttaagtacaggataaatttgcattagaacttagtgtctcagagtcttcgattacatgaagtctgaaaaagtgatgaccaattgtcaatattttggacatattccatgagtgccccctcagaccattggtagagataggtttgcaggtggtgaccctggtgaaatcctcctctgagaagggagtgttcaagggcatacgttggcatcatttaagtagcagaagagagcaccccattgagatggtttaaaaatgagatgctaactttcaaagttttttaaattttattttttacaatgcctgtgatgctactacattgtataaacagtatgtagtgttaaggatgtgcctcgcatgtaagccaccactagcatccttagtgtgggggtactgttccttttctacccaaatccctgcaagatgttctgagattttggtgccaaggagtctcccaacattcaacattgttaaaacacacttccttatcttctttgaggttttttaatagcaaatcccaagccactcacctttttctcatagtattaatgttctaagagtggctatacattatgttaaagtcagcgtagttctccacgggaaggctgttttttaaatgagacttattcaacctctttttagctggtgtttcattaccaccgaggatttataatgcaatagctctgaggcaaagctggtaagaatgccagcttcgctaatatttagagtcataaaattctggatattggacaagctcttaattactctgaatccgtctttgtcttaataaaagttggattgtacccactaaaacaagatggctgtgtttgcattaatctccaaatgtaggttaatacctttttaaaagctgtctcctagacaagagacttgaaaattaatttcccattttcagcttaaaacgaagagctcttccacgtgtggagattgaagggctgccatttttctgatgctgtagattcaagtgccaataataactctttgttcctctttagtttttttttttttttttaatgtcttaggtaaagaagtctttcttttctggtgcttggggacttgtattttttaaaaatctgcttcaaagtaaatagatgaaatttcattttctcagtggagtttggatcactgggattgagggggatgaggaagggctagatagatagtatgaaacctattggattcatactatggctgcagaagtctgggctttacacattaggttgctaccaagctggatattttgaaatatatatatgtatatgcctgtaatgttttagcatttgcttgttgggttttttttttccccataatggtaggttcttaactgactttttcaaatgcaaggtaaaactttcttttccttttcttgtctccagagtactgatgtgtaaccacttagtaccactaatgccaggattcatttctgtgctacagatggtcagtgagattataaaagctctgaaaaggtttttatataatttgaggtcttctcagttgagagtttgtgtctgacatattaattccttcccatccaccccctgccccattctcaatgtaaaccatatgggacatgtattaaaaaacaaatttcagacattttctggagattttaattcagtagttctggaataggttgcaggaatctgactcttaacgatcaagcacatttgatattcagacaactctattgcatcctccagaagctccaggattctgtatataatttgtaggatatacttgcctcttctatgtcaagtctcttacccagtctgattatgtgagatgtcttaaacagagcgttttttcataaacctttatgtaggataatactactcctaaaacactttattacatagtttttggattggtaatggcaaaagaatgagaaagcacctgaggaggcaccattgtgagtgatgaaactggggtatcagacctggttatgaaaggagatgataacccttgtactgttttcagacagttgcagagttatcctatgaaggaggaaccataattctggtggccctgcagagcagaccggggactgatgaatggatgctgtgggggctgaacataaagagaacaggtttaacagaagggaccaacatcctttgagagatactactttttaccttctaattatttaacccatgaaactattattttctcccaaagacacctgtttttagactatcagttaataaaaagaatggggctacttaggtggaagctggctgaggggcacaaacagattaagccccttttctccccagagctagcaagcagtacccttagccagaagccttgggctccatagaagtggccacaaacacaactagagtatggtgagttctgttcagtggaggtggccgcacagccccctgacaaggagtcttgtgagctccgtaagggctggcccttatctgatttgctgctgtagacagccagtgcaggggactagcacagagggcagagcttagtgaaatgtctgtcaatgaaagctgtggaggacatttgtatctcacattcagtgctgaatgagatttaaaagtcctttctaacataaaaagtctgtgatctctgcttccaagattaattcttaggtctcagtatggatggcccaaggatataagctttgtgtctgcagggactttgtttcctatagtgctggatttccagtacgtagactagcacctgacattagtgggcactcagtgaatatttgttgaatacatgcatttgttgaaaaaagtgaaaattgtttaaagtggtactttgtgaacctttttttctcttttttctgtcatcctggagacttctcatttaacccccagtctgtctcgtgatccatgccccatccttccttcatgcctcacaccacctccttctcaatctatacttggcaaagaggaataaagacgctaaggatattgtggtaaaccaaagtcatctcagaaacacagtgaaattccctaggcatctgaattgggaaacctattggctgatttgctttgacttgggtatttcctgtgattttcagccgggatgtgctcctgtgctcagaagtgaggatctgttgtaggtttatggcctagattaattgggatattttgtgaagtctctgaagtgttatcacttcatctttatccttgcctgctattcctcatgaaaagcatttgaattattttagagaagatataaatttgcttgtgttatccagtgtcagcttaaagctgattagcattttgcatcacctttgcaactcataaatcatccacttaccctctcagtaagcaggctgtaagtcagcatggaagcacctgctgcagcttcttgtcctgtgatttagaggacactccagattctctgcagacccttctgtggtgttattctctggtaaggcttcacctatatgggaaatgagtaaagacttttggtgacttttttttccctagggagttcttaagggttaccctggacgagagacttctcagaaatatagtctttaataaacctggtccaggcacaggtttggttcatttggcatatttgttgttttaaaaattttggaggtacttttcaacatttaaagtccaggacatttcacatttaaaaaaatccagatttagggttattccgggaaaatcagaacacctggcagtgtcaggccatgctgcatgcctggcttcatttgttattgagagcaggagtgctctaggaaaggggtacagattttccattttgctgtagactctacccctctcagtttttccatgggagtcaactttactcaaagtcctgcactgtagatgcttgaattggtgacatccttctatgttgtgcgagtgtatagattgttttttttgtttcttttttgagtaatatcaaccatttaactcaattgaataataacaagaggctaacatttatcaaatgctattaatgtaccaagtactgtgctaagtgcttgtaatatgtttgtttatatattctttacaattatcctaattgtatagatgaggaagaaattgaggcaaagagaggttagataacttgctcaaggccacctagctagtaaaagtcgggcagagtcactgtggtgtcctcagaagcaagtccctgcttgggctagcatttttgcctagtccgggttatctccagaacctggtctgctcctcattcccatatcccattaggaacagtgggcatcagttgcaaaagtagatgacagtaacacactccctaagtccccagtctgctcctgggaggagcagcctgccttgttcatggcagtcatagccacagggggatgtttgaaagacagccccttatacagtgtctattgattttcttcaccctcttgttttgctcatccatcctgttgttctaggatgcttatttgtcatgcataaaagccttgttacagtgaacccaaacaagtcattgacatttaaaattaaattgcaacaggtattgtcaatagctaaactgctcattgacagtgcattgctaattgcattgagagaacatcctaactgggtatattctgccaaatcaaatcggaaacattggctgtctaccagcaaattcattttgacttgcacagagtttggggatccacagatccctcaccaatctcaaaatactgtgtttatggaaacgctaattattatttttttttttgctgaggttctttgcagagaaggggaattctgatcatcttcactgactgctaagccaggagtcagaaactgtgcctttggaagggagagaactacagatttggggtggagtaaagttcaatgcaagggggtcatttggggaggtgggccatcaggttctttatctgtaaatctaagccatatccttggatccattttttttttccttctctcctttttcatccccttctctctcttctataggtacatgggagggggacaagggtggagacacttaatttttattaagcactgttcgtggtattttatgtgaattaatttgtttacttcccacaatgaccctggggagcagatatgctatcaggtaaaaaaactaaggcacagagagggtaaaactcttcgaaagagtcttgtggttagtcagcttctgtgagagtgagagtgggctgccctgaggccatctgttccctctccccagctgatatttttgtgctctcagggtaaacatttaagcctgtgagttaaactcagccttggactagctgagttcctctggaggccttgcaagtagcagtttggttggcagggcaattaagtatgctaggtgcactgtgctgaaccccaggagggagggaaggaatggaatctagtctttgcttgcgttatacatgcttattggtttgtggcaggcgtgattgatgccagaatcaaaatgacttaaagcagcttcccttgagaagcactactctaacggttttttttcctctttgttgccctaggtcccttgtgaataggatttagctctgattcagctgctgctgttcttttggtaatcagtgtggaggaaggagatgagggctgctattaatggcttcttattttgcattctcctaatcagatatcctgcagttattagtgtgaatgcaagatgttcggtggtgtccctgggtggttttcttaggtgtactggactgttagctttctaagatggaatgttttattaggttctggcctagggggttggttagatgggtggaggttgttaaaaagcactaaagaaaaggaataggatataaaaccaatcttcagggggtgggaataacaacccaccaccttcacttccctcccctcctgccctgaaaaccttatcttgctaatacccttcagatattaaaagtgaaataacagagctatttactaggcagctaaatgcaaattctctcccccattagttttaattaggatgaaatcatacatttaaataaccacttctattactaataactgaacttctgattcactctgaacccaggcaaatgcctcttctggtatgaatggcccacctctgagtcattccgcacctgcatattgacacagccaggctcctgatgtgggtacacacatctgggatttaagggcatgactggcatgttgaatcttgggtataaagctttctgcactataccctggggacaaacaggatagctcaactggagaataaagagcttgcaagctcaaaagaaaacaacaaccaaaaatacctcaaccaaattctgctcttgcttctatcctactgtttctttaggtgtttaaagggctgtagttttaaaaatctcccacccacctcatctttttaagtaaatgtcacaacagtactatgtcaatacagttgaaaataagtatttgagttgaaagaattggctctttgaggctttaactatcagatttgtgctaattctttactgtttccttgacatagtatatgcagtctgtgctaagagagtatggatgttgtcgtcggtgtatagaatggtggctgttgtaaacttctgtatgttggggaaggattgaacctgctgtctggagaattagaaaccagcagcttgacttaaatccctcagtgtcacaaccagctaatgaaggagaggactgctaaactcccagtggtctttgtggctacgaggacttactcaagtttgagactatctttagtgggccaatgacgtaggaacacaatcagcagaggacatgtagtttacagcagcctgtaatgtgccagagacatgactagctgcctctttggccctggggaagtgtgtctggccctgcttgcatcctctgtgagtgggaattgtgccagacaccagctagacatgaccagctgcttcttcgatgttctgtggacatgattggctgtagcttttgatcaggacagtgttcctaatgaagtgtgaccagcgtcatttagacaggaaagaatgacagctgatgtgcaagaatttttcttgattggcagcatttggaactagtaaccagagaaggtaggtggggggaggagaagccagctctgattgacaagagcttatctttatttaatctacttctgaggcactgaagttgaaatcttaggcaagtgaaagaaaggaagacacaattgtgaaacataattaaagattcttgacaaaaacatacttaaatcagaaatgtcttttttttttcttttttgagatggaggtttgctcttgttgcccaggctggagtgcaatggtgtgatcttggctcactgcaacctccacctcccgggttcaaggaattctcctgcctcagcctcccaaggagctgggattacaggcgcctgccaccatgcctggctaatttttttgtatttttaatagagacggactttcaccatgttaggctggtctcaaacccctgaccttaggtaatctgcccgcctcggcctcccaaggtgctgggattataggcatgagccactgcgcccggccagaaatgtctttcaataggagagcaatgcagagtttaggtgtgaggttatcactgctccttcggctatgagaaagagcttttgcccagggattgttaatttttaggcaaaatttaaagtggcgatgggcttggatagttctagcaataaaaaaagttctgcttctagttaccatcttgttgactttccaacctacttggaaagatttcctttggagaggccaaaaacaagtgctgtgtatggagtgtggcctgtggtggtaatttctcatcaactcttgatccactgaggatttaaatcttaagtcttcatgtgctttgagaaaagatgacaagcggaaatagtatgtttgtttcctaaggacacacatgtgatttctgagagctgattgtatgcaatgtggtggtattcttttgcaaataggcttgggaacttggcatcctggattcgaatctgggcaccaccattttccagctcattccttcttattcaactccaccccacctcgaaccccgatttggttttaaagattcacatactattgttttagtaattacccttgaaataaagtcacatatacttttaagtctaaagttaatccaggacaggtgcggtggctcacacccataatcccagtactttgggaggccaagttgggcggattgcttgagcccaggagttcgagaccagcctgggcaatgtggcgaaaccctgcctctactaaaaataaaaaaattagctgggtgtggtggcatgcacctgtattcctagctacttgggaggctgaggcaggaggatggattgagcctggaaggcagaggttgcagtgagccatgatggcaccactgtactccagcctgagcagcagagcaaaaccctgtcttaaaaaaaaaaaaaaatccatagcctaaccaccttggataatacaagtgactaccctatatctgatcatactgccaccccaacctaaatccagtatttgttttgccttttttttttttgagacagggcctccctctgtcactcaggttgaagttcagtggtgcgatattggctcactgcagcctcaacttcacaggcttaagtgatcctccccacttagcctcctaagtattaggcatgaagcaccacgcttggctaatttaaaaaatttctatttttgtagagacagggtctccctatgttgcccaggctggtgttgaattcctgggctaaagtgatcctttccacctcagcctctgaaagtgctgggattataggcataagccactggtgcccagcctattttacctttttttttttttttttttgaggggggagggcagatggtcttttagatttacctatgtatttgacaatttgtttgttcatatttctttcttgtgtctcagaccttccttcaggtttgacttttctttagaatttccttgagcgagtgcctattggtagtaaatgctcttttttgtttatcatagatgtctttcttttgcccttcatctcaaaaggtagttagctggatacacagttctagggggaaagattttcttctctttgagtcttgtaggtttgttgtgaagattacctgggttcatatctaaagcccttagcactatgcttggcatgtttgctctgtaaataacagtggctgttacattctcagaaaaatactggaacagttggaggcaatgcaggcttggttgggatgtccatactttgactaactttttacattattttcttaaaactttgatttcattgagattggggtgggagtacatttaagcatcaaaactaactttgaagatagatttgattgaactgtgagttctatcactcgctagttgtatatacctttggtagattatcttacctgtcctaagaatcagtttcttcatctatacagtgatcattgtaatacttcctatttctctgagttgctgggaaggttgcatgagaacacatttaaagctcttctccaagcctcacatagtaggtggctagttgtggtaattatttgttgcctgtaaaccacttttatgacttttatgtagagatgttaccaacttgtcttttttattgttgttgttctagctattctgtttttatttgctcttccccagatccacagaaaagatggggtatctcctgcacaattaactttctactctactgatggggaaggccttctgcagagttggtggctcttgcttggaggcaacactttgatgcttgtctttaggtgggaaagtagctttccaggcccagtactttgctacttgtaagactctcacttacctgaaaattgtttgctctggtttttcttgtgactttgggcaagttacctaacctctcagtgcctcagtttcctcatctgtaatatgggaataataatagttccttcctcacagggttgttgtaaagactagatgggttgacacacatgaagacctgagagcatgcatgacacagaggatgtgcttagtactttagcgttcatcagtgttgtcagtagccagggcttccttctgtaccatattgttgactttcagaataaaaaatacattgtttgctatgactttgtcccagggcgtgtgtattaagcttccacatataatttatatcacttattccttaataacattgtcatgggttagatgggacatgtatttttttcaactttattttttacatacaataaagtgcatcgatttttaagtgtacagttttatgactttgagctacagtcaccactgctatcaagatataggatatttctgtcaccgtaaaaattcccttatctctttcccagtcagtctgtcattcttacatttggccccaggcaaccactgatctgcttcctgtcattatagagttttcttatttagagttttatataaatggaattacattttacacactctcttatgtctggcctattcactcagcataattattttaaattttatctacctacctgcatagtacctatattttgagataggatcttgctctgtcacccaagctggagtacagtagaacgatcatagctcactataacttggaactcctgggctcaagcaacttctcccatctcagcctcctgagtagctgggactgtaggcatgtgccaccttgctaggctaattaacatttttttttttggtagagactgggtgtagctgtgtttctcaggctggttttgaactcctagtgttaattgaggcctcagcctctcaaagtactgggattataggcatgaaccaccacgcctggccagcgtaattattctgaggttcattcatgttggcatgtatcaggaggctggtcatttttcttgctctgtggtattccactgttgaatgtactacagtgtgtttagccgttctgctggcgatggcttttgggttgtttccaatttggggctgctataagtgagctgctatgaacatttatgtacaaatctttgtgcagctatgttttcatctattttgagtaaatatctaggagtagaacttctgcatcttaaggaatatgtatttttaacccccttttactgatcaggaggaacttagagggttggaactgaccaaggtctcacagccagaaaggtgtcaagcatggaccaacatttgatactccttttctgtttcctcttcaggagtcattctattagaccagtgatttcacacttttagagcaccaagactctttttaaaataaaatactgtaggtccaggtgtgatggctcatgcctgtaatcttagcactttgggaggctgaggtaggagtattgcttgagctcaggacttggataccagtctggactacaaatcaagactccccacactacaaaaaaaaaaaaaaaaattagccgatgtggtggcatatgcctgtagtccctgttatctggggatgctgaggatcacttgagcccaggaggtgaaggctgcagtgagctataatcacaccgctgcactccagcctaggtgacagagtgagaccttatctctaaaaaataaaagataaaatattgcttagaatttctataaacaagctacacaaaagcactgtaaacaggctccttagaaagttcagtcacttttttgctgttatcctgttgtgcacccaagtgcttctcaaggaatgtcttttttgcaaagtgctgcagtccatttggctgcttcttgagaggagagtcgtggaccccctgaggcctagttcttaaacatctcttcttagtccccattgcattagttgtttcagaacaggtcattgagcatttcgcctttgcattttggtggttcagagagtaagaaactctttctccggctgaccaaaaaaccacctctccctacgcctcgtgtatagattgggctgtacaactggtgagaatagtaacatcaccatccctgttgctataaatcactgctggtgatatagctccttgatccaaagggtacttcgggggatgtagggccagataggtacattcaaactcagactatttacctttgtcacctggtaatatttacagatggagcagatgccagtatgttccattgccctattctggagtagtgattctcattttatgttatcagagcctagcttatgaaatttgaaatgcacttttgcctcctttgcactgttaccactgcatcagagcattttaatcagcttgctttcgttgaagtgtacaatttttcttctcattacgtctgcaagctctcaagtttacagacatgatctccttggctagactaatattacttggccattcttgcatgcaaatttaaaatttaatatcttgctgcaggtctgttgagttttatgcaaattccaatatagattatattttggagctgtaaattagaaattacatttgggggaagtaatatttgtgtgggtttaaaaaaagtaatcttgcagtttgtatggtacatggcatttcttctgaagaaacgggattttgagtattctgtgtgggtttagtagatgtcttgccaattgtgttactgataatgaaaatacaaaaacaatgccagtatgtacattaaatttttttccttaggagacaaagtctcactcttttgcccaggctgaaatgcaggagcacgatcatagctcactgcagccttgagctcctgggctcaagtgatcctcctgcctcaacttcttgagtggctgaaactacaggcgtgcctcgctaattaaaagaatttttttttttttaatttagagacacggtctccctatgttaccaaggctgatcttgaaatcctggcctcaagcaatcctcctgccctagcctcccaaagtactgggattatagggcatgaatcactgtgcctggcctacatcaacattttttatgacatttggctgctttttctaagttatttgggattaactgtgttctctcatttattaattcattgagtatatggttatggatgcttgataggctctcctcttggctttgatgatacagcaacaaacaaaacaggctctgtgctcatgaaacttaccttctacttgggagaaacagacttcaagcaaataaacaccaagtaaatatttggtatctctgatggtgatacattctgtggagggaaataattcagggtgtaggaataaaggtgtgctgagatggaggtgctagtcatcaggaaagacctctctaaggttacctttatgcaaagacttgaagagggaatggaatgagctgcgcaactcttcttaggagaacattagtctgggtggagacactgcaaggtacaagtgtcctaagtgggtgctcttgccgtgtttgaggagtagcaaggacgtcagcctgactagagcagagagggaggtagaaatagggcagaggaggggtagcagatgatggagaggtgtcacaggtcatataggaccttgtaggtactataaggactttggcctgtgctctgaatgaggtggggcactgtgggcgagggctgtattaggtaagaagactctgaccattgtgttgagaatggagtttgtggggggaaactcagatctttggatgatgggcatgggacaccatcatcagccattgcaggtgtggaccttggatgctgcctgcctaaggctggtgaccaaaaagaaggtagagttggatacaagagcctggcattgttggcatttttgtgtttgagtgtcggaaagatcgtggcagaagcctaagtatctgtgttgcttgggcctagcatctgtgttttcacaaatcccccaggtgatttgatgcctctttaaaacacagaatgttgggccctacccaaagggtttctgattcaggaggtttagggcagggcccaagaatttgcattatttacaaatgtcaaggcgatgccagccagtgctgctggtcagggaccacgctttgagaaccactgctctggtgaatgggtattgctgtgttgttatctgcaaagttacctttgtgtacttctgctttacaaaataggatgtagcttgaactctgagtcaaactgccatttactgtggtatgaccttggatatggcatatacagtgattcctcacacatggtgttaataagttcttagtaaatgctggctatttgaatatggtatgtaggtataaaatgatgtggtggaggtaaaatatgaataatttgctgaatataagctctggactgtggacattataaacaagatcttgttttgttttcagcatgacatgaaaggttcattagctttgttttacacatagggaagtggcttattcatgatcacgcaactagaagtagcaacggtagatttcaaattcagttctttctggcttcaaagcctgagatttgccaccaccgcatgagctgcttggagtactggattggctctcccacagtttttgtcattgtgtgtgtgtatgtgtgtgtgtgtatatgtatgtgtgtgacagacagagagaaggagaggggtgtgtgtgtgtgtgtgtgtgtgtgtgtgtgtatgagagagagagagaaagtgtgccagaaattatttgcgtacgttttaaaatctctgttaggccattttttaaatctgtaaaatgggcatgaagcatgcagagttcatagggtttctttgctgagtagaatatgggatggcttagcattgtattttttttccttttctaattaaaaaaatttcaaagccaaatcgaatctagatagaataaatttatggattttttctttagggttccttattagaatggattcttcctaatatgaaacttgagttattgaattttgtgtggagaggatgcttctcattagggtctcagtttgggaagaagagattatgttccctttaaaaacagcttactgtgtttgcaattttagatttcttatctcaggaagttcacatactgttaggataaaactttcctagataaggcatctgtacaaaggaatgaagtatatgggaaactgcgtgtgtggggagaccatatctttaatttttgaaagggctagggtagcctggtggtttggaaaaattaaaagtattgcataaaagtcaaatgtaatagcaattattgttagtgttgtaaacttccacttatccacaaatcagatgggtggcagtctctttatcttaagttctggttataaaattgaaaaagccattgattaacaaatagctgtcacaaagctggaactttcatagtaacagtttctggtgaagcttcccttgatccctgactcaatcagctaggtagagataaaagagaaattttgtattctgaagatgtacagacaattataaggaactctggttgactgcagggggaagagacacaatagctattaaaataaaagtatgacagttgggctaaacaggcagcctcaaacatcctaggagtccctgagggcaacactgtatgtagtgactcaggttcttagaggaaagtgggtcatcaacaagaagcatacaggcttgtttttggtatctttataagaatagagggaaataatgagtgtgtcagagagctcttgtcaagtttagtttcaataaaacaatttgcttaggggtaagtttatttgggaaaataaatcactgataacagcataaatactgtgttcctcagtgatgagattagatgagtagggaggtagtggggtgaggtagaaggagcatggacttggacacagatacttgattagaagcagaatcaccttagatatctctgcgccccagcttctctgtctataaattgggaataatacctgaagaggtcattgtcaggattgaatgagatgatgtaagcagtgcaccttgcccagggcttaataaatagtgatgagactggtagatttctctgtgagggggcttcaggatatacctcccttatacagacttctattcctttgagtccaccgccccccacaacatctttatgaactgtaatgtatctcatactgtacaagtcacccatttaaagtgtacacttcagtggcttttagatttacagagttgtgcaaccactaccacagtcagttttagaaaatgttcatctcctcgaaaagaaatctgtaccctttagttatcattactttattccctcatcctcttcctcatcagatgttgtaggcaccacctttcttcccttccttcccttatcttcttttcagctgtggactgtgctgatttgcctgttgctggatcatgtgattgaaattctttgaatttttctgtaaatagccaatttagctttttcccttccagagtatttgtttctttgggtgtggaagcagctgctgcagccagtgcaagggctcaccattttgcgctttgcggctgttcatatggcaactttattcaaaaccgctcctgcactgcttaagttatttgttttatacaaaaacagttctcgctggcttgcggcttctctgctgccatgttgacaaatgttgcttctagtgaaatacacaaaaataaataacagcaagggagaggggagcacagagctaagtgaattcattttgcctcttgagtgccattctcatttgttttaaaaaccaccctggcacagacagaaaaggagaaggcagagaaccgcaggaaaagaaaaggccacatttgattctttgaattgggctgtaggggctggctgaacagacaacttgagaagtatctggaatgtaggccctggggatgaggaaaagtttacaaggaatctgaataacctgcagatattcatattgcaacagcccccatttacatagtcttcagagttcatttggtatgttctcttgttttctcgttctgttgatgacgagactcaaatttaagcactgctggtgtagtagtacatgaccatggttggtttctgtcagtgtggtaggttgtgtattaggaactggaaaaaggcaaaagcgtaagggtgtgtgggttctcaagtttcgatttgaaggtctgacccacatgagaaggtggagggaatgctgacaaatattgattgcctttctgagccaagtatttccacaaatactatgttattagtattattattatattaagatatattagtattatactattatattagtatatattagtattattagtagtattatattagtatattagtattattatttgtatataacaaatactatgttagtagtagtagtagtagtagtagtagtagcagtagtagtagtagttttcagagagagggtctcccaggctggagtgcagtggtgagatcataactcactgtagcctcaaactcttgggcttaagtgatcctcctcacttagcctcccaagtagctagacccacaggcatgagccaccatactcagctaatttttagattttttgtaaagatctgggccttacaaagtgctgggtttataggcatgagccaccaggcctgacttcagaaacattgtttcattggttagcatgacaaaggttggtggtcttagcttcatttcacagactagggaggacagagttttgaggaattgtggtacttacttgccaaaggtcttactgaaattaggggagtggaatgaaatggaaaccccgtgcttccagacctagaacttgttccttttctatattagtagtaagccatcagaggtatggaagaagaaaaggagaagggcattggaaaataaggagggataacagcaagcagtagaggccaaaaacattttgtttagaaaaattgtacatcttctttgaaggtttttgttcattaaaaatcaccaggaaaacgaaagtgacttgcaagtccacaagaaactttgttttgggtgtgtgagttaagaatgatcacctgaccaattattattgactagaaaaacatttccctgagcctttcataaattatcttaatgtgcatattgttgaggcagtgtctgataaataacagcctaattggccacccagggtctgagaggtttgcttagccacaactagcctttcattctgggtctggcagattgatttctttccatttgttgcatgattttcaatgctatttatgacctaaatattctgttcaaaatattttttttttggtctattgctaatagtagatgcctctagggagaagaggagagaagcaagagtgaggtgacagggacttacttttccttatattctccttggtactttttgaattttgttccgtgtactattccatatgatggaaaggaggtaagtgtatttaggcaggtggaaggtaagaagggtagatgaaaggatgaattattgacctgaacttcaggcctttattcatcagtggtttagcctgtgggattgtttctcagcatataaacttcttcagttatgtagacatataatagttacttgttcgatttattgcatctgcaaaggtatggccaggtgtcatcatgaggaagtatagtagtatagtgtttaggcttaaaagattctgaaacctagacttcctgggttgtaatcctttctctaccacttagtggctgaacgtgaccttggatcttactttatctagcatttttgtgtctcggatagcttgtagttaaaatagtagttataacaaaacttgtggaattggaaggattacatatattacttaatccacatgaagttcttataatagtgcccaatacacagtactcactaaaagttaaatttttttttgatgactattatcacagatggtgatttgcctcatccatctctctgtcccttaatgtggtccaaaatccaccccccgccccacacccggccttaatgcccagacagtgcccctgtactgactaaggagcctttcttttgagttcactggtctggcactggctcctagaagtgctgttttccagtgacagcaggatatttggaccactgggagagtcagtgggctggggtgggcccttgctctctgcagaggtgttctttctcccagtgggaggaaacaccacttgtcagaacacagctttggcttgcccaggttcctgttgtgcagatggggcctagagtctctctgggccccttgtcatggatccaagccaaggctgtcgcttgctgagccaggaataatataggaattagtctttttcttctttatactaagcactaatcaatctacagttaactctgtatctaatttctgaaccagatgccgtgaataactgcccctgaatgtgtttttgccaataaaaggataagtttaaggcttttaatcaatgccgcttgcactcagtatttaaggtcagaatcttgtgtgcgacttattttgatcaggataattgttgggttaaaaaatgaacggtttttgaaattgtgacactcgcggttgactcgtgggtgaattaatctttgagaggatggaaaattgtcgagttcataagagttctcttgctctctagttgtctttcaggtcacttatggaaaaatatgacttttaggaggaaggcattctttttcaatgggaaaggagataagagactaatagaaatttctaaggagtcagtgatggaggctcaggggaaattggaaatgaagctgggtgttttggatctgcggtgagctgagggactggaacagcagctgtgtatgttctaggtaatattaacttgttgtaattttatgtctccagcatacctttttcaaaggaactcatgtttcctgaccaacgactgtgtactgtctagaatgaagcatagtgtttagaaacatctggggtttagatattggcttcactgaatggcctagggcaagtcactgagcctctgtgccctcagtttttataattataaaatgggatggtaatagctacctcgcagttggaaaacttaaatgtgatcatgtatgtgagaatgtgaagtgcagtgcctggcacacaagaggtgctgaaaggagcatctccttttacttctttgtggagtttgtttggctggtctgctggtctgtcatacatttgtctggtgtgcctctagatacacgtaatgtggaaatttccctaccttgtaacagtgagttggaaattgttcctgttgatctgtttttttttttcttttgtgcttagggaaaggcatgagaaaaatgagtcaggatgccctccatttctggagaagcttggtggtaattctgttccccagtggctcacaagcctgggcagttcagagaatatgagaattggtagatcatggagaactaggctctgcccctttggctatgcgggagttacttagtcttcctgaagtttcctgtccatgaaaaggggatgtgtgagggtgcaatatgggtaatgtttgtgaacaacctttgttagtgtcaggaaagtccaaaactatgtggtgtggtattttcatcatcttgagttgacaacagtgcttatccaaaagtcaattttggtattttgtcaaatgttaaaggctcaggaaataacttccaactcaaggaagatttgtatccactctggagctggaggagcttatattaagaatgtaagatacttgggctcccaggatttctggaagagctggcagtctccctgaggttcaggttctcagaccagcaggccatgcatgggggcttgtgattaagctggtgccgaacattgctgaattatataggtctttctgtgctacaggttggttttctgctgttcacatgtagtctaacagtggcctgttttcctttgcctcaactgtgacatcccctcgaagtgacctttatgaaggcagagcttggatctgccttgcttcttgctgcctactgtgtggttttgtgcagagtgctcctttccctcctctggtgtcttcacaggtgactcaactggaagaggaggttaaagaaggtcgggttaccaagcacctctcttcatgcctcagccaatccaggccccaacactgtgtgggaagaggtgttcatctgttgagaaggggtggggacaacatatgttacatacagaggctccaaggtggttttgatgagcatagagtatagtgggagaaggagcaaaggatggtttgggaggtaggaagtaaaagtttcagctagagctgactgtcaaaggccttttctgtctttagacttttactctgtaagatacagggatttgtatgtgaggcttttgactttaactctgttggaatagggatttgttgcaggctgttaagtagggaggatggtatgagagatgcattttcaggggtttcatttgctcatggcatggtagaagatgaagggtggatggtgagtagagtagaaataggaacacagaagactgctgcagtatttcagatggggattgtgtggggcctatttaggtcatctccagtgcaggtgcccaggagaagttacagtagatactgttgtacttgtaaaggaaaatgacattcgagttcctgttttgtgccaggaactttaagtaatctgcatatcttagctcatctcattctcaaaacagcaacaagcggaaggtgttatttctcaccgtttttcaaataaagaaacttaggtttagagcataagtaatttgtttgccatccctggacagctcctaaattgcagggttgaggttaatacctgattacatccaactccaagtcctttctgttcgcattacaccacactgtggccctcaggacacagcctcatgtagtgattttgcattagcaaataactttgtaaggactagtctgttaatagtgatctctttcaacattcccatgagatgagggagcacaattaattgttcagctgagggattagagatataaggaggttaagtgacttgacgaggtcacccatcaagtggtttggggcggacaggcagaggtgagtgaggcttggagctggccattttgagacagtggccttatcgagaacaagaattttccagcctcattttataaatccaggcttctagttctatagactagggaaactatcatggaaatggtatgcaaggcaagtgcctgaggctgagatggcacaaagcaccgtggtatcttggggttactttataatcaaactctctcttctagcatagtctttaattaaaacaacaatcatctccaccaaaaactaatcatctttattaagcatacagattggaggaagagtggggagtcttgtgtctgagaaagatctcaccaataaattgtttcctttgccataataattgtgttgctgagtttaataattagaattctcactctacgcttcctttttctgtttgattttacgggtctgacatcgctgttgtttttcctgggaatacttgaggtgtcacaaagagcaacattatgatgagagccatgggaaacacttgctaattacagtatattgtgcccctgttccttatctatcagtctctattggttattattactcatttaatttttatttttgagagatgaatgcacagggcagaataggtcctgagaatgaatctagagctttgcctttgacttggatggacactttgggcatgtacgggtcaagaaatagatgattgggtatcttgtggtaggagctagaggaactattaatacatttgggagtggggagtgaaggccatggactgaaaagatgccgaactacaaacctgaatgattttatagtttgctaatggttatccctggatgccatgcaccatcatgatttaactgagccttgcaaacagggacgatacttttcctaaccccctgccatctactgctttctcaccagaggtcacagggcaaagacaagtaacactggcattgtgcatgtgtgacaggtaactgtaggtagtaaagtggccacctgtaccattgcaaccctgtgtaatagtctagtgaagtgatctgctttctgcagtcaggatgccaaatacggtggagaaggaagtgacagtcatttacagtgtcatgtttagtcttttgcagatgtgcttacagttttaacaaaggcggagaagaaattatagggtgggaaagaaatgcctacagacaggctgctaaagcctaagaaggaggaaactagtatttgtgtgttttaggaatgctaagcccttgcttacatatcagcaagcaaaatattggcattcacttctgacttgaggaaggcatctctgaagtcaatagaaggaaatgcctaaacacaggcctcactcagaaagaaaggagagctgtggaaatactcaggattatctcataaaagctctttgtgtatttgaagcctctaatgaaatcagccttgttctccaggccagacaactccagttgttcttacctttctttattgtatcttttttttttcatttcttttatgcttttgtcatctcttgaaatttcttttctttgaataataccaataaaaattgaactttttgcctgaatgcagggatgacttgctagtaactaccagtttttatcagaaagcagagtgggatgctcagtgatgttgttgatggtgaggatgtccaaatcttctttttatatgctagctccattgtctgctgcatttacctgtttgtagcgttggtgcgtggaacattggggcatataaatgtttattgaattagtgaatgaagatatactgaattttttccttaaaaagtcagtatttgctttgggtcaataaagaaaccctttattttgctttttcttcataaacaccaaaatcctaggaaatattggttttactttgccacagcactctgcagcttgtacagacttttccagagatgaaaaattctttctcacttctgtattagtccttcgctttatcctctgattcctccttccttccttcccttttctgccttcctctcacccattcatgtattcattaattcagtaaatgcttcttcaacctctgctataagcactattttaagttctagggatattgttataagccaaataatgtctctgctttcatgaagcttatatttgggtggtgggtcaaggaacatgattgatcagaagaagttagatttccctgttgggacaaggctttcagagaagtaagtggttgtataggtagtagagataaaaggattgctccctgtgagggacttgctggcaggataggctgtgatttcactttattttctatttacataacaatctgaatcccaatatagtgtttaacctgatatgtaagattctgtttgggcagggttttgtcagttatcatttatatctcctttcttgaaattagatcagattcctttgatttatttggagagaaaaatgggcaatacacaatgtgtttctgctgaatattttgctatgatgttgacacagtaatgtacactttattttgattttagtgtgttttatttaaacattccattattcagaaattgttaccccctccttgttattactgtttgcctgcagttatttagaaagcagtttaattaatgttcttttaccgccccctgcttcagtatgagtttcaacacttttaatacaaagtgttcatatcactgtatgaacttactaaaacccaggacagtgatattcattcattcattgctttatccagcaaatgtgcaatacaaaaaaagatacatgcttcctctctacacatttcagtctaatatgaactgtttggttgaaatacagaaacataacatgcaattctctgggataaacgtttcactaaataaacagcagtgagaattctgaagatacacttaactaggtcagcctaggcttatcagagaaggcttcacagcataggcgatctttgatctggttcttgaagggtaaggatgtgttttccccccagggaccagttgagaaatagctagaattaattagttctgctgtaatcattgaggtgctgatcctagagtgtggcttccactgcagtactggatgtggggatgatgatctcattgcaaacacagcctgggtgggtgtttttggttttgttttaaggattctgaagcagcatatacacaaggttgacctcaggacctctttagttggttgctgctgctgttcacaatagatttagattggatagggcttcagttttcttactgttgcattccagcattttggatcagtcactttattacatcatttactttctggcttaggcttagttgttattaagtgaatcagggataaaccttaggctactctcctgcttcctttttcaaatgatccggagtaaataaaacaactacatctctttcgtcactgtgtttcgttcccatctcagaacgggtaaaatggccaatattttcagtgaaaatgtattgaaatgcatttcactgaaagaaatgttcacattcagtgaaatgtatctaaactctaaaaagagtctagaaaagctcattgacacatttgttacttgctgaaagccccagtgaattttccaacctccgtattgtccttaaaaattgccttttagttcttaaggtggtggaggtgtgtttttttcttcccccttaaaccctcttctgagcaatctttgcagagacacctggtgagagagtaggcccttctgctttgtgtgccctctagtaagagatgatcatcagcagctttatatcctaatgtagaaaatgtgctgtgctagatcatttcaacccagcaactcacctcttcatgcctaatgcctggagctagggccttgtttctctctacattagacaaaaaataaataaataaatgtgggtgaggataataataattatgatggcaggaacacttattgagtaagcaagtgtttgcttatttaatctacctgacaaccctaccagatgtaggtactgttattttctccatttggtggataagaaaactgagtcacagagagactcggtaatttgcccaaggtcagacagctgtctgcccggggaacctatacacttaattgctctgctgtactgtggttgagtatctcttatccgaattgcttgggaccagaagtggttcaggtttttgattttttttttccgagtttgaaacatctgtatctacataatgggatatcttggtggtgggacttaagtctaaacacaaaattcatttatgcctcatacacgtagctggaaggtaattttataaaatacctttaatgattttgtgtgtgaaacaaagttttgactgtgttttgactgcagctgctcatgtgagtccagtgtagaatttttcacttgtggtatcataaaagtttcagattttggagcatttcagacttcagattttcggattagggttgtgcaacctgtacttcatgagccaattgagaaaaatgccttcataatttctttctagggcctcaaacgcctggacgtcacccctgactattgcatgttgtgcattggacagttagatctcctcagtgcctgtgaacaagtgttcttttgagtgatactcttctttttgtgactgtattatataatatagctttcatagcccccactttatttgctgttattttattcccctctcatccccgcccccccccccccccccccatataaaggactcatttcaaagatgggcgaacctggaagctgaacctgactctactcttcatgtcttcaatttactggccataaaggttcagttttgtatgggatcttctgtcctctagaagatcccgtacaaatagaggctttaatttatgcttgcattcttgcattttgtgtgatttattgcctaataaatgaaagaaaaaagtttatttagatagtaaactgaaaatgaaaaaccatttttttccacgaacttgctaattttcttccattgtatagtatgaactcaatctacaaagatctggcaaaaaaaacaagtatcatgttctgtaacaaactcagttacactaacaccagaacttactgagtttaattggagataattaaaaaaaaaaagttctttttttctttttttttttttttttaaatagagatagggttttccatgttgacctggccgatctcaaactcctggcctcaagcgatcctcccatctcagcctcccaatgtgctaggattgcaggtgtgagtcatcgcacctggcctcttaatgtagatgattttttaaaatgaagatttttttcatagtaagaaaagggaaaccataattccagaccacagagaaggacttctttaatatatttaacctctttatttacagatcacttctttctagagagactaaaattagggcagagaaacctaaatcctacatacaaagagctgctgcccattcaaaataattacaagtgtgtcgggcgcggtggctcacgcctgtaatcctagcactttgggaggccaaggcagtggatcatgaggtcaggagtttgagaccagcctgaccaacatggtgaaaccccgtctctactaaaaatacaaaaattagctgggcgtggtggcacaagtctgtaatcccagctactcaggaggctgaggcaggagaatgcttgaacttgggaggtggaggttgcagtgagccgagatcgtgccactgcactccagcctgggcaagagagcaagactccgtctcaaaaaataataataataattataagtgacagtaaagcatctccccacataatcctgtatatcagtaagaaaatatgttttgagattcacaaaactcaatttacgaatctctggttgtagttatttgacttaatatataagacacttaccagaggagatggttgcaaacagatttgatgacaggtaaatttttctaaaggtctgctaacttcttattcagtcatggccaaccactgatacaatgctgagagttgctttctcctttcccctctactagcttggggtccacagaccaaaaaaatctataacttgcaaggctaataaatgcatgcttcagctgcctggaaatgctgttggactggcaatttgctgccccgctctaatagagactgcctcagatctggtctttaacctggattagctggataaagagaatcctctgggatcctgtgtgccatcacctgttagtgtgtttgctgtataaatgtaacatccactaactttgtcagatgatgtctggcctggctgctgtggctgtgattggaattgaaacatacagcttgttattaaggtagtgactggctgtgggggacaccgacgtctgttgtttttcattgttgatctagtgagttagaatgcctttcctgggctgttaatgttaaatagttcagtcctgttagtcgttttgtgagatcatctttctgtgtgatttgtgtgtatttccttgatctagtggggtgcagggtcagggactgaggggaaggtataattgtttacagaaaatgtgacaggacatggatttgaaatcagataggaagttaaggaatgccgggctcctctgaatattaaggaaaatctttaagcccctaattaacttcagaaaatccccttgctctcacagatgggaatttggctgggtaagctaataactggaatgaaggctaggagttgtgggttaagtttctccctggcaaataccaatatttcaggattacttcgactcttgtcctgctgcctcccactggatctttacaaactctgtgcagtagagattatcttgataaagattttggatgcatgttgggcctttattgaatgatgaatgctgttttttattcatttgcacatttattgggtacctactatatgtcagcctctgttcttggtcttgtatggtggtatacaagagaaacaaaattcttagccttatggaatttatatcctagtggactataaattacaatgttcactatttgagaggacccaagcttcagatgttgtggctgtttggcacactggtccgggttgaaagaagagactgggattcaagttgtagttcctgtcctgatttctctgggcctgagtttaactaccggtaacataatgacattgggctgtatctaattatttatagggttctttccagttctttcacttatgatcctgattttcccaaacattttagccaagttgtctttttttttttttttttttttttttttttttgagatggggtatcacccagtcacccaggttggagtgcaatggcactatctcggttcactgcagcctctgcctccctggctccagtgatccttccacctcagcctcccaggtagctgggaccacaggtatgtgccaccacgcctggctaatttttttgtgtttttgatagagatggggttttgccatgttgcccaagctggtctcaaacttctaagctcaagccatctgcccgcttcggcctcccaaagtgctgggatttcaggtgcgagccattatgcctaaacagcccagttgtctttaatctagttgggcttctggctaattcgtgttggtgaccaatgtttgcatattaaatcaaacaatcagttattgtactggagaagaaaataattgtttctaaaaagttcatatttcgactacatggtcatgccatttaaaaaaaagtagtaaagcaacaataaggaaatactcttttattctggaatgacatacctacctgaaatctttgagtttcccttgtgtcatgtgagctggttgattacaggtgaggagaattgcatgttcttacatgctcctcagaaacactcatcactgtgtaaaaaatgcttttttgtttgtgtgaaatcataatatagagcccattccaccatacaccttcatcatcaagctcggggatacaagcctgttaatcaagtgggaatacaggaagtgagacatgaaacactggttttattttcacacctctaaatgagtgactgcagaggatgaacttaaaaataataatgccacctcatacttgcatcacaccttttaataaggcggtttaaaaatatttagggtgaaccttcatcaggatgctttaattgcctcagcatagttgaatagtacattagggtaatgcctctgctgtgctgaaaagcctggagggagatactgtcactcaatgatgcgttgaggatgattaggtagaaccccttcagatcttgggatctcagtttcctctcaaatgcatgctgtgggtagagaagcctgggctggtgtgtgtataatttacatctgttataagtgactaaacttgtaagaacgggtacacaaggcatctttagtaagaagtaataatatctgccttagtaataatatcttctcattcttgtaggtccatttgaaatggctccatctctagtacatctttcctgactactcccacctggccatcatatcatctttctccattagatttcaggcagactagaccgagactgtgggtttttatcctgttagccacttagaggctgtttgatcttgggaagattacttgcttttctgtacaaagtatctttatttctgcatctgtaaagtgaagataagaatccctacttcatagggtgttagtgatatgagttagtaaacatgatgcccttagaacagtgcttggcatgtgctgctgtggttttgtcatcattattactccacttcttccttggtacatagctcatgttctccttaactatacggatgtatttagcgatctgccttaaattgtgatgtgttccttctggtctgagagcccttgtcacacataacatgataactttgacttggtaggtacctagtgagcatcttggattgagctcctacaggatttagttaagaattcaaagcagggtgtattctcattctgacttttaaagcctttgaggtcagttgggggcaggtcttatttgtttcttaactggtgaagctgccataccaaggccacttgcccatgatcgtctactgggtagcctgataagaaggtcagttactcaaggctgtggactcgattccattcttgctgatattactagcgtaaatgagatgcttttggataattctctgagcaatttaggccaggtgaatactggacagtaatttcctgaagtgccatgaagtggcaggaacatgatttatgtaacatgggctcttgctagctgggatgaacactggagcccctgccgtgctctggaattatgagtgcctgccagagtgcctgcctgcttttgttctagagagtttttttttttttctttttcctttaagttaaattctcaagttgcgggcaggggcgcaggtctctatggtgatgaatggagagatgttgaactggctggttgcaaaccttaccctagcagttcttagagacaactgggataaggacattttagctggttgacacttgggttgaaagtactgatgtaaaaaaaaaaagtgatgtgtgtatggggagggacatatacaaagaagtagtaccttggcattctagccagataaaggagatctgtgttttttaaggtaggagctttgagaaaaatgcaaaacttgtatatttcagcatgcagaaaattgcacttcactatcaggcaaacctcattcatattagcaagagaagtatatgagaagcatgtggttgtgggatgccattatcaggaagttgctgtgttcttgaccttgggctctggaagaacaattagccccttgcatgcaaacttgctcagtaaagaaaaagttttggccctaaggcctgtggaaccaggcttaggatggatgatgggtttattgtccttcacagccaaaacacaacagtctttctccctttctttccaggctacccacgtgagtacgttgataatatttctgagagttttaaagaattttccagcagaatgagagaagatagaaggaccatcttgataatttaaggacatgctcttatctcttgatctgctgcattttgtttttgcttctgtttaggccagtgttggtagttatattgtcttctctccactgggcggattacatgtagcaatccaaaattgtcaacataattattccacttcttctttggcacatagctcatgttctacttaactgtactaaattgtgatgggttccttctggtcaagagcccttatcacacctaacaggacacattggacatggtaggtacctagtgagcatcttggattgagttcctccagaatgttgttaagaattcaaagcgggtgtattctcattctgacttttaaagcctttgaggtcagatgggggcaggtctcatttgttttggattacatgtatgcaatccaaaagagttaggttttttaaaaaaattaattacccccaccccttttgttaaagagtcagggtctcactgtgttgcccaggttggtcttaaactcctggcctcaagtggtcctcctgccttgacctcccaaaatgttgggatcacaggcgtgagccactgcgttcagtctaatttttatttaaaatttaaaatttaaaatttgtggtatagtccgggcacggtggctcatgcctgtaatcctagcattttgggagtccgaagcgggaggattgcttgagctcaggagtttgagaccagcctgggcaacatggcaaaaccccatgtctacaaaaaatacaaagaaaaaaaattatctgggcatggtggcacgtgcctgtagtcccaggtactttcggggctgaggcaggaggatcgcttgagcccaggaggacaaggctgcagtgaggtgagatcatgccactgcattccagcctggctggcaaagtgagaccctgtctcaaaaaaagaattaaaatttgtggtacaatataaataacataaaatttaccatgtacagttcaacagtgttaactatatttacatcattgtgcaaccaatctccagaactctccgtcttgcaaaactgaaactgtctaccattaaataacaaccgcccattctctgttcttcttagcttcctggaaaccaccattctggtttttatctctatgaatttgattactctaagtatctcatataactggaatcatatagtgtttgtctttttgtgactagtttattttacttaacataccctcaaggttcattcatgttgtagtatgtatgtatcagtatgttcttcctttttaaggctaatattccattgtatgtgtataccacattttgcttattcattcattcctcagtctacatttgggttgcttccactcttggctgttacaaataatgctgccataaacatgggtgtgcaaatatgttcttgagaaccccctttaaattattttgaatatatacccaaagtggaattactggatcatatggtaattctatttttatttttttgagaaactaccgtactgttttccataagcagctagatttttaagaagtacatttaaattcatcgttttgggccttggtctccacgctgccttgagttgtccctaggtaagtgaagttctcagtcagtcacctgctctggcatacctctgagctttgacacacctcagccactttccatggctcactttggccctttgtaggttggtgcctctcattagattcaacgaacaatttctcaggatctgggcctaaccagtggtgttgaatcttagaaagactgagctgaaatgctcatcagctggtgccatgcttctcactttaggttatacctccagttgtgtttggataagagttggagtggcatgacagtctcccacagaatctgaaaatatagttccagatgtgcttctcccaaacttcttctctgccattggggttgcaccactggaaaagtgtgtgaagcaatacttcactctgacaccctgctactatatgcttgaggaagaactgaagactgtatcatggaatgagctgcccataggtcgcgcatgtgcgcacgtttgtacgtgtgtgtgttgagatgggagagggaatctagggatccttctatactccattgattatgctaacatggatcttatttaatattacaaggacatttctttgtcatcgtctttttttttttttgagacagagtcttgctctgtcacccaggctggagtgcagtggcgtgatcatggctcactgcagcctcgacctgctaggctcaagtgatcctcccacctcagcctctcaagtagggactataggcacacacaaccatgcctggctaatttttctattttttgtagggacaaggtttcaccatgttgcccaggctggactcaaactactgagctcaagtgatccacctgccttggccccatcaaagtgctaagattatagagacgtgagccaccagcctaaaaagacatttctaattagaaagtgtagtgtgaacttttgccgtagttggacttctctccatgtgggcccttaaacactgatatctcagtcatatgaagctatcaaggaccaaaataagggggcatttgccttttctgtcagtgcagaaccaataggggccaggccaggtatgaccaacccattgtatgtgcagtggcttgctccatctttctgtctctggtttatgtatgtgatcatttgcggattccagcaggtacatcctctccaataccttacctggtaagctgtctagtaaggtttatatttcagaccattgggggatccccctcttcatggcacacactgtgcctgttgcctaatattcctttattgtctgcagcatccaggaccaatttaaatgtcactttgtgaaacttcctcagaccctcctctagagcaagttagtcactgcctcttctgtgccttgctttgaggttattgtcatcactgaacctgacccagtgtattgtaattacttcagacggtctctcccaccagagtttatcctcctctgtgcaagtgctattttttagtcctatctgtctaccttagaaccttctgcagtatttggtgtattgttctgtctgtggcaattgtctggtaaatgttttatcagacaagtctctgatgcaatgggatggagtggaattaatagttttaatcatgaccatggcccgaaatagccgtttgacaacatccaagccactcactctctcagactctcacgctgggttgtgtaaattgaattctttcaaatgagcataagttaaaaaatacttagcacttaccatgtgctaggtactttgtaattaagcattttacttacataaactcatttaattttacaataacctagtggagtacatttcagtttcatagatagtgaaaaagacacacagaacggaggttacctgctcagttcaaaccctggagtgtagcctgtgagtgtatatttctttttgcatgtggttaataaattaatgttgtatttacagctttgcagagctgggatgcccttaacacatgcagctctggacctatataagctgtcaggtgtagaagagtgagcaggaaaaccttgtgggggtaactgattccttgtacaaaagaaccagatttcagttagtgatgaaaatggaggaagtgaagaatccaagtcgaatgatagaaaaggttatgtgtcgttgggcaagggttcaaaagacctagttgtcttgattagagaggaggggagctgagggaaaatgagtcacagaggaggaaataatgaagatgaagtggccagagaagacgggctcctgcaaggaggggcctgggttttagatagcctccaagaaggacaggaagtgtggcctgatgggattagctagtctcaagacaccaggtagaatgcaggccatctttgtagactgggccttggggtgtccaaaccatgaaatgcatggcagagtgtggacacacttgtttgtttatactctttctcccatcctgtacaatgaggcagaacatgaaggaaaaattaacaaacaccccaagtctcctgacacagggatcaaaacatattgatgatgtcttgcaaatctgataatttcattgaaccatgtgaagcttaaaattgatacataggcatacccttaacattaagtgctgctgtcagtctgacatagctggataaaccaatgttgaataatctattaaatatgtcagacttgaacaaagaacgtaaatcatattatattatttcagctgtaattaggtgggagataaaatcacaaatagatgagtttagtgaatatttcttagtgtgtacacagtgtcactggaatttctttccttgctctatgggaagaaagaaattgactgccttccaagtattgactgctgtccaggaagtgggaggttgaagggtgacttatgtaatgttcacagagtgggtttcatttataaattcaatgagattagctacaatcttcctgaagttaatggtgatggaaatgcaccattctgcatttagctggaaatagctagctatccaacttggagacttaattgttcctcagattatgatatgtttgcatttatatctccctcccctcctttcctgggagctggctgctgcctttattgtctagaaattaataatgcagaccagagcttgtgggtgaacagggcgatgtattgccagtcttttgatgttcctgtttcccaacccacggagtaaacttgattattgagaataaacaagggacataaactaaggtggaaaagataaagaaattgcattaggagggtccagtgaactgagctgtagctaagaaatggagataattctagtcattacttcacggggttgttgtgaagggtgaaatatatgttaaaccttcagaacagtgcctgccatgtagcaagtgtttcagtatatatcaggttgctttcattgttataagaaaactaattggcatttgtggtggatggtcagggtggtgtgaatgtgaaattcaagagcataaacatggttgtttcctcccagatggttggtatagtgaaacagacagttaagggtaaggaagtgtaggccctcattggggctacacatcacagcatgctattaatataagcagtgtatactggtcatcttttattgagaggctatggcttttttgtgtgtgtgctggtggtttttaaaatattagtttgattcatttcaggtgattttgttaatctagcaaaacatcttcttgcactttttacattataaatgaggaccatagaactttgtgtggacattgcagtcattcagcagacatttagcaaatgcgtataatgtgtgtgaatatttttttgtatgaaaggttttcgacacctgagactcactaccctcagccctgagttcacatgatgggtcggtggatttccagagaggcaggtggaggcgccgcagtgggagcatcctggctacctgagatgtgttttgaggtgccagcctcttggctccagctggagccaattggcctgttgggcatgagctacatggcatgtagagtgagctacatgacatgtagagtgagctacatggagttagaggtggttatcctacttcttctacatcacaactttgcagagcgcttcatataagacttttgtaaatttcggagatagtgtgctttatatagcaaggatttccagggacctactagaggacaacagaaggctgacatttccccctccaggccagtagcttgtctttcattactttgcataataactacttccgcttgctttttttcccccctcacctcagctgcacttaggaggacttaatgacatcatttaacgttaaggataaatataaaaccgatctgttcatgaacaccagtaaattgcacttaaaaaaaaatggtttcacataaggcagaacaggttgctacttaaaagagttaatggccagttggttttagagtagatcacaaaaagaaatgtgacttcacccgccaactccttagttaaagaaactgtgtgtttgcagtgttggagaaccatggaggaggattcagaactttaggcaggaagaactgtgaatgagtagccctgttattcccctggccactgtgcactcatggcttctgcacattactgtgtaaactcctttctcaccacctaaaacctaccaaagcacccagcgatcttcctgtatgtgaactcacaggtttttcttggataatttgcctttccattgacctactttcaagagcaattttccctatagctttagcaggtaactaaaaaggggagtggtgagaaagtaaatttggagttccaaagggaaattacttggctttgagctacttagtcaaaaacatgtattgcatgcaggtaggtcccaggcacagtgttgaacacgggggtacagaagtgaataaacattgcttctgctgtcaaggagttcacagtctagtgtggaagatctgtgtgcaagtagatggtttcagtgcagcgtggaaacctgcagcagtagaagtgacaaaaggtatgttggtagcacggaagatgcagtgctagttccgtgtggcaaagggtgaaggtgtcttagaggactccttggtcaagaagagtttggaggacaacagggagtttgcctagtagacaataaggcagattactggggcagaggaacagtggtctcttggggagattaggagctgggaatcaaatttcaagatcaggtttttttatttcggttcagtctcatacctgctgcctgtcatgtgaccttttttttttttttgagatagagtttttggtcttgttgcacaggctggagtgcaatggcgcgatctcggctcactgcaacctccacctcctgggttcaagcaattctcctgtctcagcctcccgagtagctgggattacaggcatgcaccaccacgcccaggtaatttttgtgtttttagtagagatggagtttctccatgttgatcaggctggtctcgaactcttgacctcaggtgatctgcctgcctcgccctcccaaagtgctgggagtataggcatgagccaccccacccggcccgtgacctgactttttttactgagaagaaacagaaatggggatccttatgtcttcattccttttgtttggcataggaagctggactgcatccaaaattgttaccttgtgcaatttctggataactgaagcttacacagcctgaagtgtacacaactggttaatgacagatccggttcaactcagaaattcacatttgtccagattcattcagttgccctataatcttaagtgttttttctgatgttggattcattccttctcttacttgttcaataaatgtttgccaagtatgttataaacaactgtgcagtctgatagaggtataaggtcctttctgtcagggaacttaaagtctttttgtttgtttgttttggagatagggtctcgctgtattgcccagactggagtgcagtggcacgaacattgcaaccttcatctctcagacttaagccatcctcccacttcagcctcctgagtgacttggactacaggcacataccaccatgcccagctaatttttaagtcttttttggagatggggcttccctgtgttgcccaggctggtctcaaactcttggtttcaagtgatcctcatgccttggcctcccaaagtgctgagattataggcatgagtcactgtacctggctggaatttaaggtcttaaagtggaaataactttgaaagtatagacttgtatcagattatgaggagccagactaagaagttaagacttaatgatttatacctctcagcccagagaggatgccagtgagtttctgaatttacagcctaaggcaaattctttttgatttctgtgttccttgactttatttattactgtaggataatgccttagtgtatttgaataagtttaaaaaatttatgcctaaaggtaggtttatgagctttgcattgtataaaagagtacggtatgtaagaatgaggactccaagagccaaacagccagcttttgaatcccagacctactatttatttatttgaattttttggaaggttagtgcgcagccgacctagtatttatgagctatgtgaccttgggaagttcatgtaaatgcagtgtctcttgccttacatggaaaatgtccatgaaaatcatacccacgtgaaagttattacaaggattaagtgaggctgggtgcggtagctcacacctataatcccagcactgtgggaggccaaggcaggcagatcactcaaggccgttcattcaagaccagcctggccaacgtggcgaaacacaatacatgtatctgcaaagctcaataaggcaaagcatagtaaaacagcttgcctgtgtctcatacacggtgctacaaaacctttaaactggaaatgccaagaggcacagaccaaaaaaaaaaaaaaaaaagctttaagaaaaacctttttccccaagcctttggcttggggaaagggtgggctacaacagaaaggctttttgacagtatcctccctattgctgccaaacacccagggaaaaaccacaccccatatcaccaacccctgccagtgcagctgggctgtgcagagttgatcttccacactggtccttggaagcaggcggtgcttcagttcctctgccaggtggtgtcaggagaacggagaagggtgctgatctttcattccccttgctgggcagaactagttagtactccatggcagagccaggagtatcagcggggtccagccttatgctgagcttccgtctctaccgtgtagcaaaaaaataatgtgagtcagctctcctccctggtggcagtggggctaaggggaatcccgtcgaacaccctaacttggaggaaataaaccagtgccagtcagtgcctcatattcagtggaaagttgtctgcagggccaagttgggaggcgaacttctacctcattgtctgcagcaggcaatgtgacccagtgccctgctttttccactctagtgatgatagcgccctggaggaagcagagtccacacccaccaccccatgctacatgtcaacaggggtactgcctgctaagcaaagatgtccagggctgggagcagtggctcaagcctataatcccagcactttgggaggccaggcaggaggattgcttgaggccagaagtttgagaccagcctgggcaacgtagacctccgtctcttaaaaaaaatttagctggcggtggtatgtgcctgtagtcccagctactcaggaggctgaggtaggaggatcgcttgaacccaggaaattggggctgctatgaaccatgattgtgccactgtactccagcctgggcaacagagtgagactgtctcaaaaataaaataagtaaatatcttttgatgtccgggatacagtcaaaaatctcaagaaccaggaagatcaccgcatgaatgcgaatagccagtaatggatacaagcactgagatgaatcggatgttggaattctgacaagaattttaaagcagacatcatgaaaatgcttcaataagcaagtatttatttattttaaacaacaaaaataggaaatctcagcaagaatttatgggcctaccatgagggaaatttttgaggtgatagaaatatatatcttggcattgtggcttatgcatttgtcagactcaacaaatagtgtacttagagcaggtacttttaattttctgagtaaagtatacttcagtaaagttgatttacaaatcagggattttcatccctgaagattctggttcagtaggtctaggatagagtccaataattttttttttaattaatgccccaggtggttcttgggaactcctgatatctccagaggaacctaggctagttgagaattcttcagaatattaatctgttagcaatctgtgtaaatagaaactaggtctggtaaattatgaattaaccagataactacttgcagaataaacagaatacataattagaaatcattaagtgtgttatcaccacatggaaataattttttgtattttttttattgggtagtgttgtgaagaatattacatggtatccttagaagctgtaaattgtgatgctgggttataaaaaaactgtattgtggtatgtttttgcctctctcacttaaccccacccttcactccattccttctcaggacacttatcttcttggtggctaatggcagggtggattccacatttgggaactgctgttgcctgggcagtcatggttttcatcagtgtgtcccagggcgtggtgctttctgtcaacatcctgctctccatagaggctgagaatgatccctgatgcagtcatcacggcttttaggcctctcccattggcctcactttaacctgatgactatcatatttccatctaggctgcatttttaaatcttgtcaaggaagcccagggactctcctcactgataagccatttccaatccaggcctggggttgagtcaggtcaccttatgttcttactctttcccttgacttagattggtctggctggtccacccagataaagtgtagcagtgtctgaagctggatgtgaggggtcgggaagttgttgatggggatgccttcattccgcagcacacatttcaaggcaagcagatcattttcctatagcagtactggtcagagctggattcaggggaaggctgtctgtgtttcccacgtgggccgggtgagctgctagcatttctgtcagtgctagaaggaaagtcattctttcaatgtggtcccagattcaaaatcagttttgagtgggtgtcagaatgtcattcctgatagcttctctgttttgacagtgcaaataccccggtctcatttctctgcttttaaataatagatccttgagattggccctgggtaggagacctcccccaccccacttctttctctgagttcaccatgggattctcctaatctagccagagctggatttgatccttgggtcactcctgtggtctctagccctcctcagtgcttacttagttggtctttgtttctattggttgtttttgcatgtgtcgtggttatcgtcatcatatgactaatgtcagggggtcaggcacagttatagcttctaattgtgttgcgcttttggcaagggaactatgtgtgggggaaaaatacttattaggaatcgtcagcctgcattaaagggtcgtaatacttgaacaatttgcacatgatatctatctctacatcctatatggactgtgctttctaggagggattagttaggtttttcctttcctagtatagaaccaggactagtaggggaaggcatagaggaaaatactatggttctgtttcagagagagcattcttgcaggggtttcccaaatgtaaatttttttgttttttagagatagtgtctcagtctgatactcaggttagagtacagtggtttgattacagctcactgcaaccttgaactcctgggctccggtgagcccctcgcctcagcttcccaagttagtgagactacaggtgcacgccaccacacccagctaattaaataaaaatattttgtagaaatggggtcttgctatgtttcccaggctggtcttgaactcctggcctcaagtagtccttctgcctcagcctcccaaagtgctgggattacaggcatgacccaccatgcctagtcaaaaatgtaaatattaggtcttatgttactgaaggtattccaggaatgtttggatgtggtacagaagatgtgggtattgggaaacctctaagaatatttccaaattttatcttctgttgttctttaaaaaaaatataagctgtgaatacaaccgtggaaccacaagtaatataagaggagctgatttcttggtgcctgcactgctgactaaagatccagtctggttgcttattcagtaaacctttgagttagtgcagggagtcactctctgttttctcagggagcccttatttgagtaactgtcattacctctttccctaacccactacctttaattgtccttctgtggttagaaaaacttagtgtttgaaaggcatagtatctcaagggaactttagaagtatatcttacctttgctcttgggcatttccagatgaccctggcagtgtggccacaagcaaactggagaaggctgccagtatgtgcacgttttaataaatggaggatatctagcacctcctaacccttaccttctcctccatctcatcccattttctgattgaacagtcacgttatttctagtcttaaatacttagcttttctagttgtgttaatggaattgttgtatgtatttcagttgtattacttaagtgtcttctaaaagacatttgtatactttataattcagagaaaattctttggttgattgaagatcttgctaccaggtcctggtggaagcagctagaatttcttaagcagttcctgtgaatgtttcctttttatgtagatcatttcttggaaagctgtgttttaaaataaagctctacaggcactactgttttactctaaggcctttgagctctgatatctaagacatatttatttcttcaactatgcccaggacagtgctttgcattcaataggtgaccagtaagtgttgagttttgttgaatataaaattatttacaaatgattttttgttttttccctttaaaaattaggcttccgagaaaactttgggcttcagagtccctgcttccaagcccctctttgtaacactctatgaaatgaaaagcatctttggatggtatggggagagctgaacaatgtgaggtgggagggcgttggcctttaatcaggtttctggggacagatcactcatgctggttcatgctggcccaaggctgtcttctttcttgtttgtggatgtgggttatgttcctatactgagatgtgctggatgaaaagctaataaatattaatgaagcagttacttctgtcaggcacagtattggctagagagataggtagaaataaatagaaaatacagttcttgactttgagaaccttattgtgtaattggaaaggtaaaatgtaaatgccttaaaagttaattaacagtaattcttaaggatccttagattgtctaatacagtggttctcaaacattagtgtccctcagaatctcatggagagttattaaaatacaaatcacagggccttatccccatatatatatatatatatatttttttttttttttactcatttggtctgtgtcatgagaatttgcatttctcagttaccagatattgctggtccatagaccacacttggagaactactggtgtggtgcagttattctcaaccttggctgtatgttagaatcacccagggagtttaaaaaaaaacccatgccaagaccccacccactgtagaccacttaaatcagaatctcagtggggtaggacctaagcatttttttaaagctccccagatagttgtaatgtgcagtaaggtttgggacttactgctctaacgtgtcagggccacagaactttggattcagagatatgatgttaccatgggctgcagcagtgtggacagaccagaggagttagcctgatcttaaagaatgataaataaagaaaaaggaatgatttttgttcttgtaaagttaatgctgggaacaagccagttggttttctagctgtttcttgggacagactgatgagtttgtgagctcttaggagtcagcatgatttcccattcagcgtgagctaatgagtgggactgaggtgtgggtcaccaccatcaataataagcattcactgaccacattctctttttcctgatatagatgagcttgtgtttatcctaacaagcttagatgtgtgtgtgtttggggtggggtgtggttgtggactgtgcaatagtgagaggctgaactttgaaaaatgactttgccatttttacatttcatctctttaagcctctgtttattcatgtataaaagaaagtactacacatagttgtgagcctttttttttttaaaaaaaaaaaaaaaaaaaaaaaaagagtctgggtcttgctatgttgccaaggctggtcttgaacttcttgggctcaagtgatccgtctctgcctcccaaagtgctgggattacaggtgtgagccaccgtgcctgtttgttagtatgtgtgtgaatactactacaattttaggaacactgttttatttatttagggacccccagaatctatcagtgagcctgacacatagtgtctgtgcagtgaatccagattggttgaatgaattggaaaggttatcttttcacattgactgcccaggcattagaaaggatgggaagagcttgtttcctgatctttacaaaaaatgctgccaccttgggttttccaacttaggcaagaaatctgttatgttcaaaataaaggagtataacttaaaaaatatatagatagaagccaggcgcagtggctcacacctgtaatcccagcactttggaaggccgaggaaggcagatcatgaggtcaggagttcgagaccagcctgaccaatgtggtgaaaccttgtctcaactaaaaatacaaaaatatagctgggcttggtggcacatgcctataatcccagctactcaggaggctgaggcaggagaatcacttgaactcgggaggcggaggttgcagtgagcccgagattgctccactgcactccagcctgggtgacagaacgagactccatctcaaaaaaaaaaaaaaaaattaaaaaaaaatatatatatggaaatacattttctcagtgtgtatactagtcatagctacctgtgacttattctttattttgtgtatttttttcagacagggtgttgctctgtcacccaggctggagtacagtggtgcaattagagctcactgcagcctggacctcctgggctcaagcagtcctttcacttcagcctctgcagcagctgagactacaggtgtatgccaccatgcccaactaaaattttccatcttttctagagatgggggtctttctatgttgaccagtgttcttgaactcctggcctcaagtgatcctcccactttggcctccccaaatactgggattacagatgtgagccaccacagctggccttacctgtgatctaaagaggtattttcaattgatgtttggccatatcagattttagttgctattaaattttattcttaatttatcaagtttaattgattattaaaaaattgcactctaagaataagcctgtgttttatttcttggaactactagagccttcgttacaatacattttagagggctccaaagttataaaataaatactggagatttggtgcttgttaaaattttgaccttttctattaaagcccattggagtgatgtacagagaaaaggctgtcttgtgttgtgatagggccatgctccatccacaggtcctgggaaggatgatgtaactgtggtctaacagcattgtctgaatttttggcctagggcaaagaggaggagggcgggtaaagaaacctgatcagaccatttgatgctaatttcacaggtgactggtcactgtgtgcctggctgttgttatttatagagctgtaagtggctggagctacacacaggaacctgaaaggatggtctgtattagagtgtggtggtagatagaagcacagcagtagaatctagggacaaatggtcactggtgagtgtcattgctggagttaaatgagactcattagtggctgttatgatttccactcttacttcattgctattcctgagtctttttgaaagcaaacaacaaaatagaccgaaacaacctctgatagactctccgttatttttaattgaggttgataggattttaatcaggtcaacttgcatactgatttcaaccaccatttaaagagctatccacaaagctataaattagaattatagttcaaaaggtctgactgttttaacctactgctcctattccccaaattattgatggggaaactgagatctagcagggttaaaaaaccagcccagtttcacagttagcagtgatgctggagctgtgatctggatcttaaatctctcagtttagccttttctgttttctaccgtattagtcctacaatgaaaatgcacttctctgtctttaaatttcagacgttgtctccatggcctagatgaaggttatcctttgttatgatattttctcagaattactttgaaaaatggttccattgttatttcttaaaatgaaagtaatatgaaaacaaattccttctattgataatacatttgcccactactgatagttttaggaataatgagaaaagagggggccaatttatggtattggccaagaaggagcgctcagcagcactggactgctatgtgtgggctggaggtaccagcagataacactcggaggcagtgggtcctgtgaatcacagcttggcctcggcataagctctggagaccagctctcctaaggagaactgccttctttggccctgccctcagcagcctgttggcagaggactagaataattgtttgtttaaaagttttactagctaattatactgcaccgaattgacaggcatctctattagagtctttccagtctcttgaaggctcttctccacattacttgtaatcttgcctcagtgtagactgcagtggctgatttttgtttgtttgttcttctctcctttcccttcccacttgttgcaaaggccacacaccaagtctggagagagagctgcctgtgggctgggaattggctgccttcatctggtcagccatatgtggctactggaaaaagtgcctttgggtcattcattctcaggtcaccaggccctagagtaaagccctaaacatgggctctctagcagaaagacttattaattccccttctcttaagtggaggcaaggaggtgtttctgaaccttcagaataacccgagggaacttgaaagtacagattcccggatgctatctcctggatgtgggttcaggttcagtaggtctgaaatgggaccaggttttagaatcttcttcgcggcccggctcacacctgtaattgcagcagtttgggaggctgaggtgggcagatagcttgagttcaggagtttgataccagcctgggcagcatagtgagaccttgtctctactaaaaagagagatcagctgggcgtggtggtgtgtgcctgttgtcccagctacttgggaggctgaggtggcaggatcacttgagcctgggagatcgaggctggagtgagctgtgatggtattactgcaggtggggtgacagagtgagaccccatctctctctcttgttttttttttttttgtttctttttaaaagaaccttcattacattaattgacttccaaggtctcatccagtcatgatggtttttgcatggtccctaccagtagaagatggatttcagaccacagggaatttatttgtagctacagtcaattttcaaattatttgccttacaaatgttttcaatcccagagacctttttcccagctggttcctgggttatattgccaaagtccctggttggtatgcactcgagaactgaaagataattttcttcttgattttaagaaaagataattaaggagggaaatctaccattaaaaaaaaaatcagacattacaaccaagtataacttttagagcagatcctctattgggaaggagcaatatgttatgttaccttgtatttgagcagttaattagggtcagatgtagttagttctcatgctttggccttgcaaaagtaatcccctttttggaaaggctttgttgagtccctaggaattattttaatggtctctaagtatgtttaactcagtcataatattctagttgtttggatttgttgtgtattgacattgacttagatattctcccctgctctgggctttacctcttactcgtacccaaatccatggtccacatgctgtggtgtcccctgggcatgcccagccttgccatgtgtgcaaggtaatccctttgaccctctcaagagggtgctgctcatcttttttttttttttttttttttttggcttcacttatcccacttgacattgccaaacgtgctttgacttgaagcaccgctgctcctgtggctgtctcctttgcttctcctcttcggctcattgagaatctgtttgagatacttgtcatcctttggagattagaactcactttagagggaggaatgattttacactgggactgttaggatcagtttaggaggaaacaggcccacgatgattttaggaggggtttctactgtggtccttgtaaccacatagtttgtactgagctggacactggccatttgagtagatgcttgttctccagttatagaatggttcccagctggcagatttcccactgggattcagtttccttggccgctgctgtttgttgtgctcacactgatttttgcggcatctttccaggcccttgagtcttttccaagcagaagaaatagcagaatgccttgccctccccttctcttctccttttgggtattccatggctattagggaaggacttcctgtgaaataaaatgagggcaaaggaaagtagcatgcctgtggcataaaaatgctgttagcaagcttgaggcatatcagagagattggtcctaagagtaacatttactgcctttctgcttttgaacttttctttcccccttcctttgcctgtttctgaggtctgggatttatccagaatttaagaacggactgtttttgatcatttgaataggtatcatcattcagcagggaatacatgtgcagactgagatgtctcttaaagccaatttatagtataagtcatttgaaatgatttcttgagtcagtaatgcatttctgcttcaaattctctgcctggatttgtgcattcatctcccattttaccaggtgatttgctttattatgctgctatgacagcccccctccccaaccttcaactgctatccccagatacgtgggcatgcttttcagggtgagtagccattaaactacccaaaatgacaccgaacgttgtctacacaggcttggaaacatggagggcctggattccagtaaaattctccaggctgcttcgtcaggctattgcagaaaagattacagggtcctttaagattagttttggagagatctaggcagatggatgggtgaagtcccaatgggaagtcagtacccagttgccacttggaataatctaaaatcctggcatgatctttcctctcataacttgaagtactcagctagaggagagcctctccttcgcaagacccagctatctctttgagaagaaaagggggtttggatggagtccaaccttctggtttgttttgcccgtctgccatttgccttttccttgttggtgtttgctgctgtttgttctttggagtctgaggggcttctgaccttggctgaagggcttctaaccctggacaggtcccgaaggagtggcatcagatagttgtgttttaatttcacaaatctgttatttctttaagaggaaatgagcaactggtagacccagaacagtaccaaggggagctggggagttgttatttgtaagtgtagagaaagaaaggaacagttacagggaggtttggtgcatgatacacagctgatgccttcagagaataggaggttttctttctgtgctttttctcataacattggaggaagaagaaagaggaggcatgtggcttgttggtggttgaactccagtgcagaagttaacattccactcatttagctcactaatttattaattaatttcacaaatacctattgtgctactatgtgccaggcacccttctaggtactgggtttacagtggtaaacaaaaaaaggtccttgctgtcgtgaaccttatactctagccaagggggtggtggtgatgaggacatatttataatggtggtggtgatagtgataaatactatgaaaggaaaaaaaaacaagaaagggaagagaatgggatagggagctattttagtaagtgtgttcatggaaggccttataaatgactatacaatacataaataatcattaaaatgagattttattacctaaaatattttgaacacttcagttgttcaaattattatggaatgctagcatgcatagggactgaaaatatttttttctctgaagttttgagggttttccaaggatttagcttctctttgtttctctggatattcagactcacatagctagattagagttcaccatcacagttgctttcagcattgattgagacagtcttatgttgtaagggtctgctttttacaaaattgctataaaattgttctgtgtgattgagaggctccctctcactcaaagtagatgtttggctgtttttgttgttctgttttaaacagtaatgagtaccttttggtaattaaagtccccttcacaaaactgtagtgagtgatgaataagacataaacaaagaatcccttctgcggagcagagtgccaatggccatagacataactcaggggctgtttgaccacataactcagtgcagtggcttttcaccattggaagggtggaatggtctggtatggttttctggattgctctgataaacaggagttatatttgctgtcagtttctatgaaaggacagcattatatgagccatggtttgtcaggggcctactgtgtgctgggctctttgctataggatcaaatgctaactacatctattccacaagacaccctatcacagtgattggtttttttgttgttgtttgtttttgagatgaaattttactcttgttgcccaggctggagtgcaatggcgcaatctcggcttactgcaacccttgtctcccaggttcaaacgattctcctgcttcagcctcccaagtagctgggattacaggtgcccgccaccacgcccagctaattttttttatttttagtagaaacggggtttcatcatgttggccaggctggtctcaaactcctgacctcagggtgagaggtgaagccagctggacttcctgggttgagtggggacttgcaaaacttttctgtctagctagaggattgcaaatgcaccaatcagtgctctgtgtctggctaaaggattgtaaatgcaccaatcagcactctgtagaaatgcagcaatcagcactctgtgtctagctaaaggattgtaaatgcaccaatcagcactctgttaaaatgcaccaatcagcgctctgcgtctagctaaaggattgtaaatgcaccagtcagcactctgtaaaaacgcaccagtcagcgctctgtgtctagctaaaggattgtaaacgcaccagtcagcactctgtaaaatggaccaatagcactgtgtaaaatggaccaatcagtaggacattggtggggaaaaataagggaataaaagctggccaccccagccagcagtggcaacccgcttgggtcctcttccatgctgtggaagctttgttctttcactctaaatcttgctgctactcactctttgggtccgtgccacctttaagagctgtaacactcaccacgaaggtctgtggcttcattcttgaagtcagcgagatcaagaacccaccagaaggaactaactctgaacacaaggtgatccacccgcctcggcctcccaaagtgctgggattacaggcctgagccaccgtgcctgacctgtcacaatgattttttaaactgcatatcttaatccattagtgggtgacagtcagaattttattttattcagtttaaaaaatagaatcaaatagatgacatcagagtatactacacttagtgtgtgtattgtttcaaaaaaacttgttttaagtgtatgtgcatgcaggcagacatcagaaatttttatgtgtcatgctctaaaaagtttgaaaacaagcctatcagttgaggtttggtatcatttataggcaagtaaactgaaactctgaggttaaggacgttgcctactatcagaactaaaatttgaactcagctctttctggctttcagcatttgatccaattatgtttctcacagagctttccctctctaatggttttccaagactcttgagatcacagagacactgatttgctcctgacgttgttctaaaatcagaggaggaacatgcactctgatgaccagacccaagtttgactggtttctcaaaacatctttacataacatagtctatttcaggagaagggaaaagaaagatgactctagaacttgtctttattaagaaacaaggaaaatctagacactctttttctgtcatagaaagatagcctagttttaccagagaggagaaattctaaccagaagtagtatcaggatctttctctctaaagcacttaaagtcttttgttggcgagacgagtagagcaagaggaatctgccaccttgtgtaaaacattttggttttactagtcaggcatatttttgaataaccttcactagcatttattatagtagttattttattttattttgacacagagtctcactctgttgcctaggctggagtgcagtggcatgatctctgctcactgcaacctccacctcctgggttcaagtgattctcctgcctcagctgtaatcccaagaagctgggattacaggcgtgccaccatacccagctaatttttgaagcctctattttagtttcccccaactttactagagatggggtttcaccatgttggccagggctggtctcgaactcctgacttcaggtgatccgcccaccttggcctcccaaagtgctgggcttacaggcgttgagccactgcgcctagctgttacaacattttggcaccagttttacctacttccccagcctcctaggaatgaagtggaacttttattaaggacagatttttcagaggggcattattctcactggcattccttccctcttgcctggaatcacccttgaatgaattcctgattggttcagctagactttttcttttacagaagaaattgctcttggtgaagatgccagaaaaatatcgtaaaaacctgctctcttatcctcttctctgtactactttgttaccccaccccaccccacctcaagcccccagtaaaaaatgaccttttggcccagggccctatctgagtatattgtgtggcagagttgtctctggctgactcccaggattgttaatgacttccttctctgtccctaaataattgcttgaaaagacagctgtggagagacattgcccccagcttgcaggctcattaattcagccctatgaaagagggtgcaaaggaagaaggtggaagttactttgccaagagtagcaggcttgggggaaactaaaatagaggcttcaggggaagggcagcagcatggtgtcagagattacacttggagtttgtgaagtctgggcaggcttcaatctaaagaaactttatgcacaaaagcccaaatccagggaaataaatgaaagtgattattcacttttctaaagtccttacagtagcgttcctctggtattgtttgaatacagtttaacctgaagggcacttggtttttgtgcagctcttcaagaacagaagcatctaagtaagtagaaagtctgagaaattaacagagaagattccctaaaagtcagccttcattacttgaccattattcataattctgcatttgtctattcctccagtggccttgaagcaaaattaaaaaaaaaaaaagacacttctatgccccttaaaaaaagaataatcaaaacttgcatagacagaataagaatcaaatacactggggaacaaatactctgattagctgtccggttcagctctgacgcgtctagcactctgagttataagggaaacgataggacacttggtttttgttttccaacaacaggaaacatatcaggtttctaagaagatgtaaagtctttcttaaaacccaattatagaaggaatttatgcaagtctttaggcaaggagtattaaagaaattaatgtttaatgccatcaacaagttttcaagcagatgcagaactcctagtgtgggtgactttttggtgtttaccttatatcaagaatgcagcatttaaggccactttgacagagtgcagctaagctttttgggtttgcttgtgtggacaatttccattcagcaatggctctcaaacttcaatgcacatcagaattacgtgggggcacttaaaaaaaatgtatgcccaggctgcatccagaccaattcagtcagaatctctgatggtgagccccaagtatcaatattttgtaaaactgattccaaaggttagctaagtgtgaatcagtgcgttagatgatctttaacgttaattatcttagctggatttctcaaaggggtagtcctagaatgctgatattccctgttattaatttaagtaagtccctgttgtttctgttaacattctcttagaactctgagacttgtatttctgctgggacccagggctactgcacctttcttggcctataggagtgttgtcagaaccaaagtacttgttaagcagcagcttaggatcaacattagcagacctcattgtggctgttggagaatatagaacatcagatgaagtaggggcttgacgtttccacagccctaaatcacatatttcagagtacgttaagattccttttggaactcagatctttttctggccatggatagactgttgtcttggggggatgccagttgtctctccagtgagaaaaggagatgtttatgtattctctagttcccttctggaagttaaaaatacctgtcattgttagatttggtttctgaactctctgcccctaacaaagctgaaatgatgacagtgagtgaagtatttgcttaaataaatatcttttttttcaactttgaagaactaaatatatctcaacgtgttgaaacatcagagaattggctgggcccagtggatcacacctgtaatcccagcactttgggagtctgagctgggaagattgcttgagctcaggagtttaagactagcctgggcaaaatagtgagacctcgtctctactaaaaataaaaaataaaaaaaaaaatggctgaatgtggtggcacgtgcctgtagtttcagctatttgggaggctgaggtgggaggatcacttgagccctggaggtcaatgctgcagtcagctttgattgtaccactgcactccagcctaggtgacagagtcagactctgtctcaaaaaagaaacatcagagaatcattgattttatgtaatctagattttatcccattccaaattgtgcttctgtgaatacacattatggaggataacggaaagggtgtttagggaaggggatgacaatgggaggagagggagaaaagggtggtgggagaggtaatataaatgataattaccatgacttgaatcttggtaaaatcgtataataggaaccatgtggtactggtgttctgattaaaaaccacttcctggctttgtgaccttgagtaagctataactctatttttcagttttctcacctgaaaaattataatgatacctgcctgttaggattgttttgaagattgagattgttcgtaaaatacttagaaaagtgccttggcacatagcaagtactatttaagtgtttatcagagcatagtctcaacttgtcccattaagaatattataaaactgtaaggtccagatgatgctttattctgtaaaggccattaatggagatgcttgaacatctctaaattacctttccctttgcttgctcaggaagtttgctaatctaaattcttcatgctgtgctgctgagtgtcatgtgtgattgcttgtgcaaggagacccaactgggttctatccgcacttaactgaaactcaagttattccctctctagccttaattcctgtcttctaactctccaatcgatttcttggctccactaattgaaacctaccccagttttctcatgctgttgagcagggatcttcttgagactgattatgatgggagaatgacctcatagtttctgatgccatcttccaatttatgtaactcagccccaagcatgctttttaaaaataatggccctaaattgctgacatcttgtcatctgctcagactcctaaatctttttgtgttccctcgactgaatgggattcactggagcaagatgcctttgtgcagtctgcatttagtgcacttggcgagtgacctccaatagagctgtgtgttcccttcgagcaacatgggtaatgattacagcgacaatgctgctattgtgtccagaggtttggggctgtaatttcataatgaaattgaaaaacatgagattaaaaacctgaatatagcacagtaattatatttaagtatcacaaatcatctccctgtatttagttaggtgtttgagatttggcctctttgtggagtgcagtcacgtcgtttcatacatctgcaaaatggaaggcttctaatttatggctaaaatgtgggaattgctttctcttaatgggaaggtgaggagaatggtattgaatttgaaggagctggtttgcttcattgactagagtcaagaagggaggttgtacaatagctgcttaaggtaaagaaatgtttgggtcttttcatggtttaattcccagatacttacacatgactatagtctctccctttagaaattaactgacataggctggcctgggaaattctacagtcctgcagcaaatggtgcagttgcagaagtgtgaatctttacctaaggcagggtttctggtatagataaagacttaactggggtttgtttcccacaggtaagttatggatgagctgtgcctggcccatttccatttactgtctgagaatctgcatgtggcctgcaggctctgtagttgggctgagtcctcctggagtaggaggctggggaaggtgttggtggtggctgtcgataggcattcctgcaggatggtgggtggagagttagggtgaggggtgttctttaataaaggaatagaaattagagtggaaagtggtttaaagctagtgatacctccttctccttgatttctaggaactatcaagtatgaaatgaacatagaaggaagttatgaaaggaatcattattattgtcagtgattcttgattatctactataggcaaacacgttaagttgttgttttttttttgttttgtttttttttaagacggagtctcgctctgtcgcccaggctggagcgcagtggcgcaatctctgctcactgcaagctccgcctcccgggttcatgccattctcctgcctcagcctcccgagtagctgggactacaggcgcccaccatcacgcccaactaattttttgtatttttagtagagacggggtttcaccatgttagccaggatggtctcgatctcctgacctcgtgatccacccgcctcagcttcccaaagtgctgggattacaggtgtgagccaccatgcctggccaacactttcagttttggttaccatctttaaacttcacagtagacattgatacagaggtatactttctctgtgcacatatactgcctctcaccccaaataatttttgatacagcagtgcagagtgtccctttttttccaaagctttcctcccagattcttagtgaatctacgagactgagtatctgaattgcctaaggccttttatcacaaaggccttaggcaaatgtatgcaagtgtacatacattaccaggcttcatcaacatgccctactcagagacatttcggttcattaggtaggggtgggagaggttgtggcctaggaatctgcatttcaacaagcaccaggaatttttatatacaataaattctgagaatcattgccttaggaccttctttctcaggggccgggctattccagtgggtgtgttatgttgagatttgctttgtggagatgtgaacttgctgttcagtcccttttcctagcccctggcttcagtatatctttcacaaaaatacctacttttattctgtttccactggatacaaggagggctgggctttttgctgctttacccactattacagatagcaggttgggagacagtttgagtcctgtgtttgcactccaggcctactagggaagaggtggcctgcctccagcagtaaactggtaactatctaagacctatggtgctctctgtttccactggaaactcattgaaaatgctaccactattcatgtttttgacctctcagagcaaagtatataaaagcagcagttcaagtaaattcgtcaaacatttattgagtggtggctgaggctaaagtattattttaaggggcctgggacagataagtaaaacacagtttccattctccatctatcctgtctttctttctaatgatgtagacagtcctgacacagaactatggcagacttagtgtaacctgtgacatgatcgtgtctttgaacaagtgaaattaaagtgctataggaatgtctgggtgggaacagttagtttaggttaggcaaaaggcttcttaggggaagtggctttgggcagggtgtagggcagaggctctcaccttggctgtgctttacaatcacctgagagaattttgaaaaaccccaatatttagaccaaaccctataacaatcagatcagaacttctggaatttggacagagacagcattttttaaatgtttaaacatttaaaaacattaaattttttaaatgtttaaacatttttaaagcttcctacatgattttaatgtgcagccaagactgagagccactgacaaagaaggataaataggctgtcattcagatgggggatagtcagagaaggaaaggtattccaagcttgagagaataacataagcaaagctgcagaggcagcagagtgatggcttaagttggagaatgccactcaaagcgggggtgattggagcatggggctcctggcatgagcgtggagggaaaattatgctgattaggtaggattggattaaaatactgcatcaaggaattgggagacatgattttgcactgcctttggaaccccttttcacctcatattaggatggagaattgaggttcggagaacttcttgcttgcccaaagtactagtaagccagcaggcatgcttggttccctttgcaaggctctttgccatagacctgctgtctcaagctgtgcagtacttaagacttctcttttggcatctgtcctatagcacttttctttcatcagagcaccctaaaggtaatttagggtcagaatggtaggaaggtattggtgttaggcaagaatatggcacgatttcttatctttttgctgggcccctgtgggaatgatatgggagaattgctgggaatactgggggcagatgtttgcaagtaaaagtgtatatgtttctgtgttcttgcagctgcattcgttttgtgcctgattccactaaggactgtactttatctgcttattgctgtttctaggaagttaatttgcaggtgctataagtatgcatgcttcatatacttcatttattctttcttccttgaagcctctcctctttattaggcactattcatttgtctacttggtacctgtatttttttaatgtcactattttgacagtaccaataaaggtaaagccactcaattacgcagggctctctctttatgctttgggtaggtgcacctgtgcaactgaggggacggtcagtgttatcaaggttacctgttattacaagtagaagaacccacagagatcaggagagagctcattttcctccattagtaggaggtaggactatacattcacaaacacgaaccttaaaatagctcacaaaatagtgtcatacatgtacccagccatctttccactcattccttctcaaaaggaatgtagtaccatatagtagttaagaatatagacactggagccgatcttcttgagttccaatagtggctcttctactttttaaatctcattttccttcatctttaaattgaagatagtaacaatctcatggggttgtgataactaagggggtaatgcatgtaaagtgcttagaaaatgcctggacataggaagctctaagtttgctgctactactgttattatggttactattattaatcattgcaaggaaaatgtatcaacagatgaatttggttcaatactgccttctagttttgtgaccttagaatttataggaacaaaaaagatttgaaagggaggttgggctggatcatagagagccttgattccatgttttaggatgtatacacagtgagaagtccttcaggttttggtcttggtaagagttgtgaatcagaaagttaactcttgtagccaggcggagtggctcatacctataatccaaacactttgggacatcgaggcaggaggatcacttgaggccaggagtttgagaccagcctgggcaatgtagtgagacccctgtttctgccaaaaaattactcttgcaacttcatgaaaaataaatgattagcagaattagagcagttaggaggccatcttaatagtccaaggcacaataaggcaaggaaatgaatgagagcagtggcagcagacatgaagatgagcagttggatgcgaaaggtttgttctatagatagattcctcttggcttaagaaggggaaataggaaattaattagtaatcagaaatatttgcatattagtcttctccatcttcatccttgatgagaggagagcttgttatgtatgtaccattgctgggtacaggaggcagaagagctagcgccagaacaaggagctcagctttttctggtctctgcttttacgtggctcgttataaaccaggacccaattagttctttaggcatgcctgcctgttctctttccatgtaattactttgtggagcttgggttcatgcacatagttacctcgattaaaaaataagtttttggagctataaattttcaaacactgctttgagagggtctgtcaggcattaacattcaaggtttctgtggtgggctgacgatagcctctagcctctggatgtttttcacattccaggaaatgacacctgaagttttcagttccttttcgcatcttcagcaatccatagacagtggggtgaaaagatgtaacctaattgaagacggatggagtggagtagaagttgaaaatagggaagaggctgggtgtggtaactcactcctgtaatcccaacactttgggaggccgaagtgggagaatcacttgaggccagaagtttgagaccagcctgagcaatacagtgagacttcgttctctaccaaacaaacaaacaaaagctagttgtgcatggtggtacccacctgtagtcccagctacttggaaggctgaggtgggaggctcatttgagctcaggagttcgaggctgcagtgagccatgattgtgccacttcactccagcctaggcgacagagtgagactctgtttccaaaaaaaaaaaaaaagaaaagaaaatagggaagagactgcatgagtcctgccatgcagtctttcccagaattggacatttttgtggtgtggtctggaagaaggaaaacatttatggtcatacctctccaaattgaacaattgtgggaatatgtacagacagatttgcagggtagctgaaaagaaatgcagttctgttatttttttgttatagagtggtaacttgagtgaggattatgaaacattgcctagcagaactgtttttttaattgaccttcatgtataattaagaatatcaattattaatgttaaatatattggaattttaaaaattgtgattatttctttgtaatctgatttgtgctatttgccctgattatcagagtgttgtttgagattaaagtggtctagcttgggttcagtttgcaccaggagttttgaattaactaggctccatctgaatgtggaagattttcgtcgtgaggatgcaatggaatcgtaagtgtaaagggcctagtatagtgggtagtaatttattttactcctttttttccactttaaatgaagagtggctaaacttcaacttttgggacattggtctctacctgcacctccagaatgtaacctcttggggaagatatttggagacctggggacttttgcaggtgggtagtattacgcagagcccagatacccctgccttcttgtctggaaatcagtgattctcaaactgctttgtgcttgagtattacctggggggacatgttccgttttcagctccccaagccatagagttaagattcaatagacttgaggagctgctctcagtccaggattatgtgcagatcccgaatctgatcttgggctgctgtgcttttccagtgcccactcagtatttctggggctgcaaggaaggcagtggttccccttcacaggtacgtgaagctcttaactccatttttgtccttttaaattcacattaaagagagttttagatatgcaggaaaatgagaagggaaattgaccttgcctgtctctgggtcttgtgaatagaaaggaagagcctgcgcttggaggccactgggaatttgtggtgttccagaagacctctgctctcatgtgggctcttggcagcctcactgagagccacaatgggcttccttatttaagatgctcttaaattttcttttctaacactataaggttatgtcttcaccagtttctcagattttaaaaaaagaaacagggaggtaaaacaaatcccaaaacattttttttccttcttgtaaaggttacaaacataaatcatatttgagaacaatgaatggaccttattttttatcttcagaatgctgggcctctggcatcttagaaagtctctttactttcgaaaggaaggagacttgtatagtgagagcatcacactctggggatcaggtaacttggctatgctactgggcacctgggacttcttggtcagaacaagtctccactgtgagcttttttttttaatccatgaaatgtgggggtcctgaagctatcaaagcgttaatgttttatgattctagtgatgggcttctgtctgcgtgacaggcattttccagactttgttgatctatttcgagcttgtgaggaatagcatgtaccacccttcattacctcactcatggttcctcttcatcagtgctttataaactgtagtgtgtttgtgctgggaggaacgtaagagaacatgtggatcacccctttactcattttacacatgagaaagatgataccccaagtgattttctctaaggttgggacatgactggggctctccttgcgatttgcctttcccttcagtgcgttcggtaaacgttgcattaccccctcttcagggtattattctttcagttccatatgcctttcctttcccctgggatgctggagtattcagttttatttctaggcaaaagtactcctaactgtggcccctaatttttttttgttatgtatcttttctagaaagagaatttgattatgcattgtccatatgtttacatactgtactcataaatgaagttataaaatatatgtaagttaaaaatgtggagaaaagggaagtcttgtgcaccattagtggggatataaattattattggtattacggaaattagtacggaagttgcccgaacaattaaaaatagctgggtgtggtgactcactcctgtaatccttgcactttggaaggccaaggtgggaggactgcttgtggccagaagtttgagatcagcctggacaacatagtgggatcctatctctacaaaaaattaaaattttagctgggtgtgatggtgcacgcctgtagtcccagctacttgggaggctgaggtggttggactgcttgagctcaggagttcgaggctgcagtgagctttaatggcaccactgcattccagcctgggcaacagagcgaaacctagtctaaaaaaaaaaaagtgtgtatataagtacacacatacacacccctcaataaggctagagagaaaaaaattatatgtaagtatggtattttttttttcctcaatcacagtggatcagtttatgccttccctggatccagggtgaacttgttttgaggaccactgatccagaaagtggtggagttaagtctgtaccaccagctttagaatctcctgtggcacttattaaaaatacgaattttggtatctcaacccagattcactgaatgagaatgcctcctggtggaacctgggagtctacgttgtcttcatttttatgtttttaccaatagacatggggtctgttgcccaggctggttttgaactcctcagctcagagtcctcccacctctaccttctgagtatctgggaccacagtcacaatgcccagcaaagtctccattttaaaccagaggcaagtctccaggtgcctctgaggtccagcgagtttggggaaccggtattttagacaggcagggaagtgtcattcatgggttcatgagcatgggacttcttacactgacatctcagaaattgctcagctgttactgttaaatctacagtgatacagttagcactctggaaaatcagatgggcagttttcatttgagttacatatgagggactataacctgcataatcatacatggaatttcttaaaactccttggcattctctatgtggttttttgatttgtaaatccaaatatttgctattgtgcctcagtctttttttcctcattagaaatctaagctctccccgccccctcctggtgctgttccttgaggggctgtgtttttatttctgagcttttcccatttgtgtgtgttccttttgtctggagtatgcccaaccccctcacctttttacctgggcagttcctactatctaaaaaattccctataaatgacattatttttcattcttaaaatctaaagataatgaagaactagctgataatcagcatttaccaaaatagatttaagggttattatttgtaataactcatgtgtcagtaaccttatgtatgtaaggatagatcagtatcttggttattaagcatatactctctgaaacattcgaatcaaaccagtgtaagtcagataaatatgtaacaggaaatttgtttctgactattcactccaggtcaatgtattcccagctgccttgtgggtatcagggttatctgttccaggatcagctttaggaaagcccctactcaaatctccatgtagcaagagtgcaggctagttgagaacatgtgataattaaggttaaacaaaaaaatcaaggcagaatgactagaaattaggacagcagggaaagcaggggaagcggttgagctggtagaaatgggtaatacctatgattatttctgggatcaacagatacatccctgttgtagaagtccaaagcagtccttctttttggtgtcttttcctgcctttggtatgataagcccccctaacatctggcacactattggggtgacattgtgaagttacctctgcccacagtacttactccagtttgatatttttaagaaatgctcactttccactagccatagtttattggctttcagaaagtgtctggcagtgagtatgccaaaggtcaagaattctggcagagtttgatttatctctgctcccttgatagcagctagccttggaggcatagaagctcttgacaagtactatgagtcagaaggccacatgtgactaggtccctgcccacctctccagggtcaaatagatcttgcctttttccccagcccctccctgcactgttcctgaagagggctgtgtttttctttccaagccctcccatttatttacattccttctatctggagtacttcttaccccctcacctttttacctggctaattcttatatatcttttagataattctacataaataacacttctttcacctttcctaaactagaataggtattcctgctgtatgcttctatggtcccctcatttcccctagaataacttactacagtttttcgttcatacttactgttatccccctggactgtctgttctgctaggataaggattcttgctcaccatttcctcattgctaggcataaggtatgggacatagcaggttatcaataaacattttttgactgaataaaagcataataaaacaatatgttaattaatggggtgactggcagggatctagttgccaatttcagcattggtaattaacatggctagatttagctgctaggttctatgagaaagaatgattaaaaataaacagaaaggagatggaagttgatacgattaaaaacattttatgtgcctgctgatggacctaaaactgggcaaacctttctgcaaataaagctctaccttgatggtcttattgatataccatatatacatatatatgtatgtatataaataagatatacctatatataaaatatttatacctatatatggtatataaatgaatataaatataagatatataggtatatatatgtggtgtatatatacataaatatgtttgtgtatgtataataaaagacattactctccattgaagtgtttactacattatgtactatcttaaaacaaaacttcccacaggtgtcagtacaaacatgcatttgttcatttattcattcattcaacagttttgttgattgtttgatatatgtcaggcacttttctaggtgctcaagacacaacagtgaacaaaacagacaacaatctctctgactcaatggaacatgcattttagtggaagggaatgtcaataaagaaacgtctaatatctagagtattagaaactggtaagtgctaggaaggaggaaagggggccaggaaatgatgtgatgtgtgctgttgtggtggtggggcatgcaattttagattcagtggccaggaaaggagtcactgagaaggcaactcttgagtaattacctaaaagggggtgaggaagtaagccaggtgggtatttgggagaagtgaggtaggacagtgtgcatagctctttggaatgtgctcctcatccctcatgtttattacgttggccagaccagcaggttgggctttcagtggcctgtttgatcagaatctgcaaatgtttcctgtctttggatagtttccctgactaaatcttagcctgaagacgtatgttaaggggagagcgtatgtttcttcttgccaacttagttttatggaaaaggccctaaggaaaaagcctgtcttttccttttcatgggtcagaatttgtgttttgttattttctaagctctagtttgtggtggaaccacctctctcagatcttgtttttccttcagggcacagtgtatttctcacttaagtagtttatgcagtcttatcacagtgtcccctgcatggggacctgataacttactctgattgataacggaagggcttttctgtctacttctgtctccttgatggcttccttatctgttgtcctgtaacactaactgtgaactcatttcattaggtaatgaaatgttatcttctgtaattgcttatttgtgcagcagtcttgtctctgcaactggagaggaactttaggttctttctgaaccttagagtactggctcatagtgcctgtgctataaccatcattgattgctgttggtcaaagcacctgactttttggggtaagtaaaccaacatcttgcttttcagtgttttgtttttctggattacccatctatgctttgggtttaatgctccttaggacttggccttagtatgctgctggagagcccaagggaacagtatattagtaagggatgaattctttgtgaattcttaaatcttccattgcgaagatctttgtacagaatactggttctgtttatattgacagttcttcagagaattgtgtgttgactgttcatggcagaaacaccataagttaattgctgtttcaaatttcattgacactttccccctcatttggaggtcatttcctcaaaaatgtcgttgtccacatgacagtttgtgtatgcttaataaaagagaatgacaaacccaagttcagctgttgttactggactgggtggtttttagctcctcccacaatgggcaataatcagtttggggtctcagcagaattataaatacctgcatttcatagtcttcctgaaggaattgctttacttggaatactgtagttcagactgctgatgtaccgtgcactcctttctctttgatgatcagctctgaagtgcaccaattggagagaactcttgaataaatgctgtcacttgtcacatgtggtcactttctggggactgtgcatgtgccagtgggggccatctagaagccaccgatgcccactaatataacaaaactcactgggtttgcttctctataatgatgttggattgctttgctggaaatccttaccatcttggtttctctcctctgtttcctgtaaacaccaaataaaagtccttgcatacaaatgttaccatctttggaaaaaaaaaaagtccttgtagttgttaacagttacagaaaatataacctgaagacttggagtcaaaaaacaaatccctgccttcccatacagtcagtaccagctataagctaattaaactcaactgttcccacctgttcccggggaggcctctaacagtggcacatgcttttctctttgggacttaacatttttcagaactctttaaatttcattttctaggccaggcatggtggcttttgcctgtaatcccagcactttgggaggccaaggcaggaggattgcttgattctatgagtttcagaccagcctgggcaacatgacaagacactgtctctacaaaataaacaaacaaattagccaggcgtggttccaggcacctgtggttccagctactcaggaggctgaggtgggaggatcatttgagcctgtgtggttgcggctgcagtgatcattgtttgcaccacagcactctagcctgggtgacagagtgagactcttgtctcaaagaaaattttttttcattttccattgacaccatactaaacaacgtgtatttccagaatcaacctttatttccctaagaaaatgtagattgtgatgtccctggtgagcaataagttaatattggctgatagtatttgagcagcagtgacagataggaggaagacaggagggaagagatgggagtgttgctgggggagtgggtgtgaaaccataacacacatatatggtcacgtacacatctgtagtttactcaaatggcattttcacaaagcacagtagtgttgcaggtatcccccagtgggcacacagagctttcagtcctcactgtgtgaaacttctcatacctttgatgttgaatttaagttcattagtggctcctatagcatgtcagaggtttacctcacttggttcctgactcaactctgaaatgctgagtttagggtggatttgaagtgtcaccttcgtctctactttctaagagtcagtaaagagctgccatgatagttaatcctatagtgcctccaatgaagacttaaatatacttactagcccagactttgctttatcattctcctgatctattagttttattcctgttgacagccaaaatgtaggatcatgaaccccacagttacatggatggtgacagacctgagttgttgtcgagaatcgtgctgagttttgttatcacatttcttgtctcgatttgtagcatctctggattttacttctttaccagaatagtggttatcaaagtgtggtcttcgaagcagcaatatcatcatcatctgggaacttgtttgcaatgcagatttccaaggctctaccatgacttcctgaatcagaaacctttgaggaggaagccagcaatctgtgtcttaacaagccctcctgtgattatacccaactttaagaatcactacacagacagacgttgctttccttttagtctcttgagcttgtaacagttgatattttaacttttatatgagagaggacagttatatcttcctttaaactcttatttggtgcagttgattgtcagatgcagagtgctgatgtgaggatggactgtgaatatgatccactgtggcagtgtttatagtctcagcccaatgccttgttgacttaagtagcagccttgataacaggagataaatctgcaaagatactgtgaggttacatggcaaggcttttaaaatacaccaacattacatttgtggcaagtgctttgctcaatgttggcatttttgaagtcaccctttacctctgccccctgcccagaaatttccttgtgagaaatgtttttacgttagacaaactgccatgggggaggatagtcagaaagaggagacaaataatacgcagaggcagacttttttttacatttgttgctcagaagaaaaaaattccaatgaagaatgaaagaggcttcatatcctgaataaagtaaatgatctgggtaggatggtacaggaatagaatgtgactataaaaaagaaccaaattgtgcagacaagaaaatatgaaggaaaaaagaataggaaaaagacagggaaaatgcaaattcttatggaatatttttgcaaatctgtgtacagaaggaaccaagcaacgcagatcagttcttctgaggctgggagttctaaaaattatgcagtatcaaggaaggctttcttcctgagtcaagtgtaggaagcagaaccaacctttatttctctatgaagatgtatattgtgatgtccccagtgagcaataagttaatattggatgatagtatttaggcagcagtgacagaaagttttctttctcctgactgaatctcacaccaaggtccctttttatttttaattgtttagtttaatttttgttttttgttttttgagacagggtcttactctgttgcccaggctggagtgcagtggcgcgttcatagctcaactacatcctcaaactcctaggctcacacgattcccccacctcagcctcctgagtagctgggactataggcacgtgacaccacacctggctaattttgtaacttttgatagagacacacacggtcttggtcttgctatgttgcccaggctggtctcaagcggtcttcctacctccacctcccaaagtgggattacagatgggagccaccatgcccagccaaggctttttttttttttttttttttttttttttttaaaccagcgtcacaaccacagaagaaagacaagaggaagatatgaagacaaaactcaattttttttacttagtgtgtctaggtaaaggtttagtaggagataatgtagaaatgaaatatgataatagcttatttgtgttgagtgctttgatgtatgaggcattattctaagggcgttatacttgttgaactgtctacttcttacagagtctgatgagctacactctgtttgtgtatttgtttttggtggcttttttgagacagaggctcactccactgtccaggctggagtgcagcggtgccatcacggcttactgtagcctcgatttcccaggtttaggtaatttacccacatctcagcctcccaagtagctgggactgcaggtgtgcactaccacgcctggctaatttttttgatgagctagactctgttaccctcatttgctagttcatgaaattgaggcagagagagaaagtaagcaatctggccaaggccacacagctagcaaatgggatttaatccctagcattttcattccagagccttgcctttagccatcacactctactgtttctcttccatagtcgtcttctttcttgtgattccaagttaaagaattgtcatggatgagctttttccaggagtaaaggtacttgttggactcttcatcagatttggtcgcgggaaaagaggttgttgctcttccttagagacctgttctttctgcatttaaaatctgagtgtaaatttttttttagctggaaattttaaacgtgtagcaagtgtggccagcttgctcttgtaatgtttagtttcctggacctcatgttgcctccctaaaacttaaatggggttgtggttgcacaacagtatcatggaaatgaaatgaatcttaagcctaatgagtttgaataagatgagcacaatctaattttgtttccagtcgtttttcctcctttaaacaaagaatatcatgccaaattggaaacattggattgtgtcactgtgggtatttattttttactacatgtcaccaagatccagatttgttgagtgtattagttacatatggggtaaaattctgattttttaggtgtattagttatgtatggggtacaaaattaccacaaaacttaccatcttaaaacagcaaacttttactatcttagtttatgtgggtcaggaatttctgagtgacttatctgggtagttcttgcttgacttctcttttgagattccaggagtaaaggtacttgtcagactcttcatcagatttggtcccgggaaaagaggtcattgctcttccttagagacctgttcttgttgcatttaaattcttagtgtaaatttttttttagctggaaattttcaacctgtgtagcaagtgtggccagcttgctcttttaatgtttagtttcctggacctgcagccgaaatgttatctggggccactgtcatctgaatgtttgactggagctggagagtctgcttctaagatggctcattcatatggcttttggcaggaggccttggtttctcaccacatggacttcttaacatgacagctggttttaccagcgtgactgattcaagagagagaaaaatgacctaatcttgcaagtcagacactgtcacttctgccacattctgttagtcagaagcaggtcattaatggcagcctgcactcaaggggaggagaattaggcccaagctttttttttttttttttttttgaaatggagccttgctctgttgcccaggctggagtgcagtggcacgatctcccaggttcaagcagttctcctacctcagcctccggatcctgagtagctgggactacaggcttgcactaccatgcctggctaatttttgtatttttagtagagacggggttttaccatgttgttcagactcatcttgaactcctgacctcaggtaatctgcccgcctctgcctcccaaagtggggattacaggtgtgagccaccgcactccggccaaggccgcacttttgaagggaggagcattaaattgtggacgtattttaaccaccatagtaggcctgactccacacctactaaatcaaactctctgggtatagtaattttcatttttaagattctctcaaatgatttttatacacacttaaaatagaggacaactgggtatctagaagtaaatgaatgctatcatggcactatactagtttatttaaaaggccagatgtttttcacatgtttagcattctaaatatttgaggtttgtggatgaggtcacttggaagtaaaaaaaaaattttttttcaggtttgcgcttaggcactaaatcatatactaggtaatatagtacactctgctcagactgcattttatctggatgggcccttagctttttttctgttgctcattcaggcagatgagccccactctaatgtagcctgtggtatctgaccagctgctctcagtgcatatagcccaagcaggagctgtagctcctgattagaaagaatgaagtatatgtctgggcagggcaagccaaaagggattctgaggttcttgtctcaagatccagggtgaaccaggcaccatctgatgatggtctttggctcattggctcctacagctgcatactttgttaggagacatgaggggtacagaaccaggagtttgcaaagaacaatcatttgccttctggagcccttctaacctggacatcacacccttttgatgttaaatgacagacgtctggctctgtgtgacatcatacctatcttatcttagtgtacctcagctaacctcctgaggcttttggtggggaatcaggcctcattccccatcatagacataatttcctttttttttttctgagatggagtctcgctccgttgcccaggctggagtacagtggcgcgatctcggctcactgcaagttccgcctcccaggttcacaccattctcctgcctcagcctccccagtagctgggactgcaggcacccgccaccacgcctggctaattttttgtatttttttttggtagagacggggtttcactgtgttagccaggatggtctccatctcctgacctcgtgatctgcccgccttggcctcccaaagtgctgggattacaggcgtgagccaccacgcctggccgatcatagacatcattttcttaccttcccattcacattagctcttagccatctgaatgcatgcctacaaggaatgcaattggttgcttaagaacggaggaaacatgttatggaaatctatacttctcttcaaatgtttgtaccactcacctacccaattcccttcccaccccaatcaaaagacaaatacccatgctcagaacctgggggctcacattttacctgaaattccacaagtaacagaagcacacatttaggggataaaaccctagagagagagtaacacaatcctggctgccatctcagaacaagagagcattgtacccagagtccatgatcacatactggaatgactgtgtgacggagctgacatgccccaataggtacaacagattgttctgcttgtaaccaatcaataccacaattaacaaatatttattgaacaccccggaagcaccctggtatatactgtcctcatcagctatttgttagaataacacgaaacctcctgatcctctgtctgccttcaggcttgcctctgccccaataaaatcaattctctacatcaaaaccagagtgacttttcctaaaatatacacatttgaccaggtcatttaccttgaaatgttctggttgatgttcagcatccagataaagcccacacttcccagcatgacctaagaacctgaccgtgtgactctgcttccctcttacagcttctccacacatgttccagcgtccaggcactctccactcctcgtgcctcccaccatgcccacctctcttgtccttcccatctttatgtgccacataacagcggctaagagtgccggcgtcagagctcataaggctttgattcaaaacccaactctatgacttaataattgtagagtcttgggtaaattactggatgtttctgagcctcagattcttcgtatacaaaaataaaccaccagcctcacaggattctcataaggattaactgtgatcatatttaaaatgtttagcacagtgcctagcccataattaagactgagtaaatattgctattgctatattgatgtatggaaagcccttggcacacagtagttgtttaattaaaaaaaaaaaaagatccttgtctccgggagcctcagtttttttttgatcattggaacttctcagtgtgacattcagagtttgatataggagtggggatggcattggtgtgggtagagaactagggttttgagggaaagagagagaaagttgataggaggagcatagatgtaaaaaccattgtgtgtttccatgtgatcttccttccgtttgaatatgactaaaaatgtcattcgttttggggcagggaaaaatggtagactaggattcggaagaaactgacattctgacgttgagtaagtcactgctttgcgcctttattagttcatatgtaaaattggttcatcagatactgtttttgagagctttttaaagactagaaaacataacgtgaaataaaatgacaatattatacccctaattctacatttacagcatattcaacatttttttgaaagcaacatttttgtttacacataacagatgctgaagcacacagccccctagaaatggaggttgccaggaggataaagaagatcatgaatgctgccagtgtctctaatctttgccctcattccttgtgtgtctctcatttgagaagttctcacctttcctgggggttctctggccagagtgtttttactctgcaccactctacctgccgttgactgggttaccttcataaaagaggaatctgaagggccttatgggaagagtactgctggtggacacatggaatcaggaagcatagtttgaaatctagcacagattaaaacttgacctaacactcaaaaggttttcttctctgtgatctagggctctctgtggtcaccatattgcatcactatgaggtttaagatgaatgtgtgggtacctagcaaaggtctggcatgtgatggatacaggacagtcttgtcttttcctacttggacacctgagatagttccccagtgtaccctgaatatctgaatccaaaatcttcagtcaagaaggagcctctacggactagatccaagcctccctttctgatcttatttctattcattaccttcatgctccccctcccgtccataataattatcctccagactcaaggcccttcacgtgatttttagtttattacaccttagcttttcctttcttctgtatagactttgctgtacctgcaataagtgatacctttcccaggtccatgggacttgaaaatcctgtttccatcaagcttttccgcaaaccacccctcctcaccaggtgggagccatcgttcattccctgttcccccaatgcatgttgttttgcttctattatagctcttatcacagtctgccttgtagcatagtcatttctgtgtgttttccctctggattcggagcccctggagggcaaagactatgttttattttatgctgtatttccccacccccacagtgcctagtgcagtaggggtttggtaaatactgcttgaatcaatgcatgaatgaaattgcctctcctagttctgtttgcaaggctgtaatgcagaccaggtgaatgtagaattttggcttactggatttagtttagcataggaagggagttttccaagaagcaatagtggttttgaaaacagaaattgcctttaatcttgtggaaaacatatgccagccctctccataatagtctcaattacaggagagcatcgtgttactgtaaaaacacaaataaataaacccatgacaatactgtgtttgggagataaaaaccacataaaagccatctttccccaactctccagcatcataattagggtatttctgggaggagaaaaaaaagacaccagcaaaaaacaagtgatactatgtttaagaacacttcttgctattggcaagatgggagtagggagttagattttccatacagcacaaatacaagggttcttcccagctcctaccaggcttgatgctatatagattacactgcatgataaatttgggcactagaggtgccaaagatggtggcagaacctggagggcagaaaatgtcacccagaaggtgatgctgtgaaatttattgctctgccacactttacctaaacatgtcctattattctgaatgctgggtcttcattggctcagggatgcccttggtgcgtccgttgccatgggctacaactttcaactgtattttgtttattgctggtcatttaagtctctatctggtttttttttcttttaacttgagggctccagatttaggttcttttgaggtaagagtaggaatgactttgaaatattgcctacttttgtcagtattagttaacaagcactgagggctgaatgacactgaacagaacccagccatttctcagcacctctgttgccactaccctggtctgagttgccatcatgtttcacctggactgcctcagtagcctcccacctgacctctttgctcctactttgcctccctgcagagtgttcttcactcagcaaccagagtggcccttttaaaatgtactttagatcatatcactcctcagttcaaaatcctccagagtgcctcccatttcactaagaatgcaattcaaagaccttacttaccatggcctacaagacactgcacggtctagtgcctgctatctctcaccccatctcctactatccccttagattaatcctctctgacccttcagcttgcttgctgttcttgaacctggtcaagcatttcccaactcagagtctttgcattattgttctcttagcctggaacatttggtcccagatataaacacatggttcatactctcacttccttcaggcccctgagtgtcaccttgttggggaggtcctgtccacctgtatttctattgctggagcaagcacttaggaagtctttgttggaattgtgaataagcattgcccagagattctagcacatttggaaaaagagagtgtggtttagaaggacagtggctctggagttggagcagttgggcactgctgggtttgcctgccccccattggatagatggctgatgttgggaaaattatttaacctttctaagcctaggtttctctactagttaaatgagattatgtctatctctcagaatcgttgtgaagagtaagtcagataatgactgcaaagtgcttggcaatgagtcttgtacacatactgggaggcttcctaaataccacttctcacaaatcctacttcctgcttgtgaaatcatgttatatggaagaaggggagtgtctgaaaatggtttgaatcttgtgtgtaattctcaagtaccagcaagtagttgtgattatatttaaagcacctagccctgtgcttggcatatggcaggccttaataaatacccaagtcttcctgcttttaatcatcagacttagactctgggtgtgaactaaggtagctctgtgggcacacagggattttggtaaacagaaaaagaagtcagcagctgaggtaggggtggttcacagtcttgcttgtggttcaacagggactgcatttatgaaaatggcaagtgagcccagggcaattggaactttgggccttgccagcaagtgtggtatttcagtttacatcctcagagtaagtacaatttcaccattattccattgaggctctccttgccaagaaaaacccattgtaaatttctggtttaaaggttctgcagttttagggagttgtactttttgttgctttaacattttcttggcaccacacattttaagctgcactggcttaccttgtaaatagtatacacattttgtgaaaagctgaaccacgtcatttgttttcctatgttccttatgggaaatggtgatgcttctgccccactagttcccctgggtttctgatcaggcagtttggagtgagaaaatgagactgagacaaaatatagattgtcagcaagagattggagctgtattcacaaaagcactttgtggacatggtagagccaggcaggagagaaaagtctgtggccggcagggtgtctgtgtgacgtggacccattgtgtgtatgggctcctcccgctgtaccagtggccagctcccagccaggccacccgggcgagggcctctgaagcagagagccctgcacagtctggagccgctctaacccagtgtactgaataggactccaaagaataggagctgtgttccctttgtcacctgcaaccctgctttcagcctgcacagtgaatgtgcacttgggggctgaattggcacttggaaaaatctgcaggaactttgtgtgtgcacagcgtgtgcccagcggtatgggcgaatggagcgtgcacgctggagatgtctgggggctgggtgcttgcagaggagggctgacctctttatgctgcagggtttgccaagaatgctccgcccttgacagtgttgtggccaacagaaaagcattcgtggcatcttaatgaaaggcagcagttccttttttcaagaatgataggcattcttttcttgagcgaggtccccatttagggatggagagagaagccaattatttttcagttaaaatttattttttaaaatagtgatgcctcagttgtaaattaccctggctttgccatgaagacatttacagctagccttctgacttggttttaagttgctgccttgtagaataataaaatagtagcccaaactgtgataaggcatcaaagactttcatatcctatctgtgtagctgatgtgcgttgctccatagctagaaaatggatatattttctgaaagggaatgggtgtatttccctttaccttgcagcttgcacataatcgaacacttcttttattgaaattgggggttttctcccttggacttaataaggagatatagatatctatatatctatatatctatatctccttaagagggagtttcataagttcaaaagttgtcaggttgaaaggattgaggtattggaaacaacaatcttaaagttacctttggaatgatagatctttgaaaaaaacaggtagtttatagtacattggaggaaatgctctgttgttttgcatcttctccaggcctctttatgactactttttttttgagatggagtctcactctgtcgccagactggagtgcagtggcatgatctcagctcactgcaacctccgcctcccaggttcaagtgattctcctgcctcagcctcccaagtagctgagactacaggcacatgccaccatgcccagctaatttttgtatttttagtagagacagggtttcaccatgttggccaggctggtctcgaacccttgacctcgtgatccacctgccttggcctcccaaagtgctgggattacaggtgtgactacttttttaaatgcttcaatgaaacttaacatgatgacctacacatttcagctgcgcatatgttctacctgttaatggtgagatacaacagagccatctttgactacttcacgctgtttactctaagaggcctgtatcattagatgacttcctgttggaagcagtaatttgtgtttggacttgggtgactgtcagtatgaatctagccaagaaaggtcatgtcacctgctacacagtttgctagagggaatacaggccaagccttttgcctctgaaatcaaagtactgtagaaggtgtaatagaaatgatgcctaggtttgtgtattcagggcctgagtttctgattaaagctgttaacaatgggggcaagctttccccgtgggagacaggcttcttggatctaaacctttctgacatctcaaagctttatttcctgatgatttctaaaagggaaggagccagccccttgaaattaaaatatcgacttacattccgttctccccagacggaagaatattagcagattgaatcagttggggttagtactttcttttatgtgttaaactcagttattctggctaagatcagatttttgtctaggacggagctgaaacacatgcggaatcttgttggttgagggctggaaacgaaggttggcttcacacaggttgcttctccaaaccgtaggtaagctcttcggccccgtgcacagcattcacagctgctgtctgctgcgctttcttgctccatcctgtctagtctcagaagtttcatggtactaatatcttggatccttacaaaggactgacttttgacccagttgactgataactatagagtactttacagtttaccaagagctttccttcatgtttgctctttacatcaaaattacaagatgggttttattatccacattctttttgtagatatgagggccagagaggttatgagttagccaaagtctatccagtaattgacagagccaagattctaggctgggacatctgattccaaatctactgctcttcatgctcctttatactgcagctacttacctgctcaaagtatgtcattcactcattcgttcagcaagttcttggtggcatgggctttgaagccagacagctgggtcccagtatctgctcactagctttgtgacctctgttacctcttggaacctcagttctttcatcagcaaaatgaagatagtaatagtacctatctaggaaggctgttgtggagtcctttaaacagtgctctggacatagcaaatactccataaatgtttgccattcttcttcatcatgggctcactcagtggtacagggactccacaccagtgacagcactgctgttgaggatcacttgttctgatgcaaatatgaaaatagaagactgacaattgcatagtaaagggattgctaagatataagcaggatgctggggaagcttgaaggatgaacagctgtgttttcgattgccaagaactcggctctctagcagctcacccttgttgcctctacccctatttggtcacattcctgtcttactcattccttgctgaaggcagtatttaatgtgcaggggttttatgggtactttgtgtataacctctttgaggaggaagagaaggagagtatgtctggctaagggaaccttagtggtcatttgggattataagacctatatttaacagttggaggactgttcaagacaaaatagattccaaggttctggtgtgcagtgttctgtctgagcaccacaggatatcatatgtgagtggcttccagtgggttgctgagggaggggactttgtgggggaagtaggccttgagttggacctgaaagaaatgaggatttggattatgagtagcagaagcgtggagagctgggcagaggtggagttatgatatttaaaccatggcctgccttgggtggcgggacagccctgcccggggatgtgggtggtccaggaggcaggtgctgtcccctcctgcatgagaacctgcctctggaccccaacaggatgcacacagcttatccccaccctctgcaaagctacctaataatatctttgtgtttatggtaatgttttttgctgatttggtgggagataaaacctagagagacccacagcatggatgctaggtctgagtgggtctgtgagctgcaacctagctgcagcccctttgtttgtgagctgtttgcctgcatttaaatgccatttacataaggagctgtcagagttgagttggcccatgattattccttgatgtatgttgaaaaaagagaagaaaagaaaaccctggctaatgaggagctgggttccttttctccattgatgacagcttcctttctgatctgatggtccgtcagaaactaaggtggtgtgtgactgtggggttatgtccccgctgaagccgtcttttcctcagagttgtaattgatggggagacctgtcacttgttatgctgatgctgtgcagatttttgtgcagctgccagccaagagagttgtaggacagcatctgattgggtgcaggttgtggcaaaaatgataataaatagagagctggtgagggtagattttgattgacccgagattgtatattattaaactggagtctgcatgtacatgtcagtttatgaagaaccagacccataatccaactttaggactgtggcagttcgggtttattaaatgtgctttatatcactattaatattgaggagcaaagaggaatatctgtaatcttttaatctatgcaataatggtttggagggagattaccagatacattggactattgtttgtctataattgtattcagaactctccgaagcattgatttgtttctggcatgctgatttggctcagcagtctcataaagctcttttatagtcctctttgctttgtgttttccaaaaataattggagaataataataatgtggctggcgataaagaagagagagtaaggttgaaagcaaatttctagccgagtggatagccataaacatcttctatgctcataaacacctgggtctgtgacctttgtgtttataagatatttatcgcctcatgggctctctgtttgggggttaccacttcagtgccttgtaaaatttgattgtgtttagtaagtagattctgaatttttgctgagtagggaaaaagtgcccctcacctttgttttctttggaacaaccaatctgccaagaggggcagatctcaccaaggacaggagcagagagcttgggtgtgcctgagttttgtggaaatggtacagtgggacccagtaagggtatcttttgtacttgattaagtggcttgtgatggaaatgacttttgaacggaagggaattgtgcaacacatcaaataaactcaagcagtgtcgatgggttttccttttccagtagaaatggaatttttgattcaagtcgaggaagctttcttgggatttggatttttgccacttcctcaccctttcttcccatttccaaaacaggcctgaggaaatgagccagagaaatggtcaaattcagtttcattgactttaatacgaaggtatgactaagtgctgcaaaagcacagttgtcttctatcttcagcagtcctctaaacatttcttggggaagttttaggcactttgtcaacctctattgtcctcctgatggtgttgcttaattactcttgaaggaaacagttggattcctgtgaactgatgacaggtgtatgctgagctgcctgtgtaaactattggctgcctgttcatgttgtgcacagtggatcagaggcatatgggagaatgtgccaaaacgggaatcttaagggagttttttaaaaagtaaaaattgtttgcttttttgctgtggtgcgaacatggctcacttccgccttgacgtgctgagctcaagtgatcttcctgtgtcagcttcccaaatagctgggaccataggcacatgccactgagcctggctaattttagtgtatttttgcagagacagggtcccactatgttgcctaagtgggctcaagtgattctctgtgccttccaaatcattaggaatacaggcctgagccactgggcccagcccccagtaagctttattataactcaactagcttcattataactaaagtatgagccagtcttgaggtgtataggacctatatttatcaaaggagactgttctacctaagacttagtttcttgtcctatgaggttaattgctgctgcatttcatggagtttatgagatgtgcttccctctgcccttcttcaatcagatggtactgcctgggagtcatatacatgcaggactgataaagagcggctcccacagtggcagtacctacagtggactgtgctgtaggtaaagggaagctccatcacactggcatgtgggaactggactaaaaggccacgaatcccccaacacttactctctgcccagctttgtgaaatacaaaataattatgagttccagactccagagatgctttccacctagttggggaaggagaagtttaggtcagtggttctctaagttggtccccagacaaggagcaccctaattctctggggatttgttagaattgcagattttggggcatcgcccagactaacagaattggaaaccatggatggtgttttacaaactctgcaggtgattcagatttatgctaaagtttgacaactcctgctttaggttcatcagttccagggggaataaatgagtaaacaaggcacatagaattaagggcttcctatagggcacagcgaaggagagaataaggtgctttatagcaggatgctaagctggactgtcaatcatgtgggaaaggggtcaaagactggaagagcagggatcatcaaggcagtgtttgctggggagagaagttattgagccaggttttgaggactgaataggagagaaagaggtagagtagcatgaatgagctcagatgtgatagggagggttctgttccttcaagagcttagttaagtgtagtgaaaacacacacacactccggacaagaaaaattaatgtaaaatcaactatagaacttaggcaggtttatgaagaagaaaatatattcctcacaagttggattcctgtgagttcatctcttttattacctctggcaatggtgcaattaattggggccagggctctgcacctggaaaggctttataacgtgagattctcaagaggaagattttatttgcctaaggctactactttaaaagtgagagaggcactcatgaaaattaggggtaactgtaaaaagtgataagctgctcaacatagattcagtgcccagtatgtataaagtgctgtgtgtatactggagagagggaactggaatctaacttggggatgggggtggatccagaggagtagagatatgaagaaatacacatttaagtccagtaagtttttcatgcacctgtagtcctgagaggtgaagccagctggacgtcctgggtcgagtggggacttggagaacttttctgtcaagcaagaggattgtaaatgcaccaatcagcactctgtgtctagctaaaggattgtaaatgcaccaatcggcactctgtaaaatggaccagtcagtgctctgtaaaatggaccaatgagcaggacgtgggcagggacaaataagggaataaaagctggctaccccagccagcggtagcaatgcagcactgatccccttccatactgtggaagctttgttctttctctctttacaataaatcttgctgctgctcactcttagggtctgcaccacctttaagagctgcaacactcaccgcgagggtctgcagcttcattgctgaagtcagggaaaccatgaacccaccgggaaaaacaaacaactccagacgtgccacctttaagagctgtaacattcaccttgacgtccaaggcttcattcttgaagtcagtgagaccaagaacccaccagaaggaaccaactctggacacagtccaagctactccagaggctgaggtgagaggatcgattgagctcaggaggttgaggctgcagtgagctgtgattgcaccactgcactccagcctgggcgatagagtgagacagggtctccaaaaaaaaaaaaaaaaaaaaagtctagtaagtttttgttttcctttaaaggcagaggggagccactgaaggttattgagcagggaagtaacaagattagagttgtaatcatgaatctaattaaaaaatcagtgactggagggaagtagatgggttagaaggctagtctagttttaatactgtgaggcagatgagaagggcttgaactagcagagttctagaaaaatggtgatgtaagcaacaatagagtcatattagttaagggtgagagggaagaaatatttacaattcactgtggaccagccacttatgcctgtcattggtagagcttaaccatcacaattttagcaacacagagattgatttttatagaaggtccaaaggatatgtagcttggagacatattcaagatttgactcatgctgggtgttatggctcacacctgtagtggctcacagctacctggtaggtcaaggtgggaggactgtttgagcccaggaattgggaccagttgggcaacacagcaagatctcatctccaaaagcaaaagatttgattcaagcctgcctgcctgcaaagcctgtaccctttttgctctagattctagactttggcgaatagaatgatacattttgtttataattggacagttgttgatcttggcagaagtgttgactgctgggaggtgttaagagaaaggaaaaagcagcataagatatggaagtttgtttgatgaaactgtatctcaaagagtttaagagttttagcacaggacagatagaatcttgccccacccaagatgatggaagaacaaaacaaagtctgtgctgttttctttgttaaccagagttgagagtggagtccaatccaatatctgcctagtgggagtctcttgagtcctgatcccatgagatcatacatatggctgctactcctgttgtgaggaaggttgcaattttagaaataaacctggagcttttgaaggtcctatttattacttcagcccacttactgccgaggtccccatgttttgcaagtgacaaaaataaatctaaaatggaaaactagggagaaggtgagagaaagtgtccagagaaactggggactttgagttgtttggtctaagctacttatttgcatttttgtctccacttcctagcaagcatattggtacttagcaatggtgggaggaaggcagaactgtaaaaaaaacgaagtcatcattctatccttacacttgagtttcctttcagcaacctctctctcccttgtctttgtcccgtctcataacttaggcgtgatgtgctgctgtatctgccttgctgccttctcctgagtggaagctgcagctacagtgttggttattacacctggcaattagattgtgcaggacagtagttggctaggaatggcataaggttgcatgcctcgttaaatctgaactccactcagcatagactcttgtagaagcaagggggatttgtttaggtaaggagcccttgaaaggagcctgcttgttgaactgtatgttgagcagcagtgatgaaaagatgcctaaacatgtgtcccacagcagctacagtccatcagcattggacacattggtagatcacccctgctgttaacacaggtcttttcagcttactcgtttgtgtacttaactgttgagtgctcttttaattaggggcgactaacatcaaagtactatagttgtgccgggcctgctaatcaacaggtttcacttatactggggatcacttcagctttacaccaccattatcatgacattgatttttctgtgcacataaaaggaagcacttactgaatacaggaaaaaatcatgattgctaggtggaaaaaaaaacaaaaaaccagcaagaggaactcagttacccagggaaaatgtaaacgtttcatatgaacattgacagtgaaatggatttgatgagttttgaggtgattttgttagatactttgagagaaattgagaattctgtattccgaagagacagccggacttgaaactctagaggtatgattttgaccaagacctgaacttctctttgcctcagttttttcatctataaaatagggttagtaataataccaacctcactgagatattgtgaggattttgtgagatattgtgagattgaatgattagcttagtcactggatgtaagtactcaaattatagctattaataagtgtgatacggctgggcacggtggctcacgtctgtaatcccagcactgtgggaggccgaggtgggcgtatcacaaagtcaggagttcgagaccatcctggctaacacggtgaaaccccatctctactaaaaatacaaaaaattagtcgggcatggtggcacctgttgtcccagctactcaggaggctgaggcaggagaatggcgtgaacctgggaggcggagcttgcagtgagccgagatcgcgccaccgcactccagcctgggtgacagcgcgagattctgtctcaaaaaaaaaaaaataagtgtgatacttaatgtcataaatcattgttattatttctgagaactgatatcttgtggtccattgttgtggcagaagtataatttatataggaaccgaaaccagccctcgatttttttttttaatcgccgatcttggttgggcttcactatcattttcatcagcttcacaacccctcagttctgagaaccctccttgccatacaagccactggagtgtctgcgtttcctttctgtggacattgtcacctttcccttcattttggtaaggccatggaaacagagcaatcagataaaagacctgggcatttggcactttcattggccatacttctccttctggcttgagtttatatgtggtttggggtagttactggtgaaattgagctttgcagctgtctacttaatctgcatttcctgatctgctttggctggcaatcaaaagctgtatctatttcggagattgcgcaataagacttttaatgacaagttaaaagacaaagggttggtgggattgaaccttatgcagaaaatacttcactatacttcggtggctcctgtttactggtgattttgtgtggatagtaacttaaaatcaagaaacatttttgctaacatatttcctgggccattttagaaagaaatttctttatttagccagtaagtagagctttctttagcgtttacatagttatctttttaatattaatttttgcaatccatatgaatgaggccacatgtcctttaacaattttagacctcttctgttatgcattactgccatctgtcagtatgagagaaagcttcctggggcagaaggacttaaaacaatggttctcaaccctggggtcacattagaatcactggcagagcttttaagaaattttagtgcctgggccagttccagatacatagttgctctgggatggggcccaggcattgatgtttttaaaaaactccctaggtgattctagggtataactgggctgagaggctctcctccgaaagcactgtcttaatggaagaaccagtggcatgagaacagttctgctttttctcagcagtaaccttgttgtcttccattgcagtgctgattttgacaatggagccatgcggttgtatttgggtagcggtttggagggtaacaagtgtgtcttttgtatctctgaatcctctgcagccagtctagtgcctggcatatactagatgctcactatcctccacttcacttcttttggatgactaaataatggaatggagcccagatgtactagcctttttacttaatccctgagcctttctccttcagtggtccgtaagggagcaggtccacaagcatacacttttattgttccaggaggaggaagacgcccagcttcggaatgcttgaggcataaaactgatccttggttaagatcagcagaggcttgctgtgtgcaacataaattgtcaggtaaagaagcaattaacgtagtgccatttatttcctctttaagcatctagtccttatgagtgttgtggttctgcactccaactggaaacaggttctctattgccctgttttgctcttaaacacagacacctttttcagtcaagagaattagggccttttaaaaactcttctttctttcttttcctttttaggtagcccatattgaatcaggtcctgcagctatagttattcatgcagggagaattctatgaacacaggggagaatggcctgggagtttgataatttgttattttttggtttgtagattgagaagtatattaagtaaggataaccccttatagttagttagttattttatagttttcctgtccagaaggttttaatctctcacacggctgtggactggcaaagtaactaattattgtctccagtttatggataaaaaaatttaagatgcggcaaggttaagtgacctgcctaaggtgatagacctgggccttgaatccacagcttttgactgtaaatcccttcagtacactgagctttggatagtacttttgcttggattagaacaccctataaatgtgactaatggcatctcagggttctgtcctggctgtcatagttgaatcctttatttgcattgcatgtgcttgcttgtgtgtgtgcgtgtgcaactattaatattaagcatcttgccatttgcctctgtagagcacagttgatagacgggaatatacacttgatgtagtcaagagagtgtcatcttttattaagaattctgatcttgcctctccaaaatgcctactttcacttttagtctattgtaagtgtgaatatttgtgtgtggtattttattcctaggcaaggtgtttttctcagtctatgttgtgtgtctaggatgataatgttaaagcttaatatatttagttttggaagactacatttttctggggtggtttatgagttgttttccttcctccaacaaattattgagtgtctagtatgtgttctatgctgtctacctttacttccatctcaaggaagtctaggataaaaataacattgtttatctgtgaagggataaagagtcaacacccatttcatgtcagctctgtctttattaggcatttggctattgagctttctaatttcttgacttttgggagtgtttctcccagttaccagacaggtccagggtgggaaatgctttccttgggccccagaactagctcatggagaggtggttgtagcttctgggaattttgaaaagagccacacccaggaatctgcttggactatgtgttctttctgtcctgcctttactctcctcttttctccctcttataagcaaagcgtctttttgcttccttgcccccaatcccagagagactgttaacttatgtttgcatgtaaggagaacagtcagagttaaggatctcaaactcaggaaagtggtttttgtactcaagagctccctgtgtgtttgcgcagcacacttacctccatccaggatgcacttatcctgcgtagatggattgtaaccgtgatagagggggaaaaagaagaggggaaaaaaaaacccctaaaaaaaccctggattctgaagatggctgcagtatattcttcaatagaaatttgaagcatgaagtggattttagaacaccacatgaagctcttcttacttaaaacacaagaacttaaaacttggccaggggaaaggtgtagggaggtggagaaaagcactccttccatttaaggggaagtaagcacttgacttcatcaattgtggttaagataaacaaagcttatctttttggttggcatcagaaggggcatttaaagtctcatgaaatgagagaagggttgttctgttccttatttactgtacttgaacggagtcactgaaaaccttgatgggatgtctctatgactgctcattcctagttgtctgcagcactgtggccagtgaatatgctggttcccacagaggaaggcccacagcatggtttccttcctcttcttttaattttgcctcgtgtcttttgtagacgagagtgctctgcagtaattcttttgtagaaactgccatgcctcaaatcacattacataatacaggctggggaccagcattccgtgaggacttgatcaatgggttgggaaacaaggttgatagcattgctgtggaggagatgtcaatgcgaatttgtcagctcacctcacatccttgcttgcagaactttgattttatttaggtgttcacttccatgtggacttgagttcaggggggtacatcttgattagtctattccagtcattatatttctactccttgtcagtgatgggcttaggaaggtccaggtctggctggctggacatgaggggaaatcttgtgtgggcacttctagaaaacgtttccttgattttgatgaagagaagtataatttctatctggttgttgtctgcatgtggtgctttgaaattggcagttgccatctttgaaccgtgagccagcgtaagaggacaggcccacatgcaggggacagcaaagctgtacaaaagatagatactatctttgatgatattgtggagctgttgaattgatcagcctgagtccattccattttgggacttcttgttatgtgtgagaaagaaaaatcacgttttaactattttggctggattttctgtttccttcagtctagtgtattataactgataactatcttaccccattcatacaggatggtttgagataaaattagaaaatattggaaatgcttttacacaagtatgacacacacaattaacatagacattaacataaatattatattgtaatgtccagtgttctcatactttgcttccatatcacttctgctagcattttctccaaagcaaggggacaggccatgaggatgaaaaacagccatttaaaaactgtcttgggggttttcagtattctttctgtaagaattgacatgatacataactcctaaaacatagtataaggcaaaaattattctttcctgatgaacttgtatttcttcttattggaaagtggcaaataaaataatccagtataggaggcatcatgctacctgacttcaaactatactacaaggctacagtaaccaaaacagcatggtagtggtaccaaaacatacatatagatcaatggaacagaatagagacctcagaaataggaccacacatctaaaaccagctgatcttggacaaacttggccaaaacaagcaatggggaaaggattccctatttaataaatggtgctgggaaaactggctagccataggcagaaaactgaaactgaaccctttccttacactttatataaaaattaactcaagatggattaaagacttaaatataaaaccccaaaccataaaaaaccttgaagaaaacctaggcagtaccattcaggacataggcatggggcaaagattttaccatgaaatccccaaaagcaattgcaacaaaagctaaaatggacaaatgggatctaattaaactaaagagcttctgcacaacaaaagaaactatcatcagagtgaacaggcaaccaacagaatgggagaaatttttgcaatccatctgacaaaggtctaatgtccagaatttacaaggaacttaaacaaatttacaagaaaaaaacaccaccaccaaaaagtgggcagagggtatgaacagacacttctcaaaagaagacatttatgcggccaaaaaacatatgaaaaaaagcccaacatcactgatcattagagaaatgcaaatcaaaaccacaatgagatgtcatctcatgccaagtcagaatggccattattaaaaagtcaagaaacaacagatgctggagaggctgtggcgaaataggaacgcttttacactgttggtgggaatgtaaattagttcaaccattgtggaagacagtgtggcgattcctcaaggatctagaaccagaaatgccatttgacccagcaatctcattactgggtatatacctaaaggatcataaatcattctactataaagacacatgcacacatatgtttattgcaacactattcacgatagcaaagacagggaactaacccagatgcccatcagtgatagactggataaagaaatgtggtacatatacaccatggaatactgtgcagccacaaaaaggaatgagattatgtcctttacagggacatggatgaagctggaagccatcatcctcagcaaactaacacgggaacagaaaaccaaacagcgcatgttctcactcataagtgggagctggataaggagaaagcacagacacaaggagggtaataacacataccaggagcagtgtgggaggaggcaaggggaaggagagcgtcagaacaaatagctaatgcatgcagggcttaaaacctagatgatgggttgataggtgcagcaaaccaccatggcacacgtatacctatgattacataggtatacctgtacattctgcacatgtatcctggaactttaagttaaaaaataagtaaatacataaatacataaaaattcagtatgttttcttgttgtcttatttcaccaatgagctcagatccaactttaatggttaataacactttgtctaaaattcctaatatatcttctaatattttctagttggttttatttattttagttattttaacaacagtgagtgatctgtatcacatcctcctggaagtaccttggatttcattataactgaggaagcgtttgttatttgtttaaatgagtgtcccagatagcttgcaatggagcatatttatttgtttactctcttatccattcactacacatttattgagctcgtactaaaaattagccagacacttaaatcgttttctttggcttgattgtagagctcataaacaaaagtactaggaatttagaattgtagatcacagagcattagaataggggaaagtcatttttcattgttgagcctgaggagagtttcgaaggtgacttgaaggtattgatttgaggaatgccgatggttttcatcttcttttcccatcactaaactaagtatactcccttcagaggtagagagccaggagacctttatagtagtgaaaggacaggaaaggaaggctttcatagacagcctggtactggagtcagtattcaacagtgaaattctggggtatagaaaatagttaatttatatactttaattcccacctgatccccactccccaagaaggttggaatccttgtttttcctccttttggaatttgctactttgaagggtttttttcttttgaaggaataagaacagtctgttcattgtgctatttagtgcaattagaattagggagcaatatttgttctgtgagttatctaccctgacagaagctctgatagaagctcagaatagttaactgccctcatagaggcttggggcatcattgctggaaatgagatgcctaactccaggacttcatcctgtggactgcagaattaaacggaaccaaagaaaataagcaacaaaaaacagttggaacagcttctcagtggacttactgctgccagtcttggtggggaagcaccagtgcttcttggactctggctactttgatcttcccagggtgctggagaacctggaaggacccaggttgtctctcctatgtccactgtaagccttggtaagaagcatgaaccttctgtaagccaggacccaactgaccttttaagatttttttttttttttaatcatctgaacatgctatgccgttgtcttggcattgctttgatcccagatgtctcagttttaaagagcacctacactaagtggcaaggagaaattagaattatccatattgatgatgaaaaataaacctcagagggcttccaattgcaccctaattcttctcccttaggatattgagagagtgaggtgtagaatttaaagttaaaaaattttacatcactttacttaataattgaaagttacttggctttggcccttggcatgatttaaatcacaatggatttgagagatgctttgtcattgacttaattttcagggttttaactcattcagtaagttggcttggcagccctaagcagcattagtattttgtgtgacattttcaaaatatcctttgaacctatggtaatccctaaggcagccatgttctaaaactcagagaaggacctccccaggggcttgaaatacctgtgtttcctcccctcaccgacaaccccctaccctgctccccatagcaatgttttgaggttgtgtgatctggatctgggttgaactcctgcagcgttttaaaccttttgtttctttcttctttaataacaacagtgtttcttaccctggtcatctattgagaagtgtaggtgaaagtaagcatcaacagaatggtgattttgaatatgggaatgggttcttgggagccactgatgtacctatagggactggggatatgattggtagttctagaatgacgttgcagttgctctatacatgacccatcacgtggaagatcctgacctcagcagcacacagcaagcatgtaatagctgcagagaataatgctgagcactagtcaactggtaagcattacagactcccctgcttctctctcccatgggtcaactggtgttgaataacagggagactagtactttggacatttttacctactgaagttgactcatgctgttcctttagaaggctaataaatttttggtgattaactgaataaattaacaacaggctaagagaataattacagacctatttaggaaatctagttcttggttttgcttggagattcttgccagaactttaccttgtaagttagatatttttacctgttgcttctcagaaaaacctacaagcatactcttaggtttataccttctatccctaacaacaacaaaaacattaactgtaaactgcctcctgttatctgagggtaaagtcgtaaaaatcaaagaggaattttgaggagaaagtcttggtaacagaaaatactaattagttgtctgtgttgtgagatgtgttgcttgagagtgtctgagcttcagagaatgtataatttccctccttgatgtccacaaggagcttctaggatactttattaaaagacgagtaatcagttattattcttcgtaggtatatctcaaactgcagctttaaacagaatcaactagagggctttgttacaatacagattgctggactccactcctggtggtatggtaggtctggaaaagggcctgagaattaaaatttttaggtcctccagtgatgtctaggttaccggtccgggaaccacccattaagaatcactgttgtatctggtcctctgcctctttctgcacatcttatatccatgcagcaggtatgaaaatgagctccccaaaagcattcaccttcactgttgacctgattattatataattataattggatctcaaccttttaaaaggccaatcgtatctgaactacatattaattataaatcttagtgaaagctctattatattatctcaatttttttttcttttgagatggagtctcactctgttgcccaggctggaatgcactggtgtgatcttggctcactgcaacctcgtctcctgggttcaagcgattctcatgccttagcctcctgagtagctgggattatagatgtccaccaccacgcccagctaatttttgtacttttattagagtcggggtttcgccatattggccaggctggtttcaaactcctaacctcaggtgatccgcctgccttggcctcccaaagtgctgggattacaggtgtaagccactgcgcccggcaattatcctgatatttgatcctgaaaaatcttgcttgaacttgaaacttgtcctagaatgtctttgaaaagttcatattccgataagtgtattacattctacaacaattatgctaaaaggttacttcacagaaaattatatccacactcatgatagaatcatttggaagtttaaaaaatatggtcatggttggactccatccaagactgattgaatatgaccctctgggattgggcaccaagtaatatacaattttgaaaaatttccaagggattttaatgggcagctaggtcatgaaccactgcgataggccttggagagggaggggagcagcagggctctggtaagtcctttacacttgctttaacctgctgctctttccccttcccactgttaaactcccctgcacctctacgtcactcttctttacaggctggctagcgtcatcacattgtaggtcgttttctgtgggcttaggaaaacagtccaacagactgttaccctagtgcgtgcaatgaaaggcctttattcttagggttcaaattattttacaacgaaattgtttagtttggagcctagccagtttcatctcttctatactccaggttgatcttctgttttagatggtgttcctcactctgccttcttcacctgaataaaggaaaggcaggcaatgtttccagagctcctgagccacccttagtgctggaggcaggtttaggaaagagctggctccctcattgctaaacagaattaatgttgttcaatcactttattctggctctgtgaaataatacacaggaggaattgctgctttatgactttaatctgataaactacctgctctggtgtgttacattctgtgtgtgtttctctgccaccactgcagaataatctcagccttatgtgtagcaactagaatgcaaggttcaaaactcaaaccaagccttgatgcagacgtcaaataagaactactttagaatgctctgtgataatgctaggcacttagcatgactgctggggctcctaaaaggagccaggaagcagcagagcctgagaatcctataacatttccttttgagcttgggcctgaagcagccaaatgctgtaaccaaataaaagccagtttaccttttgcttttcttatgtcttcttttcttgttctcgtcttataaattatgttcacacttttccttttttcttttccattcatgcctttcctccgttttctctgtactccatgcatctgccgcctgtctgcttgcttggtttttcttctgtgttctctcagcttttcacttttggaagagtcaggaatcttgtatattttgagaattagcgaaacatcgtgggtatttatccaaagtggaccttgtacagtctcttttatgctcgtttttaatctcaccaatttctagaatctcactaatttctaggtttgttaagggacaacatggtgtattgctggagatcaagacacaaagagtaacagagcctcagagctcattaatggtggtctgaaacaaggaaaggagaattaaaataatgtccttaacccaggacataagagatacagatagagagatggcaaaatccatggcatatctgtgacggttttctttttttgtagaaaatatcataaatagatcttagaactctgatcttctgatttttcttaacacagtactctagggagaggccactagacaagatgaatcccatcactgttagtgggagcttagagggaattttaggtgagggaaaatacggagataaatgccatcttttgagataggtcttttgattcagtgttgaagatttgtgtcaagagactcccaaaccataatagatattgcaggccttccctttactgcctgttaacccaggcatgtgacaagagcaagatttctagagattgccatagaggaagaataatttcagtgactttgggaaagcctgaagactgatttagggtgaaaggcacatgtcattaaagagtttcattatagattgctggttttattaggaggtaagtggttggagacattcgtttcctggaatcatgtaggacatttaaagtgttgaatgctatatacaacaccccagaggtgaagaagatgtttatcaatttaggtgcacagatgtcagtctgattattgggaagagggtgaagaggtttgacagtatcagagtatggacacatttgagcagcagcagctcattgtcctagaacgaattgcctcctggccgtgatttattgacatagctgatggagggactcagcagaagccaccatttatctgtttcttcagttgaccattggaaagccttacaaaattatgtgcgtgagaaatgtcaaagtgacagatttgggttcaaaagattgtacacttttatacatccaccctttgcccttctttttggacttgagtattttagacaaaactaacattttcttcagcttagtataaacagatttctgctcagattagctgagaaggcatacaccatgttatccttttatggatgagtgatacatgtgatgtctttgtcaaataggaattgccctctgccttgtgtgtttggagagatgactggccacacctctgaagcaatcagctgtggccaaattaacataatatggtacctgtacataaaactaaatatagaacaattttatctttttgtagtaaggatactatattccgaagaattcatgtaagttgaattatttaaagtggatttagggacattcattgtaaagttaatctttggtaaatccttgtgtggtgattttttttctctcctcttttgcatccccatttgaaagcccacaatttaatctatttgggtaaggtagattcttatgtgattaaatcactccagtttatacgcattgaggagtaaagtcaccagactaaactcctcaggaacaatgacagagagttttgccatgggtgtttgggaaaactgcatttactttctgcacacttaaactctgtttcagtccacatatttgcacgcctaaaaaaattaacaaattttcacagtaacaatgatactagcgtttacttattgctcaaaagaggtattgaccgctatagtgtgtgtgaagttggaaactttaggatgatagccatagtttgtacttcgagctcactctagtgggggaaatagacaagaaaacccataattagtacacagtaaatgttaggtatatttctcatgtgaatgtgtgcagtatggtaactgctcgttagaggggaccctatagaattgattacctataagagaccttgactgcgcttgggatagttaaggaaggcttcatgaaatagcgacaaatcagggttagctcctggcctgggatgatggctaaaaggactaaagggcgagtctttgcctcagtttcttatttgaaaatgaggataataataatccaactttatagagattattatgaggattctgtgaaacaaatgcacatagatagttaggcagtcctggtaattgggaagacatcaataatgatgtaagttatccatgtccctagtcctttatttcttacaacaacaatcctttcaagacagtagtactttccctattttgaagatgctcagagaggttaatttgcccaaggttacccagctagaacttggtagggttcagctttgaatctagacgtctctctcctggttaccttttgttctctttatgctactcagggggcccaaaatgattccagctgcttcctgcttcattatccccctaagtgccccactgagaggagtctacaattgcctgcccctcctctccctgcctcctggtcttgccatgagtcactgctgagccatttgtgtcagagaggaaaatgggggcttgctattcacatgtagcaatttgctatgtgttcttgcttatttgccagggacaccagcagagaagcgttcatcaagaggcgtcatgtttgttaagggaccacatggtgtattttaaaagctcttaactctctctggtatcatcgattatgctttagcataagaaataaagtgacactgagcctcttattaataatacacgttttccatttaactttgactggttaaatctggcataaaatgcagacttgcaaaccagcctccctgggatgtgtagcttctcttaggctatttatgatgcggatctctgttgagcagcagcctctgcctgcagctaaggctctggactagatgttctcttttccttttctctcttgatggcatggattgttttgtttcacaaggctcatgttctagatgggattgtagctggtctactacaagctggtctagttgggattgtagattggtatggataaatactgaaatgggagctggtatctgacaactggaggggttatatatgtgcccccatattctgatcaagctttggcattttgtgcatttggcaaaagtcagtggtcaatatttgaagtttgcatgaagttagaagaattttgggctctgaatatgagatgacttagagataatatgtttattttacagataaagaatcaggcctaaagcgattgatgatgatgatgatgatgatagcagaatctctaacaatggttaagccagacactgttcagagtgatttttgtgttaacttgcttgatcttcacaatgactctgtcaggtagacagtattattatccctgttttacaagtgaggaaactgaggcacagagagtttcagtcatttgcccaagccacatagctggcaggtgatagagctggggtttgtacccaggctatctggatccatcaaaacctttgctatctgtgtatcactacactgtagcttgtccagagttacaaagctgggcaggaatagtccaggacccaaatcccagtcttttgttggctgaactatatttgttatttaaagattcttttagcagtggaactcttctttaaatggagatattactagatagcacaaccaaataaaaaaagtggaaacttagctgctgtggtttaagtgggataggccaggcattgaccatgcattccctttattcagcccttgctgtggcttctgagaaagccacatggagcatagttttattttatttattttaatttttagtccctacaacaagactcacagtagggatatgattttaaaccctggctctagttagggatatgagctccagattgctctcttttgggtcacaattaaaatcctaaccggcaacagatatttttggtcagatctggtcattctctctgcctccgtacccattgggggcaaactatgaagcttttgtagctgcattattgtagatttgcaggatttctgttcgtaatcagaatcgggtatgtgttagaaaaaggccttcctgagtgtatgaacccctttgcctgctgacagtctctgggctggagttaacattaacatctgcatgcccagaggacagtgaattgctaacttttcactggctttctttttgcttggacattttacagtgctccagggtcatcattctgggcagtacttaccttgtaagtacctgattttggctcttttctcactcactagtctgtgatctagtcttctctctgtgtctgcagagttcagtcccatttctggagcaaagcagtagctcagtaaatgtcagtggagttttttgaatcactttttattattccagattataggcatatatgtatagatcaagtaggctgaatatgacttaatccccaagtttcttctataataggaccttattttatctctccaagtaatggaataaagggatggaagctggtctagttggggttgtagatttataaacaagacattaatctgaagcttatattcttttagagagttacaagaaaacccaagatctccccccatccccaattaaacactttgttctttgtaaggatagtagagtagtaggagtgggggtattcaggaaagcaggtcttaaggcagaagaatcacatcaacatcccaagttctattcctcactgcctcacgaatggtctgctagccacctgcagttgttgttgttgttgttgtcgtgttttgtaggtaaaggaaatatggcaggagagtgaagtataagaggtccaggagcttggtggaggtggaggagaggggggatggggaaagataaagaggcagataagaaacaggaatcattgtagaccagtggttttcagagtgtggtccctggaccaacagcttcagtgtcagctgggaacttattagaaaggcaaatttgctggtttcactctagacccagtgagtcaggaactctgatgggggtgggcagcgtctttgaaaacctttacttcactaactttttccccctctatcttaaatattcccaattgttttaggttttagttgattcccatattatacttcaattgtgtgtcagtgagtaggtctgtattaaaggagaactgttgaggaaacataaagaaatctctttgtattccaaaaagcgtttctcagagttaaattacatgttttgttagtgtctgttgcttttgttcagattaagctctgaaacaaaattaagattctcgtcaaggcttgagcttattaatagctgtttcatttgtttagcgctaatttaaaatgtctgatatctgtagaggaagtgctttataaaaacacatacttgttaagtgttccactaggagaagcactgtgaagtccaaaggatgtggagattaggcaaataactgtggttttgttgagctctcttcagtgtaatatatgtgtgggtgggataagaacactgggcttcacaggtcgaagaggcttccactggtcagatttcagacaatttgtgcattcaagagaattactgcaactgagtgtaaaacactgaacaaataaaaattcttgaactcatagtgatgagagatggggtgggaggagagaaagagacagacagacactctgggcatcattggaggtgactatgatgtcaacttctcattctataaattgtaaattacatgaaacaaacaccctgtctttactgagaaactgtagttctttcatgattggtaagagaaacctctgctttacaaatggatgctaccaaataaaatatagaaggatacagaatatcagcatttgcatcctgcagtgaaaatttgaacaggcaagtgccgtcaatgcaaaactagttgaaagcatgttggggaacagaataatcttattagagaataacccacaaattaccagcaaaggggaaagtatacccttaacaatggcggtcaccaccttaacaaagtggttcaacttagcatcacagtggtaggatagcctgacagtaggagcttcctgatgtgacgaactacacagcatcaccaacaatttatgccaaaaatgtttaacctgaatctaaccaggtgtattaggctgttcttgcatggctatagagaaatgactgacactgagtaatttataaggaaaagaagtttaattggctcatggttttgcaggctttgcaggaagcatggtgctggcatctgctcagcttctagaaggaggagaggggttggcacatcacatgacgaaagcaggagcaagcaagagagagtgtgggggaggtgccacatacttttaaatgaccagatctttcaagaactcactatcacaaagacagcaccaagccatgaaggatccactctcatgatccaaacacctcccaccaccagcattggggattacaattcaacatcaggtttgggcagggacagatatccaaactataacacaaggtttacagaaaatagaagggtttgaaaaacaaattaatccacaccaggaagaaacagaccaaaaatgtgggtcattctcaagaaaactggtatgtctgatcttttcaaaaagccagtgtcgtgaaacaaattgctggtgggtattactccggattacaagagactaagggaacataacagtcaaattcagtgtacaaatcttgatgggatctggcttaaaaattataactgctgtaaaagatgtttgaggcagttgtagaaatttgaatatggactggctatcagataacattaggaacttaatgtcttaggtgtgatagtattttggttgtgttaggaaaatatctttattcttaggagttgcttattaagtatttcatgaaagtatcatatctgcaattcactttcacatggttccatgagagagacgagtgcatagataaggtgattttggcaaagttttaacaattttgaatctaaatagtaggcatatgggtgtttgttttatatttatatttatattcagcatagagaaagctgtgaattcaggaaaagtttatatgtaatttctgagatttctagctcatgcatgcatttctgtttgagaatgccttatctagaattttttatcaagaaatctgaatggtgtttaagaatatcttatctagaaatatgttggcatcttaatattatggtttggtagataaaatggatttttttaaaaaaagacttgcaaagaagtggatgaaatgctaatataagaaaattagattttataaggaacatgtgaccagataaacttgtcctaattattgtgagtctctttaaagcacataccttaggacattgtgtgttgacgcttttactgttcataacatattctttaagaattctctcagagccttaagatgatttgtttttgagaaacatctgaagtctcctgtagcttattctgatgttatgaagtaagtgactaaattttgatcacagaagtgtgtgacagggaagtagtgggatattctttgcccctctttgtgtcctgtgatgctggtggaaatttcaaaggaagagtttcaaaagtagtttactttgttcaaactctctagccctaaaccatcagtgacaccagtgagtgtttcttattttacctatttgggtgtgttagatgtattttcactgggactattcttttggtcagagagcctaaagttaagtgtttgagcttctggtcctgtgatctcagcaactggacttgattcaggtgctttgactcaagggcacagtggtagcatcaccaaaaatagatgaatggcagcagatccctaatggctggctctctgctggttgcccgtctcagctcaggacttccgagaggtataaaacctcactgatagccaggcataatggctagggtttactcagagatgctgggggcttgagtgtagtattgctctgttgtaggctgataatggagtatgtgccaggtgggggcaggatggtatccaggcagtgtgggcaaagggctgcagttagtcccttgttacactcagtgacaggtgactctgagctgtctggaagtaagataaagtgattcaaggataggatccatacctgaaagagaggtattcagaatagcatttgaagtcaggtagacttcagctcttccaatggacctgcaagaggtggtcaggaaatatctcatagatgaattaaagaagtgttacatgaaaatgtaaaggggcaaaccaaataaaatgggttcattaggtcccaggactagtggaggggcattcatgttggaatggagagtagtgagaattggggaggggttgcataggggcttgttcttagggcagagtttttcaacaacaggtatatataagaggtcaaaatttaggaagtctgttagagaagattataaactccatgaggacaggagacatgtctgcattgttcaacactggatacttgatataatgcctggaaaatagtagatgtgcagtataaatttccgttgaatgagtaaaaatgttaagtggcgaataaaggaatgcatggggatgatacagacaaagcagtaatctgtggtggttgatggctgacctggttgtagagtaccagggggaatgtgaatattttagatttcctcagaggctagtttctgagatgttttgtttaccagtgtggtaaccttctcatggccctagctcaaatggtaatcaactagtctttgcagcacaactgtgaggtaaacatgctgtgtccattttagagaagaggaaactgagattcagagagatgaaggaatttgcatgaaggtccacaactaagaagataagatgtgaaactagatatttcagctcttgaatacaatcttctttttacttgagcgctcaatgctggggacagttctgcttttcaagtggcctgataaatagtatctttgtatcatgtgagagttattaagactgtgatagaaataaataaggaaaaattcacataccagccaatcctcgttactctgcttattcccctattcatcatttggctgattgaatactgaagatgataaagctgaatcggtagagcaatgtgtgattaaaaaaaaatctgctattccacttaatgggctacagttattagaaagaaatagaaaccccagttaatgttagtatgggctacttatttaggaaaggagatttttaaatgaaataagcctttcctttttattatattgctggagacagttttcatttttgcccacctggtacttaaatggttattgctataaggaaaccagtcttactgataaccgaatgaaataaattaaacagacacatgcaaacaaatccaaaatgtgcctgagaaagatgtggtcttctagctttcagtcattcagtgagacatttggcagagatgggtgcagcagataaaactgtcatggttttcagaagtcattccaagacaccagagaggaaacatgacagacactggaaagagaccctctttcagatatgagtaatatatattttatactcatattaatatttcattggagagaaggtcaaaatctacatttaaatggaaatatttaaaaagcagaagcataatatttgactaagtgaaacactcagggtttttcaagaacacaagctgcacccctgggacctcagctctctagatctgttgtttcttagagcacggtagaatgtttgaattcctttagttttatcggtagatcttagccctggcatttaggaatcttaatccctctactccccttccatttgaccccgaattgtgttacatactacctaacagtgtgttcagtgcacagtatggcctctctcagtcctataaaattatttaaatttctaaaaattcatttttctggtcctgtgaaatggacataataggattgtggagatggacataaataagatgctttcaattatgagtaatggaaaacccatctaacaaagtatggtggcaagaagatgggaataggaggcccagggtttattcagaggctgtgttcatccttcgtttccctctgctattcaaagtgtgttagaattcaccttcaggcttctgacctcatgattataagatggctgccattgtttcagaataatttcttcatggcatctaaaacaagaagatgggatgccaggagcaaaagaatcttcctggtacctttttcctcctttttatcagagaagatgatttttcctcaaagcctacagaagacttgcctttatgtctcattgaccagacttgggtcacattaccactccgttatccctgccctcaaactggcaaagagaatcaagaagaccttgattggcgtagatcactcatgcttgatttcctgaggctcgtctcattgcctctctcagaaacttggggctctatttttattagctaagaagggcaatggttattgtctgccacagtgatgctcttgtgtgaagtaaaggtgcataaaatgcatgtcttccctggactttagtgcatccttggtttgtaagtgactacgattacatgaatcagaaataaatcaggaaaaggaaagttggtaattttggcctattcctgcagaaatcatagcagggaggggagtgtttgtgaacgaagggagggtccagttctctaaagctgtgctggtgaactaccactgcatagggtggccctctgctgaccctagagcaagctggaggtgagacgagtttgtcaggacatcccagattctttcttctgtactctttcctcttctctgttttccaccaatccaatcaaaggcagtgctgatgtagtcagcacaactcctgggatgcaggtgcctggggctgcaattctgttctgacactgactgtggacattctggttctgggcagccacttgaggtaacaataatgatacacagttcctgcttttaagaggttcatgatgaggagcttcactgctcccctgttgctttatgacaggatgaggattcagactaaatgaccacttccctcttttctcactctcaagttttatgatttctttcaagtttatttgggattttttttttttggtctgtgccttttgttaatatattctacatgcattttgcttctaggcatattgatattcacaaagtttaccactgacagttgtagtctgagagtgtacagaaaaaaacgtagttgaccactctatgattattctggactctgtgactctcttaatgcaagccaagaccacattagcctttttggcagtcttattactttgtggcttttgttgggtttgcagtcatccagaatttctaagaacaatatttggaaggtggctttgcagagacttgagccactgaacttctcttgtcatgtgcttcctttacttcactcctttctttaatatatgcctggcattgggcccagaatccataatacgatattcataataaataccaacatcttttgagcactccctatgtgtcgggtgttacactaagtgctttacaggtattgtttcatttaatccccacagcaactttcttcccctttttctggagacagagtctccctctgtcgcccaggctggagtgcagtggcacaatcttggctcactacaatctccacctcttgggttcaagtaattctcatgcctcagccttctgagtagctgggattacaggtgtgtgccaccatgtccagctaatttttgtgtttttagtagagacagggtttcaccatgttggccaggctggtctcaaactcctggcctcaagtgatccgcctgccttggcctccaaagtgctgggattacaggcatgagccaccacacccggcccccacatcagctttctaatctaggtgttaataattcccattttacagatgagaaaacaatatggagcaagctaagtcatttgagcaaagttatatagtagcaggtggttgaggcaggactagaatctaggcaatctagtagcacagcccaggctcttaaccttgaaatgcaccttaaggcattttataaatttgtcttactttccttaatttttcccctctcccctaccccccagtacatgcataattgctttaaatattattacttgtcctgtctttcaagctggcttaatagaacatacgacgtagagatcaaaagttacagagtactaaagccgtagaataagagtttctttattcattaattcatcctttaattcctgattgactcagttcctgaggtattacactgagcgtgtggatagagagaggaaaaagacctagcattctgcctttgaggagttcacaaagtcatatggtaaatggtgggcctgagattcttgtcccgcagcaaattctgtcattctttgtagatcatggggaaaactttgcattttgctctaagtgtgctgagttcagagtgtaacatctactttgctccgccatagcctttaaaacaggattcatctctgagcctcagcaccagtacatctctgggaatctacctggccttcttcattatgtcctgcttccctgacctacatttttttcctttttcagattgatttgttgttcaaaaggccggtgcccctggaatgaggacctacaagcttacttttatactagaaaataaaagactagaagaatcaagcctttgctcagatcatactttgtgaggtgggcaagagtagaaagccgaacacttgaacgtgagagcgaggagggagccacagatgaaggttgaggacagagaaagggaagctggagggctctaaacttgcagaggcctgacctggcacttcatctgtcgcctctgaaaacagctctgctcttgctcttgctctattctcatccaagtactaggcgatcctccttttatcacttcccagtttcttcctttagtttcctctaaggtcattcctcctttgcactggatttactttggagtaacagttgttggtgggaggttctgattctgcagagagagaaactgaggcatgggatagagaacagccatctgtactttgtcctgtaagtcattagagactggcagagccttgtcatagatcccgtggtttgctgtaagccacaggtggccctcataccctcataggaatagggaccttcttccttccttaacatgattggattttgtttttacctgaaaatacgagctacttctaacagaaggaaagacgattgcagcctgtactgcattgcccctatctgtaaccccattaagaggttgtaaatagtactataatgatatctcagtcatttgttttgatgtatccaggcttttaataaatcagccgcagcttgcttaataggaatatgagagcagagcacgttgctgccagcagctgctagtaaattataaagcattcatctgttttacaagggaattaaatgtttgttctctttaaagggttttgactaaacaagggtgtgtgcgtgtgtgtttgtgtgtgtgtgcacacacacagtggcttcctgcccatgccctcccaggtacagtagcaacctcaggttcctggggaacacctgtaaccaaagccatatgaattagagtgcccccaggtaaaccctgtcattattggtctctgctctgcgtgcatctctaaagcaatatttgttggattacatttgtcttccacgtcaaaggattctgtgaaatacaagtcccatttcccgctttctcctttttttcttaagactgtctagggaaggagctttagataaactatacatccagcacaacattcaattgtctgcacaattgagttagcctactttatttgacttttatgtttacatttgaagtggactccccccgccccccgccaccaccttttcgacacccttggttttattgactaaataatcttcagaagacaagacatcagagttggtgcttttggtggaaattaaaccacagcaggtgtttcaagaccagctttggcaacactgcaagaccctgattctacaaaaataaaaaaaattagccagttgtggtggcgtgcgcctgtagtcccagctactggggaagctgaggcaagagcatcccctgagttcaggagtttgaggctgcagtgagctatgatcatatgactgcaccccagcctgggtgaaagagcaagattgtccaaaacaaaacaacaagacgtggggtccagctaaccaatattcaagagctgttggctacttatcttgtgaccttcaacaagttatataggtttttaaaatctattactttattttttgttacttttaaatttggaaataattgcagatttataggaggttgccaaaataatatagagagatccagggtgaccttcacctagtacaatatatgtgtatagctctatgtcgttctttgacatgtgtacattatgtaaccatcactgcagtaaaagcacagaactgtttcatcatcacgaagatctccctattgcttcctttttataacaacttctaccaccttccctatcctcccctccactgtcttacctcctggcaagtactaatctgccttccatctttataaattttattcatttaaaaattatataaatgttattacacatttgtatttatataaaatataaaatatatcacataaatatgaaaatatgaaatatatacattaaatcatacagtacatggctttttgaggttgactttttaaactcactgtaatgctatccatcaaccttgttgcttgcttttatgaatgtttattctttattactacctagtagtattccatggtgtggacacatcagagtttgtttaatcattcgcttattgaggaacattttgattctttttacttttgggctattataaataaagctgctaggaacaattatttacaggtgttttgtgtggaagtaaattttcatttctgtgggataaacactcaggattgtaattgctgagttttatagtgtttggtttttaagaaatgtcagacttggctgggcgcggtggctcacacctgtaatcccagcactttgggaggccgaggcgggtggatcacctgaggtcaggagattgagaccagcctggccaacatggtgaaaccccatctctactaaaaatacaaaaataaattagccgggcgtagtggcatgcgcctgtagtcccagctactcgggaggctgaggaaggagaatagcttgaacccaggaggcagaggttgcagtgagctgagattgcaccagtgtactccagtgcaacagggtgacactctgtctcaaaaaaacaaaaacaaaaacaaaaacaaaaaaacccggaggttgcagtgagcccggatcatgctactgcactccagcctgggcaacagagcgaaactctgtctcaaaaaaaaaaaaaaaaaaaaaaaaaaaaaaaaaaaaagtcagacttttccagagtgactgtaccattgtacattcccagcagcagtgtatgagggaatcagcatccttgccaggatttggaattgttgctgttttttaatatggctgttctgataggtgtgtaatgatatctcattgtgattaatttggatttccctaatggttagtgatggcagacatttttatgtgcttatttgccatttgtatgtcctctttgatgaaatgtctgttcatgtcttttgcccattcttttggattatttgacttttactgttaagttttgaaatgttctttatgtattctagatatcagtatcttgtctgatgtatggtttgcaaatattttctcagtctggagcttggcttttcattattataacaggatgctttgcagagcaaaggtttttaattttggtgaggtcaaatttatcagcattttattttatggagtatgcttttgatgtcatgtctaagaaactcttcaccaaacccataggtcctgaagattggctcctatgtcttcatcagaagcttaagctttacattttacatttaaatgtatgacccattttaaattaagttttgtgtaagtatgaggtttaggttgaggcttatttattttttgcctatgaataatctaattgcttcaacactgtttaaaaggcatttcttctaacattgaattgcttttggatcgttgtcaaatatcagttggccatagttttgtgggactgtttctaggttctctattctgtccgttgatctgcgtgtctgtcccttcgccagtcccttactgtattgattacagtataactatttagtaagttttgaaatcatatagagtgattcctcttactgtattcttttttgttaatagtttcaggtattctagtttctttccatgtaaatttttagaacaatcttgaacgtatttacaaaaattttgcagggattttgataggaattatgatgaatacttttatttttatgttttgtagagacagtgtctcgccatgttgctcaggctggtcttaaacacctggacacaagcaatccccccaccttcgcctcccaaagtgccaggattacaggcgtaagccactgcgcctggcccatatgtgaaatctgcatatcaattttgggagatttgatatctttgctatactgaactttcccatccatgaacactatatgcctttccttttatttagatcatctttgatttctttccatcagcaatttgtagtttttagcatacaggtcctatacatcttttgttagatttgcatctaaatatttcatttttctgagacattatacataacattgtaattttgattttgcttttcctgtgttcattgttagtatattgaaatacaatttgtttttgcatgttggtcttcaactttgcagagttgacttctaggagtttttatttagattttttgggatttttgtaagcatatcatctatacgagcatgtcatctataaacagggacagttttattatttactttctgatataccttttccttttattgccttattatgctggttggagcttcagtactatgctgaatagtggtagtgagagtggacatgcttgtcttgttccaaatctgaagtgaacaagcattaggtctttccctactaaatttgatgttagttgtaggtttttgggtagttgttctttgaagctgaggaaattcctttctattcttggtttttataaatatgtattgaatgcttttttgcatcaactatgatggattatgttgattggtttttgaatattgaaccagctttgcatccctggaataaatcccatttggtcaggatgtataattctttttatatattgctaaattttgtttactaatattttgttaaggacttttgtgtttataagaggtagtatgtgattttttttttctttgctggtatttttagggtaatagtagcttcataaaaattggaaagtgtctgctttccctgttttcttttcttttttttcgagacagaatctcactctggagtgagattcagattcagattcctaggctggagtgcagcggctcaatctctgctcactgcaacctccgcctcctgggctcaagcgattctcctgcctcagcctcctgagtagctgggattacaggtgcctgccaccatgcccggctaatttttgtatttttagtagagacagggtttcaccatgttggccaggctggtcttgaactcctgacctcagatgatccatccatctcagcctcccaaagtgctgggattataggtgtgagccaccgtgcccggcccctgcttttctaatgttatcatttattgctaaaagtttaccgttagtactgcttgtgtcccctaaacttggtatgttgtaatttcattttcattcagttcaggtcattgtttaagttattttgaggcttcctgtttgacccatagattatttgccagtgtgttttttagttcccaagtttttttagattttcctgttatctttctgttatttatgtctgcttttctttcattgtggtcagagaatacactgtatatgatttcagttcttttaaatttgctaaggtttgtattatatcccaggatatggtctatgttatttgttctgaggtcatttaaaaaaaaatgtggcttatgctttgttaagtgtagtgtgctataaatgtcagttagatcctagcctgttgatggcattgttgaaatcttttacatttgctgattttctgtctagttgctctatcaattaattgttgataaaggggcattttagtctccaactaccttttgtctatttctcttttcagttctgtcagtgtttgcttcacactttacaactccatttttttgccacaaatacatttgggattactatatttgcttgattgattgacttacatatcatttttaatgtccctctctgtttctactaattttctatgttctgaagtctacttattttattcatgtaggtactcctgttttcttttgactgttttcattgtatatatttttcatatttttactttttacatatatttatcattatacttgaagtgagtttatggatagcatatagttcatgcttttttattcattcaaccaatctgtattttaattggtatatttagtcactgtacctttaatgaaattattggtgtgttagaagacccaggcagctcatcactttgaagttccttgcatcctaaggtccctagcagttctgcctgttctctctaccttcaagaatcttttaatgttcatgttatatatataacacccaggaattgttttactgtacttagcagaaatgataggaaaagtacatctgttccatctttctggaactgcttctttacttttaaaattaaaaaaaattattgatacacctataccacaatattgctgtaagtgagatgaaagtgaaaaaggattcaacatttaaattctatttggacatcagttattatatctaagtgatatatgaaatcatgttgctctagaacaatattaacagattttatgaggttcccttataggaatgaaaatttatacgtgtactctttctttctctttgacaccactctacccttttctccttctctaacatattccattaagaaattttactcaaacttatgctttgcagttggaataccctaataccgattataagtcctgaatcatttattaagtaccttgtaattgcccagcactgtgctaccaatgcctttcagtgactttctaaattcaccctgttaggtataattatcttactgtgtagctgaggaaacagaggcttagagaagtcaagtgatttgctaaggtcacttagctagggagtgttaaaactgggacttgaatacaggtcttagagtttaaagttcatgctcttaacctttatgttttacttcctccctgtattctcttgtacttcatcaacctgaattctttagagctttttgatctgttgggacctagtttgaattcttaagcattttattatttttatttgcttcaatgaaaggtaaaagatataacctagattttatccattgctagtttcttttagtgccatagtggttttatctgtcagcgtgtctgtgtgtttcttaatgttcctagcaaaatttaagatgtgatctagtaactgtattcttccaattgattcatctttagtgtcactttaattttatttttgaaaaattaacgttatcttctcatttctctgttggagtgtgattgagtgattaattcagcaattatttatagagcctactgtgtgataattattgtgcgagatgctggggatattcagtaattatgtgtttctttgttcttgtaattgttctgtgactttagttacatctttcttcagaatctttcaattcacaagtcatctgtaagatttcactcattttctatttctagagtgtagtccagaaaccatatgtgtttgtgggagtttggtttaattttggggaagatattgatacttctaaagttaggtacaccatggtctactgtttacttttcaatgcaaatagagactttattgatgaatgctttccttctcaagtacatgttttgagattggtgaaaatctacagaaaacaaataattttaccccttacgctgaatgctgggaaaagaaagggtcttgtctataaattaagagcattacctatgagcttcacaatgtacgtgatggacctagtctgtgtaaaatgaagattctagaagcagaagaaaatggcttcaaaagcaaatcagaggttatagttcatggacaagctaagtactaaaccaatcttattgttgtgaaattaacattttctgttttatctctgtggtatcacggaattttattattggacaggctaatagagatctgtttgagcagcctattcattttatagacaagaaacctgacacctgtagaggtaaaatgacttttaaggccttttgtgatttagcctccaaacttgaagacctgggcccttgttactgtatcctctggactgcattttagtaatattttatcatttcattatagtctcatacttacccaatattcttcctttacagggtttcagttttctcaactcaagagagtagataaggcacttaatgtagttcatttctagttggagtctgtaaaggtttatgaattgctttgttaatccacgtcactttgtatcttagctttctagactttaaatgttggttgtagtccgtataactgccagacttaacttataatgaatgccttcaggtaggtagatatttgtttgtgtgtgttccgtaaagaacaaacaaggggctaagaattatcaactcttgctgtgagggccccttagccaggcttccaccctctgcctcttcagtcttagggacttgtcaaccaacttctgcttcagggcctcagggatggtgggtggtggggaccttaggttggctaattttaccatggcatgacttccatttttaagagttattttcttggattgagacacagttagcttgcctgtggcttccccgcagtgattcttctgagtggatggaataaatcaagtttctctgtgtttcctgactaaatattgcaggttgtttgtgccattcctcactttttggattttagataattcactattctacatgcttcattttttttatgtttcctcaggtgagccccaacttttaactgagtactttagaaataggctgagtcccaaggggtcagtggaactttcttgttccacctagcataggcctgaaacagaggctcagtcttgggactccttccttcagcctggaaggaagaagtgagggagaaaggaagaaagtgatcaccaaggcaggcctggtgcctagaagctgagctttgagaagcatactttagtaacgcattttctgtgtcctctcctcagttaactcgtctcttgaatctttattattaaaaattaacacctgaactggtaatctcagttcctgcggtccctctctgtatttcaactttacatcagccactttttttagtattataaacaggagatcttttagacccctaggcttccagttttgattggccgtcaccttctagctccctcatctcattacagactaagctggatgcattaactagttgcatagtcttggacaagtcacttaagtattctcagccttagtttcctcagttgtgcagtgggtctcctcacacctactcacttaagaaataaatgaaataatgtgtgtgagagagttttctgaacaagaaaatattagctaaatatcatctttccttgttgtacccttgtttctacaggacacagttggatcagcggattcagtgcttttcctgggatctcttacaggttccctccatgcttgttgcccttgactgatggtatattggaacatttgtacacagtggccttgaactatagtgggcacttgaaatggcaacattttgtattcttctaggaactactgtttttctttgaaaagccaggaatttcacggctccagaggaggggatgcagaagctatttctttttattttcccctgttaaatcagtataatgagattctatgtgcatagtaatccttaagctctttgcctagttccttttgccctaggcaccttggagtgatggaattgtagtcagtcagacatgtgcagtgtattcacacatacacttagagggctcctcgtctgctccccctagctaagcagcccctttgaaatgtctaataaaatccctgctcttgtgcgctgcattgaaacaaagcaggctcacgcagtcctggaaatgagccctgagaggtattatttctatatgtcggtctttatttgcctgttttgacagtgtcgtacaatgagggtcctgctgctgatgcagcagaatcacaaggagccgtctttgctgtgtaaattctccctcaaaggtctggcattcgacctgcctgctaaaccctctttgaaacaatgcaatgacaaaatattttcttcttactgataataggcagattataattgctataattgcttctacctcattctctgaagggaggaaagtagggctatggaatgagtgcttaaaatttttatttatcgtcttagagatatagatggttcatttattatacagaagtttacatagcagcctctaagtgtacgttgtttctcaatagttggaattaaattcgtacttttggactactgtttattaagacattcccgggaggctgaggcaggagaatggtgtgaacctgggaggcggaggttgcagtgagctgggtttgtgccactgcactccagactgggtgacagagtgagactccgtctcaaaaaaaaaaaaaagacattcctccttggtgatgaataacacctgtgtgccaaaaggatttttctcattggctctgattaaggggatatccagccaataaccgtagcaagccttagggtgaatttttggcaatctccaggtctagtcattgccttatgggcagtctgatggcaccttgggcattgtcttattgccctgagcacaggtgttaggggcatggagtctgatgagccgtgctctgctgtctacccccagtctgttctccagaccccctaaccaaacttctcatagaggtgaccatcacaaggacctggtgtgtggctagatcagtgacaatttatgaccacttctggggaaatagctcagagtgcacgtccttcgtgtggtaggtccaaaatattatctttgtatgttcaaagtagcataagctttagttgctgctgttggtttcaggagaatcacctggatgtcagtgccttggggttattaataatggtaaaaaaccagtatgagggtggagcttagaagtagaccaagacttgtgagtcatgcactgctttttaatttgcaagctaaataggtgctaaaactcacctaccctggctgctgagatagtcactttctcctggtcctcctctattgtaaagagaagaggttggacttaatgcccttcaaggtcttttctctctgactttctgtgaaactccaaggtgagtcctaaattttgttttggtctataaatttaaatgcttcccctgctgagctgctttgggctgagaatagaatggatggaatttacaccttctctctctctctgtcccatgtgatgctttgattggctgctaacagaagggaaggtggtcagaaggcaaggaagccttggcaaagaggaagaggagtgaaagtactaaagaataggaacaactgggggtcagccctggaataaaaaagacttcacagggcagttactaggcttgcctcactctttggaatcatgagaggtttgctaggtatgtactgtaaggcccgtgtggccagagactgagtcttggatttactctttttgccctgacattgccttgtgtagcactggatatcatgtaggtactaattatttcttctttacttaacttcctggaaaccgctgcaattgtcaagtgaatagaagtgaataggactgttatattaaacattatagagaagggtccatgctcacagcatcttcatcattccaaatattgtgcttgttgaagcagagaaccttgtcaggacagtcattgtaccaacatttacgaaatgaaagcaagagctattaaccactgtataagatttgaggatattgtgctttcaaaggaagcaaagagggtttaaaattactccagtgggatatctctttagcctcacttaaggattgtttaaaaggaaatagaaataaagattgtttcaaaagaaaaagaaataaagttagaggtgaatagatggtatatgtaagagctttatgttttggtcatactaagtttattgttaagttacaacaaaaaaattgttaactatcatgtctccagttttgcaggataattttcttttaatgtattccaaaaactgacctcagaatttgatgaagtgttagacaagatgacaaacagagagactgttagtaacgggcagaagtcattagtctcagactcatattcatttgtttgtggttattgattctagtcactcctattcttatctccatccaaaaataggcattaaaccctaatctcttgtggatgtttgctttgtagatttaggagaataagaacatgtgaccatacctggttagccatctcaagatttgttatgagctagttgacttcaagagccagtgagctgggttgtgcaggatacttgttactggataattctacttcagatagatgctctagttgctctgctaaaatcctctgttctgtcaagcctgtcagagccagagtgaaaaaacaaaacaaacaaaaacaacaacaacaaaaccctagtagagtacctgaactctaaattacagagtttaaggactgaaaatgaccttgaggatccagagtaggactctcaaactcacatgttcctggggtagacaggtagcagagtgaatgaattggacaactataagcaatgggggagactgaagagacattcaaatttagaaaattttaaggacattatacctgcctgacaaagaggtgtttttttttgttgttgttgttttttgttttattttctgtctctgatgcttgaatcaggaggacaaagagctctgatgctgattcagctgcaattttgaggacccttgaccctaactatcaggttatctatttctggtttaaggatgatgacctgagttacaggtaggaaaaggcatttaaccaaggagagacagctagtgagggctggagcctggggctctgaggtgtagtctgaggttctttctctacaccatggtgatatctgaaggggaaggcaggaacacctggatttcaatcagggatttaaaaaaaactttctatttttttagagaggtataattaacatacaatcaaatgtactcatcttaagggataacttgatatattcttatgtgtgtgtcctttcatgtcaccaccacccagatcatcccaagattctccttgtgctcttttccaacatcccccacacccctgcaccggaatcacaatttaccagggaaccatggcacttttccttccacttgcagagctggtccgtctgtcactggcccagttcctcccctcacctccctctcctcagattcaattgtaaagagctatagcaaacacaagggcacatgttgcttaatttttttttcccacataacccaacagaatcttgggtttctttaaagtaagctctctaattatgccaatgccattgactcaccaagtaggatgccaggtcccacagggtgtgtccttcacagggttctgagggtactgcttcttgcaatgtcaactgctttatacaaaagcatatttaaggtcacatgatatttgccaagttattaattattcggaggctacttttcctctgaaagaacttcagatgtccgatgtcatgattttattaaatcaaagacccatatttcattgtaatggacatggcactcaaaacctgggaatcgactcattgaaaatgtagccaacacaacactgaaaacaaagcccacctcacaggcaatgcagcttccttaaaaaaaatagctgattcccaggctgaagctgttaagcagatttttatgcagggcttcaagttactaaaaaagcaggattcaatatgcctttctctttgatttgtaggagggggtgggaagtaatgctgctgctctccccttacccccttcagaagggcttttaccatattctgaaagcaatgcttgaaggacccataaatggattttggctgtctcctagtgcagggattaacatagaattatagaagtgtgctgcatggtggttgggaaaatagggaggatgccattctctttttggagggacatggtgctcccgtctcttgcctgtggatgttccctataaagcagcctgtcactgtgaaaaatgcacacactgtaccatctcacagttataaaggttaagtaagcatcttgagcagtgccccactgcttttgtactttccataatgtcagccgataaaggattattgaaaaaggcttgcaaggagataaaaggcttgcaggttgaggttaaacaattgaaattttctgttcccagtgtagtaaattaccaatggcagatttaacgtttgttaattattagagcaaagtactaaggattgttttcttttgcctaattaattacctcatctggagtggaatgttaattcagataaatgattatttcttaatacctctgaagctttccttggaatctcctagaattgccagtcctgaagtgtggtttcctcacattctggggaagataggggataggtgaccaacgtgactactctcttggcctttttcccgtctcagaagatggcaggataacttgtttagacttttggtgatggagttggtttgctgttctagttagtagaacatgagtgtgcttcctggaatcctgtgcctcataaccaagtttttgagttagtctctcgtgtggttttgaatttaacattgaacattctttttacctttggtaattctcaatttggggcacctgccgtgaacattaaagatggtatcctttggaaaggacactctagtttcttaacttgctttttacctttaagttattttacctcctgatgtctgttcagaatgctagaggcaggtttttattctttcttggatctaaactatatcacctctaatagttgtgaatagataatattcaaaaaaggtaaaatcatgactcatgcagatataaaatatccacatgtcaaaaattttacttattttaaatgagggaaccagatagatgttacaacaggtaccaaggagaaatgaaagaaccacaaatttatatggaataaaggaaatgaaaacgaacccacaaatgaacacaaaacttttgggggagggttgttcctctaggggacagaatgtatttgcatagctatagacacttttcagagttgtaaaatcgcccagtcagacacaaaggtaagtgtccctgtaggatgagaccattttctgaaaggagggccattaatctcttttgcttttttttagggtcagaaacttccccttagacagttgtgtatgaggttttaatccagttacttaggatgacattgtatcttcaaagtagattagagatgaattatgtgacttatttttctttttagaaggaagcttaaaggtgacttggggagatgggctggtagatctgggccattggaggcgagctacaacccatgtgaccagttaccctgcacagtctctactcctgataaggcacttattttatgagcacttttcataatgatatgaaaaggcagcgggattctgtctaagattatctggagtgaaagctggaggctgatattaaatggatagtcctgttttcttttggtgctgccaagctgagctgtttaaaatgatgcttggaaaaatgcctcctgagccaggaagttgtctgattagtgaagagatttccgagacgtttggctcagagactaccccatcataccacacatgttcttttccacattcacctgagtcttccaaagatacgaggactcggggtggtgatagggtgtacattcttacatacacatatgtgtatatttgtatatacagtctgtctatccatgggttctgtattagttgattcagctaaccatgcatggaaagtatttgaagaagaaaaaaaggatgtttgattctgtactgaacatgtacagacttttgtccttctcattattccctaaacaatatagtataacaaccatttacataccatttaaattatattaggtattatgtaagtaatgtacagatgatttaaaacatatgggaggatgtgagtaggttatatgcaaattttacaaagggacttgagcattcgtggattttaggatcttgggggatgctggaaccaatcccccacagatacagcgggacaactgtattcatataaatatataggccagagattggctttaggggagtctgcaaagttccataattatatgcatttttcttaggcagtattgtgtctgtcagattctcatagtctccaaaagttttatgattcttcaaaagtttaagaactgcttacagaaaccatgcccccagtaattattctgaatctatgtgttaccacgtgtatgacttagaagaagtctagatgaaggttccacctaattacagaatccactgctgtagccacagctggattgagttatgtggcagccctgccccagagctggggaggctgcgtgtgtgcccctccacacctgagtacatcctgggtgtgctgaaatgaagcccagggagatacaaagcaccataatgccattaaggccagcacccgttgggtaggggagaggctgaccatacagacttctgacttctgcgtttcattccctgctctgaaacctgtccgtctctcaggcttgcaatctgccttcctgtctctctgacagacctgtgacttgggctatggttctgataccaggaaataatgcaggggtgggagtcttagtcccaagcaaaataaatcactgctcccattagacattacaatgtttaaacccaagtacatctgtctgccttcaaaaccaagatttagagcatgtcaagcaggtgccatgcctccaataacacatactttgttccaacatttagtagattactgtgagattttaaattcaaattctcagacattcactttgtttaggaaataactgcaataaagcaaattgtctcctgttctttttttccccctacggtgcagccaagtgagagcaaatcaattcctagtcaattttttgttgctgttttcctccatgctagagaagagatgatgcagctctctcctgttgcagccctgtgctgggtgtggttccctctccttaatttgtcatctgaaagcaattttgttcaattagagattagaattaaatttcagttgtagggcttctgtgcagaggaaatgatgcattaatgaacacacagatgtcatcttgcagccatgatgcttgcagaacagtttcttcaggattcaaataataaaaggggccacagcagcaggagcattgtttactggttggcatactaagtggaggctcacatttatttgcaaaccatttatcattctgtatactgagagggagaacatactttatttaaaatatttgaaataatgactcttaaaatcggataacagaagcattaatgccaggtgccatgcagtaaattgcataatgctgttgggttggcactgacactgtgatttgtgttgctaatgatctatccaaatagatgggagttgagaataaaaagagaatattcctggaaagagacaaggcaactagtgaattaaaagtgtagtgagaaagggaaaaaatgtgtaggatcgtattttacttattggaagacccatctgctcttctgtacacacattatgtaagtttcactctctgtattacaaataacctgcagggtggataggaagttcatatatctgccttcagctgtttttttcactcacagacgtgaatgaacagaaagatttatgtcttgtgtgttggatattataggatggtaggttttttttttttttttaagggcgttgtgtatttagactgtgatattctgtgcactgctttgcttgaagtgagtgatggctgcgactaagaaggcagcaagtggggagtgggagtttggggaggtggaaaagggtttctgtgagacaatattggtttgtctggtctttgggcctgggctacacacatgccctttgacacttatggttaaagtgtttatttccgaatggtgcccagagctatgttcagtgtgtcctgagtcactgttgaatttttaaaatttggtagtctctgtgctgtccagaatttcttagatgtgttttgaatacagagggctctcagtatcaggtggcatccacgctggtcattgatgttgacagggatgaaatctcacttaaaaccctctaatttcctagttcaaggactcttccttattcctcttcccctgttgcaaaaggaccctctgatgttggttaagggttaatagttctgtccttgaaatgttttctttctgcgacatcacatttttcttttgctttatccatatcttgtgccaaggccattctctttcattctcatttcctttttaacccctgtgtgtactgcatcaagtcctattttgctgtctcttcgaatttagagacatcatcagtgcatatcatccattatacaaaaaagccagtaatagcccaatttttatttcctgtccaaatttttctcctcaacttcatatccatatctctcttccagaaattttattagaagcacaatgtatctaggataaaatgtaccctctccctaactcttccttaccttttataatggtgcttacgttttccatgtcttcctacttaaaattgtattcatgtttgtagtcttctccctgacttcactgctcatgagttctacctttttcttgtctgttataagtcctttccttttcatttcttttgctacctgccttgtccagatcttccttacacatcacctgcaagtagctgatcatcctcttaactgatctggtagttaatggtgtcttttgctcccaagcctgcctagtcctctgctcatctacttatttctgcctactactccaaagccttcattggctccccattgcccaaaaatgaattccaaacctcccagtcctggtgattaagtagttccctcccatacccaaacaacccagccctgtcttttactaacttttccttataggtgtgtgttttgttctccctgttctcccctgtatgcctttcaaaaccctgtccttgctaaagcccagcttggatgccttttcttggaaaccttccatgattgcccccctggagtgtactttgttgctctaggtataaatgactactgcacttatgttaaggcacctgtcacatactgtaggtatttaaggacctcctctctctgctggatgatcatcattttgatagcatattccttttgttttcaacagagctttttctattaattttaaatgcaatatactgttgcaagtagtagttggaaaaaatcacagagcaagcaaagttctggaatacaatttttaggtcttcctcaacattcctgtcacagtagatgatgtacacttacagcagaagacgatggttagaaaggtaagagcctagggtctgagtcagcttcaactagaatgtgagaactgagatagaaggaattatttccaccttcccggggattttctagcatagcctatgggttgtggtttgcccagcaacaccttaatctagttgcttatgtttagtaagcatttacagcctgggttagccggctggggttcaagactcttggcctttaggccagtgcttgatgcttctgtcagcctggaaaaaggacccatgtatcactcagtggttctttagccaacttgagcaagtaaagaagtctaggaggcagaggtcttctgccagcttcagcctttaggattgttagggtgatgtggggcctgctctggtgtgtctcgtaaagaggatgaaggagcagtgagaattgtgtagactagcagtatcctttcatctgctttgttgtgagccagcttaggtggtcttttctctgctattaaaggggaattctgactccttgagttgatgagatggagtttgggaggcagataggccttgaggacttggtgggagtttgtaatctgggcggcctggctgaattcatcacaagggtggatttttaaattgccttttttgctcacctactcaaattgagtcactgagcagtatacttgtagatgctttaacaagtagattatattgaatcacatttaataggaagatgactaacacaagggagttgttttatgttttaaaaactgctcacgttcctgaactgcagaagcacctgttctgttactttttaaaatatggtcgtgaatatttttccctttttggtttccccagggcagtgatgttctggttctgaggtctagtacagcatttcctttttggccttttgtccttgcttaaattctcttccaattcttcccttccaatccactgacccaggattagagtactaaaacctcacttgtttttccttatttttgttcatctaacttaagagtgcgtggcaaaaatcttcctttgtttttaactaagctcgttaccttcaccctggtttcataatgtgtcaccctccctctctccccctattttttcctcctaaattaaaccaacaggagtcatttgaaataggcgcagtgccagaattagcaaataaaaatacaggacacatagataaatttgaatctagataaacaaataattattttttagtataagtatgtctcatgcaatatttgagaatacttactctaaaaaatcatataggaaattcagatttagctgggcatcctgtattttatctagtaaccctacataggcatatatttgaaataaaaataaaattttacattaaagaaaacattataaagaagaaaaatttaagtttattgtgtgttaaatattcccaatgctttccttactgaaaaatgtaagactgtggacaaattatgaaacagtttgtgcataagatttataagttagctacctaatgaaaagcttctgttggctattggaatcagccatttatcctaggattcagctttatctctttgctaagaagatgctcctgattttgaggtgagaatatttagtgcaagcggtagaccattgttacatatgatatatcacaagcacctgtgtcaaaaacaaatgttgaagtattcaacaattttttcctcatttaaattgtgcccagctctcttagctcaatttcttctggcataaagattcttaacacaaacaattggatgatgaagacagtaaattcttgattgagcgaagtttttatccaagactagcttccctctgtcacccaggttatatgtggagtacaaactaattatgaagctaaatcttcctcagaccacataagtaagtctactccaaagcttaataaaatgattctgcaatatttgttccatgctttgctttttaccaagcctgtgcatacgttctgatttgattctcctgacagtctatgagagaacagtgatgatttgtctcctcattttataagagataaatttgaaattttgataggtgaaatggcttgcttaagatcaagcaagacttaaatcttgatcttaggccttttgggccattgctctttccactacctgtattgacttttgaatgtaagtgatttgggaattaggcagtttaggagtaattgtaccagtgttcccctctgctagcttggaagatgaagagctgttttcatacctgtgcattgtgctggaagaggtatttgcctttggttcagtgcatacctataatacacattgggtcttcttttgaggaacagctgcctcccctgtacaaacagcctttctgaatgaaggggatcagccaccgttgacctgtgagtttgaagtattgcactgttaatgtttgggcaggatttttttgaacatgtggttgtaccacagagttacgcaagcgaaatattcttggaaatgacattctgcacaaccgtagggagaaatattgggaagctggcaagagagtcaattctatcagtgtttattgagcacctataatgtgcattttgtgaatactggatgatgtggatgagaaaagatgtaagtcctactcaggagcccttcctgccacagtaccttcattagcatctcctgcctatcagtgcttgaaattcctggctcatttttgatatattttatttctgatttgaggcatcgtgtcctttattttgataaaatattatctaaatattttatatcacataaattattaaaataaaatattattttttgtttgttatgtatagtcccctaacaaagtttgaactttttgaggtcaaggatcatatatatatatatatacacacacacactcatgtacagaagaagttcttgaaaaatattggataagcaaataaatttgtggtattcttggggaatcttggattaataaatggatagcatccctcggttgttgtatacctatattcaaaggatccatgactcaatgatggggtaaggaggctaaaagaggcaaagtcaatgactgaattgaacatggcatatcatctcaaattatactgggaaacaacattattgtctacttgttaaccaaatatatgcagttgatatcattcaggccttgcacaagttccttagtgtataatcttggtccttagaatgaagtgagcagcaggtacatattcagagactcatagtttgatggcatgggaactgtatctttggagatataatagaaaaaactgtgccttatctgattaaaaatgatttcctaaaaagtacttggataattcctaattgtcccagttttcataaatgatttggaaaatgctgtttgagactgtgattgttaatatactgtggaagcctattaacttctttttagaattcaaaagcctttaatatatggggcaagagaacatggattgacaaatggataagagtaactaactttattgtaaatcactgttgatatttggtccctgcctttgttcttttgttttactttctttcctcataggactcattaccttttaacatattagtaagaccgggggaatttgttcacttttttccttgatgtataacaaatcatattgcttaagttaaagctaaagtagatatttaggttaaaaattatgtagatatttaagttaaaaatgtgaattgacttaaggaataatattaagagaacaatgtagcaaaaattgtcatatatatacatatctgtgcgtatgtgtgtgtaatatatatatatatatatgtattcacgttatatacagacatacacacagacatatgtaagtaccagggatgaaacaaaaaaaaaaaataaaacaacatgtgttaagtactgtgttagtactaaagatgacagaaaaaagtacaaccctagatccttggccagagatgcttacttgtcttacacttcttacagtcccctctttactacacgacaggttaacttaatcaggacagactgtataagttacagggcccagtgcagaatgaaagcatggagcctgttgtatagaaagtaggacaaaggtgccattaaaggtggtaaaatataaaatatttttcttctaggggatctctctcaactttttatggtgttttaaattagctgtttaatgttgctttaagtgaggaaaaattcaaattttaaattgctagcatgaattttaccattcatggttctgttgtgcaatgccagttttaaatgcagatatgagagcattcaacttgtatgtagaatcactgaatttatacagtttatgttatgcctcataggcacataatgtattttgtttttaccgcacagtggaaacactgcatgaaatgaactcagaggtttttatttcacttgttgatatgcacacatttaaccaacactctctaccttcagattacaatgagtaaggaaggactgaaagggactgtctttccctttcctcctgtgtcattttcagtgtgattggctaatacagggaagtaatatgtgtaagaaaaggtatgttaggatttcttgccattcatgtttgttttagaacactatttccagctttctgcctttaaattgaagttttgatttgaagggaaagtataggctcccaaggttgtctgtctttcctctggcttcgtcgtaaccataacacacttatagggtagtcccccctttatccatggggaatacattccaagacccctagtggatgccggaaaccacagatagtactggcccctgtatatactatgctttttcctatacgtacgtggctgtgataagtttaattagggacagtaagagagctaacaacaataacagagatttaacaacaataactaaaacaacagttattaaccacagtactaaaagctatgtgaatgtggtctctctctcaaaatatcttactgtactctactcaccctttttgtgatctgttgatctgataactgatctgagacggctactaagtgactaatggatgagtagcatctatagcgtggacatgctggacaaagggatgattcatgtttgggtgagacagagcaggacagcacagggcctcatgctattcataatgcctcaaaatttaaaactatgagttgcttatttctggaatttttcatttaatattttcagattgtagttgactatgggtgactgaaattgtgaaactggagataagggggactgctgtactctgatttttactgaactgtcacatattgcaggctcactggagttctatgttactgggacatacaaacactatgtgaatggggcagccaggaattcgctcgcgcctgttgcgtgtattttttctactcatggacatgttccactgtgttatccgacttaacttacaaaacaaagttcaaagataagattatagagcattaaaccaagtgccgagcccttctgagtgcagggccctgagcgattgcacaggtcacacacccatgaagctggctctgaccttaatagataaggaagcacagcagagacataagctgggcctgatgccctgtgttttcacactgaggaaagcatgaattatctcttacgttccttgtttgaaactcaggcttcaaaagtaggaaaggttagaacatcaatccattgtgcctttccaccttttatctgtaacttgctgaaatgttttcttcctcctcctccttttcttgtcatgttggatatgtccttaatatatcagtgtcaagtgttgtgtctgaatgtgaacctgaattctattctaagtgctgaaattaaaacagtgtttctctgtttagtttctaatgtattcggggtactagagtatctaaaacagcattttaagaggctttaacattttttgcctttttttctcccgaattatacaagtcatttttctttttctgatttgttgtctcctgagaaagtaggcctccctttttttttcttgcatgtggcagattagtatcctgtggtccattgcaaccactacagtggttggtaggaagtagaacttgtagaaggtgcagttaaaactactattaaagtagcagggaaccttctttgccctctcagatgaggaccaggaagttgactttcacatttgaggtggcacttgatgtagcctatattcttttttttttttttttttttttttttgagacagagtctcactttgtcaccctggctggagtgcagtggtgtgatcttagctcactgcaaccttagcctgccaggttcaagcgattctcctgcctcagcctcccgagtagctgggattacaggcacgcaccatcacacccagataatttttgtatttttagtagagacagggttttaccatgttggccaggctggtctcgaactcctgacctcagctgatccgcccgcctcagcctcccagagatatagtctatattctaaagagactctcttctaatcaagtggttatcatctgctaatactttgaggaaaaaagattaatgttccaggatttataagttcagagaactagcttaacagagtgcagtgcttcacagatctgtctggctgtggaatcagattgactttaggttgctgtggtagctctgcagcataggagctgggaaatttagtaaccttacttggtggttctcagcccttattggtatggttaaggaactttgaataaacacctgtagagatttgaatttagttgccgttgggtggggctcaggctttttttttttttttttgcatcccagagttagcagtcagggttgagaacactagcttatctcagaacatcaatattctcatttataagatgagagaattagactgtatgagatcgtcgtgagatctaggcagatgaacacagcacttggccagtcaatgtgagtgactgttatcgttaaccacccttactgattctttgctgagattggaagctagattggcattcatttcttaagctggaaacctgtgctgatttgttagaaatgctgcaaggaacagaaatgattatctatcctaagggaatgactcagatcttgttagaataccatgcccaacttctcacctcccagaagagtgtgtcacagaatagctggaattacacctactttatgtatgaagattatccctggaatagatacatctttgaggaagaagttgatttattcatttgtgtaatgtttattgatacttaatacctatcagcacttctagactgtggcctggaggaatccatagattggtaattggttggaaaagtgaatgtaaattataacacagaagaacaagtgttttgttaaggataatggaaactttaaagctaagtagaagatagccaagctgagaggcctgggtgggctagggaagaaggttattactggcagaggaagttgcagttttaaagagacttagaggctggacacagtgggctcatgcctgtaatctcagcaatttgggagaccagggcaggaggatcacatgagcccaggagtttaagagcagccttggcaacatagtgagaccgtgtgtcaaaaaaaaagaacaagagacgtgaagacacacttggcatgactgggaaacttaaagtagtttagcatgtctggagtatacttactccagaggtgggagtccagaagatggtgataagaaagaggttagaaccataagcagggtcccagtcatggaaggctttatttggagattgaaattgattattggatagccattgaacattgtaagcaaggaagtggcatgcttaaacttgcactttggagatgtcacaatcctacaacaggctgaaaggctggagacatggaggccacttgggatgttgttaatggaagtccagatgaggaggtctgaattaaggtagtagcagtgtagtcacagtgaggtggacaacagatggcggagattaagaaggtggaatttgtaggtgtcagccccaggcattgcatctattttttttttccaagttgtggagacggagtttatctctgtcacccaggctggagtgcagtgacgcgatctcggcttactgcaacctttgcctccctggttcaagagattctcatgcctcagcctcccaagtacctgggatcataggcatgcaccaccatgcccagctatttttgtttgtttgttttgtatttttagtacagacggggtttcaccatgtcggccaggctggtcgcgaactcttgacctcaggtgtgagccattacgtccagttgcattgcatctgtttgatgttgggtatctaggatgtacatctgtcaactcgtgatgcctccctgaaccttcgatgattatctattgactataatctacccccaaccctttttttttttccattttcatctttcactgaattcctctgtggatccattgatcacgctttgcatatttattccttctcccccaaccccattcttcctggatgagctttttgctctcttttaaaccattgcacttgactgtctaggcatttgccagtatatcaaataagtatgtatttgaaagtctaggtgagcctttcttaaatactggatgctcagtctaaggtatccattgtgtttatggaattactttctctcctgtgtatctaaatggtactagtttgatacttttctgaagataattgagaaaaagtaactttgatctttttttcttctgtggttcagaagagaaattatttgtttcttgctcctatctgagccagattgcaaatttagtgctaagatttctggcattaagaggattattattattattgttaaattgattgtctcattagattaccaacatgaggctcatgggacttaaaagatttatgcccatatcctggttccatttttgtgtagagcctgtgggatgaaaatggctcacaggtctgtttgtgacacaagtagcttgatagatggcctatggttcatgtgtagaaaatgttggcgactatagatttattttagtatcattttaggaagcacaaaagtggtgtcccaattgaaccttatggagagagcatcattactttccatcacaggttcagactttgggaccccagggctctggaaatggaactctttgaagaggtcagagcctctatgcaccctctcagtcaactcaactgcatgtagaggagggaaagaatgttgttattattcttaatattcttatagtagcgtctaatagtacattagtaaatagttattcacaaatggttgttcctattgcttagcaatttctgatttcagatttgtgttttggatatatgtgcatactgaccttctgccttttaataaatctagaattcatttgatagtacaaattaacaaaaccagttgtaataaaaatattgaattttaactttaaaaaatatgcagtgtggccaggtgtggtggctcatatctgtaatcccagcactttgggaggccgaggtgggcagttcacgcggtcaggagatcgagaccatcctaacgaacacggtgaaaccccgtctctactaaaaatacaaaaaaattagctgggtgtggtggcgtgcgcctgtacctcgggaggcagaggttgcagtgagctgagactgtgccgctgcactccagcctgggtgatggagcgagactctgtctcaaaaaaaaaaaaaaaaaaaaaaaaatatatatatatatatatatatatatatatatatgtatatataatatgtattatatatacataatgtattttatatttatatatattttgagatatatataaaatacattatatatatacataaaatattttgtgtatatatatatatatatatatatatatatatatatatatatatatatatatatatatatattttcagtgttcatataacaaatttcttttgagagctaccaaggaccagacttggtgctgtgggatatttgataggtgtgagacagtcttttcctcagagggtttgtatcctaggagtagggataatgataactgcataagccacctgattgatctggaattggatgcaacttttactacaggaattgacataaggatttagacccttttccagtacattgacctagtagtattaacaggactgtggcaactttgaacttccctaatgagaaaaacatgtgttggtgagcaggtattatcacatcttcccttgcttttctgtttaaatacagtatcctattcagataggcaaatctctgatgttttgttgagtgaagtctatgggccagatcacataatagatgatgtgtttgttggttgcccactgattagcttgggacttgttacctagaggtccatggcccttctgaagtcttcattatgttgttagtttcccaaaatgatccgctgacacttgttctaaatatggtttattttttgcagcttaatgatttacttatttgccaaatactgggatttggtttcagagagcatccttttctacctccttgggtatataggccttgatttataatgtctagttactctgtcaatgaatcagttagtgaccattttgagtgttaagagctttgagtaaagaagtgtgtgaaaagccttctgccaccaggaagcttgcttccctgtgcctagtctaaaccaaaagtcttcaaacttttttgattgtgaaccccagttggacaaatcacttagagtaagcacctcattttaaagttttatatttatactactgtactaatatatagatcagaaacataccgaattagaaagtaataaagaatgagatgcatatttatttatttacttaaacttttattttagattcaagggatacacatgcaggggtgttacctgagtatactgggtgatgctgaggcttggggtatgaatgaccccgtcacccaggtactaagcatagtacctggcagtttttcaactcttgcctcctccctcccacttctgatagtccccagtgtcttttgttgccgtctttatttctatgagtacctagtgtttagttcccacttacgggtgagaacatgcagtatttggttttcctgttactgtggtaattcgcttaggagaaaaacacatttaaatagacattataatgcagtcttacccctcagtggaacatcctacagaccactggtgtagacagaaagtgctagaggggtgcttgggagagagaaatcatccctgaggcacgtagtgaagaatgagttgtgtgcaggacatcaccagagtcatggcaggccgtggagaagatatagttggtaccatcttttggtgtaagcagcagggagccatggatcttcctaggaggagccacaaggtagaagtggccatgccatagatgcctgcatagcatagtgggctggggtagacggtggggggcatgtgtgtaaagagagaatgtgagggagacaggttggtatcctaatcctaatcccacagcagaatagaaaggcaaagaggatggtggtggcaggtagggtgaggaggtagtgaatatgtggacatttcctgcatgaccagaactgctaaggaggaagtgagtcttgaagtctgctggacaaacaatggtttgtagtaggagaaccctaaggtggagggagcggggaggggaaggactggccacatcccaaaaccttattatgtccaattttactgcagctgttttatgactgcaacatttttgttcaggaaatcgtttatttacccccacaccttttcttttagactaaatgacaagaaccagtgctcacatccagggtcaaagctaatctttgaggaggtggaaaacgcctccttgtttcattgtctctcttgaaagtggtgtctccctttcactctcctgcaggagagagatgtccaggtactgcctaagcagccccagtgaaaacggatggttcttgaggcttccagaggtcaatctggcataagaagtaaagaagaagccacatgactcggagaggcagaatttctttccttggacaggatagagcttttaattgaatccaaatcacatctctcatcctgtgaatgctggagagcagtacatttttaactaggaagagcatcaattatgtattagccacgatactaatttaccctgagtgtgtgtcttagagctggctttcatctctgcatagccactgatgtaatgccattgtgtttctatactcaaccagtcgctcttaagatagggtgtcctgctattgaaaagagtagaaagtagggattgctattgctgaggctctttctgtgttcttacagctgagggccctttgggataccaccttagggtgggagagctgttcactcaccgttgtgctttgagatgcagactggggcttgtccttttactctgatgctgctgctttatcagttatttggtattattgtgttccaggataaatctctggaaccctcagttatagatatttgagactttctgtgtgtgtgtgtgtgtgtgtgtgtgtgtgtgtgtgtttgagacagggtcttgctctgtcgcccaggctggagtgcggtggcacgatctcagctcactgcagcttccctccatcctgggctcaagtcatcctcccacttcatcatcccaagtagctgggactacaggcatgtgccaccatgcccggctattttttttttcttttttttttgtagagacgggattttgccatgttgcccaggctgatcctgacctcctgggctcaagtcatccactcacctcagcctcccaaagtggtgggattgcaggcgcgagccactgtgcccagcctgagattttgaacatttgcctccagaaaatgtaggcagtttctgtggctgcttatttcctcgccagtaatatattttgcttgttcctagagtactaaatgtaatgatgaccaaagtggactgagcatttcctagatcttgacactcttctaagcacattatatatattaacttattaaattctcacaaaaatcctatgaggtaaatactattatcatccctatgttacagatgaggaaaatgttaaataacttacctagtgagtgtagcataggctctggtgtaaaaagctgattcaaacacctgccttgccactgtgaatcacggccctcagtcctttcctgtgaaaaattgatttttattttttttgagacaaggtcttaccctgtcactcaggctggagtgcagtggtgtgatcataggttgctgcagccttgacttcccaggcttagacaattctaccatgtcagcatcctgagtaccttttaattttttagagagatgggatttccctatgttgcccagtgtattagtccattcttgcactgctacaaagaactaactgagactgggtaacttataaagaaaagaggtttaattgtctcatggttctgcaggctgtacaagaagcatggttggggaggcttcaggaaatcttcattcatggtggaaggtgaaggggaagcaggcacatcttacgtggcctgggcaggaggaagaaagtgggggtgggggtgccacacacttttaaacaactagatctcgtgagagctcactcagtatcatgagaacagcaagggggaaatccgtccccatcatccagtcacctctcaccaggccttacttccaatactggggattacaattcaacatgagattttgatggggacacaaagccaaaccatatcacccagctgggaaaatggattgttaatagtacctgcatacagaattgtggtgggcatgtgattttggcaggtgataagctcttcattagcattcactaccacagtgaacaccaccatcctcctcctcatcatcataattatctatccagaggatcatgtgagatgcttcaaacccctgactaaggcaatctcaaaggataatttgcctcaggtgtcagaattgtttagctgtacttgcctttccttgcaaatataatggcagaaaaagaggaaaatttagacattttgagccttttcgaagcgggaaatcaggtaagatattttcagatagataatttgttttctccttgtgctcttatcacttccttcctctttctctcccacctctgagaaccctggatgagggtagatgaagtagaggagagggtggtgacaatggtggtaaaagaaaaagtaaccaccaaacatgtacagaaccactccagcatttaattaaagcctgcagccctttgtcagccagaagctcctctcatggtgagagaggcagagagccttgtcactgtctctagaattatttgtataattcagcagctgtttccctcagatgcctaccacacgaggttggattataaagacgtatgagtagaatcgccaaggttcagacacttgtgttcactgttgagctgagagccacttaggctgttcttgtacaaatgcattagattatggttaagcagcttatggacataaaaacacattagaactttacagcactctataaattatagtttttgcagcattcacagccacaatgctaggtaattacattcattaatctactagtaagagcacataaagttgcctcccaaaccttactgtatgtgtcagtactcagctgggaaggagagtttttttcctctcctttttccccgtctttccctgttccattaagccttgtgtgggaagatttttgatgttacattgaggtgttccctaaaagaatccaataaacccattttttttttttaatggttaggctctggcaggaggccttgtaggtaatattttcatgttgagctgcacctagtaactatttttgtatgcatttattttctttttggaaatggacagatgtctcatttggaaagccagcaagttaaagcagttgaaaagagattaatgatagaatcagtggtaaatgctttttcaggacttctttttgcctctctctggtagcagttaacatgatggtccttttaattttggatctatcaggagtacaaagtattgctctcttcccatgccaaactttcctaaagtttccatctttccatatggtgataggaaatgcctccccccacagccctgtctcagaactttctcttatttgcatgtctcataaattacagaaggcagatttaggaagaaatgctggaactttatatggtgctagtatttcaaggagcaaattgtactttcttcgcattatttctcaggttaaatagaccaagtggaccaggcgtggtggctcacacctgtaatcccaacactttgggaggccgaggtgggtggatcacatgaggtcaggaatttgagaccagcctgccaacatggtgaaacctcatctctactaaaaatacaaaattagctgggagtggtggtgcacgcctgtaaccccagctactcaggaggctgaggcaggagaatcgcttgaaactgggagacggaagttgtagtgagctgaaatcaggccactgcactccagcctgggcaacaagagcgaaactctgtctcaaaaaaaaaaaaaaaaaaaaaaaaaaagaccaagtgataggctgggcgtgctggctcatgcctgtaatcccagcactttgggaggctgaggtgaaagaattgattgcttgctcaggagtttgagaccagcctgggcaacataatgagaccccatctcaatgtaataaataagtaaataatttttttaaaaagtgaaaagaaaaaataggccaagtaatacagccatcttaaaaataaaaacaaaaatggaatagagaagtatgttaacctgcaaccccaaggcaacactataagtcctgggtcatgctcagaccacattctaggcttctgctttcagttctgttcacatgaatgagaacatgaatgctagagccacgcaggtctgtgttgagtcctggtattgtcttttcatagctatgtgaccttgggaatattaattaatagtaataaaaataattaatttggactgaactcctaatacatcctaggcattacattaactaatttaatcctaatagctgcttcataagttaggtgatattattcgctccattttatatatgagaaaactgaagcttcacagggtattgtagtaattaaatgaggtattataaataaaatatccagtatgttgcttggcacattcaatgacactcattaaacacaatcttgaggatatatggagaatagatcccaccattgttcctccaatgccaaatgtaaccttttagaatgacagtttccctttttaatgacttaccagtcattaattgtatcagtcaggaagaggaattcctcacatttatttgtaatttatttactgcctgtaccaggaagtatcccaagcactttccacaaatttcattaaactttctattcctgtattccaggagaagaaatggaggctcataagggccaaggcatttgttcatgttcgtaaagccagaaggtgggaaagccagttctcggactcagatgtaaccgccaccaataaagagtagggatagcagtgaagtggtctattttcctggaatgaagcttctatggtgggaagtaatctaagcaactgattaaggagccagctttgtgcacttcaaagcagcctcagcttcggggtggagcatagagttccttttttttttttttttctttagcaggcaggaagatattcttattcccaaagaactgagaaatatttgagactatccatagtactcattggtgctgtaaggttagataactgctgagaagaaaactgattgctctgtgtaaatcagtatgctgatgagggaatgataaaactgcagggtagtaccagcgtcagcatcttgtttccaacccagctcttctctctcttgacaaaacagctgtcattttggattaatgttgaaatcaccagaatctgctggtcatcagagcagggccgatgccatctttgggatgaagtgtgctggcaacaagatagaaactggacatgggaaaaaggaaagtctccctcaaacatgctgccatccaaggcccagtttaaaccacaggctcaatttttgctcccaaactgatttcccgactaacccatctgctcatgcacacaccctcccaacctcacacagcaggcctggcctttatcatttcaggtcctgcagagctgttctctctcactgtggtactgatgccagttttaacagccgccatgtgtattgactcctctaccgattacaaatatatacgcgtttgccagtttgtttagtgagtggttttcataggctgtgatggggatttcactttcatgaatataatttgctgagcctgtggtgacatcaataaatccttctgggatggggaatggttgatttccctacatccagatgacatcctccagcccacttccttatgggaccaacagccaatgtcataacacatgcttctttgtgagagcatggaaggaaattgtttaaagtgtgtcatctgtgggcacagtttctaaggtagatacctgtgaggatgtataggcatgctttagacatggacagaatgagttatgtacttagtaactcaaaactctgctgagctcattgtggacagctcttacagataaactaaaatgcagcttcttaaaaaatgagaggacatttgcagaaagcattcttactgctttcagcaaatctatgtgccttatgtttttatatagcagtcattttctcaaatcagacatccctattgcctattagataaacacagaaagcatagattatgagtttaaaagtatcgacagcatttcaagtgctatcagagaacatttaattcagtttaattttgtgataaatctcacgtttaatcctctggttaccctgtaatcatgtctctattgatcttttctgaatgactgcctgcagtttaataaactttgccattaacccagagcttctaaaaggagagattgattccattatcaaatctgatagaaccaataagtacctaaacatcactaaatctatctataggaagctttggcctagagacaagcctgtggcttgtttaagaaactaggtaaaaatctggatatctttgcatgacctaattgcctcacagcatctgattcccttgtgcaaactgacactgcctttcatctttcaagtcaatgtagtagccaactgaaaggacagtctcttttcttgcctcaaccgtaattgtagggtctaatttattctcactgcagatatagcttgaggagtttatttggtctatgtctcaggtcagtgggtatatcttaagcacttttctgtgtctctgaaaacctgcaggatagtttgttttatttttacctatatgatgccaagggaaagaaaattctgtctggataaatcctgaaatagaagactgggggtgaagattgagagagagggaaggcaagtacagagtcatagctgtgtgaacaagctctaagacttggaaaactttccatgaaacccatatatgtttctcatgtagtgataggttatttgcaatatgtgttgaacaggaatttctactttttgtgccgcgagtatttatagctttcatcattattcattaatatttattgagtcacataggcagaacatatggaattcagggtctagagtatatttacagcttcttatttttttaaggtcagaaaggtgtcattccctgccacttttcacctcttaaataaatcggtgaaggttgtcaattttacagaaaagccaaagcttttattttctgtctagatttttattgacaatgtgaatttttcagaaggagttcggctatttgacttaggaggcatagcctttccctaattacacttcggtggggaagtggaggtgcacagaaggatttttataatgagacaatactaaactgtaatttaaaatttccttccaacaaaagaccctaatcttggcacttagaaataaatctgtaatgacgtggtgttaggcagtggaagcaggattagagccaagggactctgggtgtgttgccagttgctgattttctcactttggaaagtcacttgtttacccagccttagtttcctcatgtataaaataaaactgatggtgcctgcttagagagctattagagaattcaatgaggtgattattttaaaagatactgtaaactttttccaatgctgagttgttgtgcagacattaatggttatgaaaaagataaattagtcctcgctttatattcagaaatggtctgacctttcagtaaattatgtttagttcttaaatcaaaacccagttaggacaagagagcttgaagagtacgtatacataagagaagtctcacagagatatttgaaaggctggaaaatgtgctctggaggcaaaccctccactgaattgatgaattctaagttacatctgttgatattttttgtgtgctaaatagcctcccagtatggtaacattagagaggctgaaggaacctaagaggaggaccctacatttataggtattgaggtagattggtctctgcccttgagaagccaatcaaaattaggttgagaaaggatgtagcaattgttcgtggaatactaataggcatatatgcacttgttcatgttgattctctatgtcactgctctgtaagagaaggaatgcctgcacatcttcaataggaagttgacaacagtttctggaaagttggaagaaagttacagaattattcctttagtagtaattattccatagttctctagaaacatgacaaaacctcttgaaaaacttgagtcataaaaggactgcctcacatatatacacacacttcctgatatgctgtgtaaaactgcgtttatattcagagccacataacacaaattttgccagaagttgctttttataccactgaatagctctaaactttaaattgtctttcataaaattgtttcttgtctgctgagtggacagaatgtctctctcttccccacccttcatatcattttgttttcctaaatgggccactctgtgaagtagttctttacttctagccaccacccctgcctctagaacaatgcaaccaaccttaaccaaagtcacatatcaagagttctctgctgcctgttaatgcagatttgacttctttgtgtgtgtgtgtgtgtgtgtgtgtgtgtgtgtgtgtgtgtgtgtgtcagggtctcattctgtcaccgaggctagaatgcattggtgtgatcatggctcactgcaggctcagtcagtcctcctgcctcagcctcctgagtagctgggactacaggcatacgccaccacacccagctaatttaaaaaatatttttctggagactgggtctcactctgttgcccaggctggtcttgaactcctgggcttaagccagtccacctgccttggcctcccaaagtgttggcattaaaggcatgagccaccgtgcatagccagatttgacatcttaaaagccagagctagacatacttattgattgtcttcctggggccaggtgcagtggctcacgcctgtaatcccagcactttgggaagccgaggcgggtgggtcacttgaggtcaggagttggagaccagcctggccaacatggtgaaaccccgtctctactaaaaaatacaaaaaattagccgggcatggtgatgtatgcctgtaatcccagctacatgggaggctgagacaggagaatcatgtgaacccgggaggtggaggttgcagtgagctgagattgtgccattgcactccagcctgggtaatagagcaagacttcatcaaaaaaaaaaaaaaaaaaaaagtaatggaaactcagagaaggttgctgaagggaagctagaaggcctcctccaggacagagaagtaatcattttacacttatcacttacggtaactacaatagaatcagtgagctagttgctgaatacttctagagacattgttcacttaaagtgaaggtgtgatagtatgtgaatacctggggaagagaagaaagcgaaacatttttaggaaagaaaaggaaagtatgtgacttattactaatcaggatcaatttgaagatctgaatagattttcactggctaatcagagttattctgtggaatatctgcaacctctgcaaccacttttgatttttctgtgaatagtgaggtactgagatccagtaaattataatttggccttgatatcaagccatgaaaaagatgtttagaactaacattcattggcctctttcatttttttttctcttggggttaataaggcgatttatgttatttctaggcatctgttcatcccctctttagcatataggggaatagaaatggtttatccgggatatggatgtggtaatgtgtcttagtctgtttttgtgttgctacaaaggaatacctgaggctaggtgcagtggctcatgcctctaatcccaacacttggggaggccaaggcgggaggatcgcttgaggccagagttagagaccaacctgagaaacatagcaagaccttgtctctacaaaaaagtaaaaataaaaacaagaaaaaggaatactagatgctagtaatttataaggaaaggaggtttatttcactcatggttctgcagactgtacaagaagaatggtgctggcatctgcttggcttatggtggagttctcatgtggcttccactcatgatggacggcaaaggggagtcagtgtgtgcagaggtcgcatgatgagagaggaaacaagaggatggggggaggtaccagtctctttttaacaaccagctcgtgtgggaactaacagagtaagaacctctcttagttctattagagttcgacatgagggagggcattaatctatttatgaaggatccaatcccatgacccaaatagctcctcttaggccccacctccaacattggggatatatatatatatatatatatatatatatatgtatggttttttaaattattatttttttggagacagtctcactctgtcacccaggctggagtgcagtggtgcgatctcggctcactgcaacttctacctcctgggttcaagcgattctcctgcctcagcctcccgagtagctgggactacacctccacgcctggctaattttttgtattttagtagagacggggttttaccatattgcccaggctggtctcgaactcctgagctcaggcaatccacctgccttggcctcccaaagtgctaggattacaggcatgagccaccaggcccacccattggggatatttcaacatgagttttggaggggacaaataaactataacagaaataattagataatgtgtttgaaagtcttggatggaagtccgagaggggaagagtgatggagtagtacaattcatagcatggcccaacagcttcagaatgagaggacattcagggcatcctaatttcacaagttcattctcctttaagtttttgtttttagaaatgggctcttgctttgttgcctagggttctcaaactcctgggctcaagcagttgtctagcctcagtctcccaagtagctgggactgcagccatgcactaccaggtccagttctaattcattcttttataaacaggttactgtgtgtcctctactctgttctctgctaggaattctggcatgatgaagtcatagccattgtccttatggaggtaattctgagtattaccaggaagatccagttaccaatattttgatacactgtaataagtacattaattcttttcctatcttttgcatacagtgcttaatcaaaaaatgaataatggttgtttcaacttactttaccatcagcagtgtgcagtggttcccatttttccacaccctcactgacaagtacctcttgtctttttgataatacccgtcctaacaggtgcaagatgacatctcattgtggttttgatttgcatattccagatgactaatgagcacattttcatgtacttgttggctatttgtatgtcttcttcggaaaaatgtctagtcagattttttttaaaaagaacatattacatgtaaaaagaataatggttaattaaagcaagtatcattagaattacacatcctctcaaatgtgtgcgtgtgttactttagtggattagatttaagtgggagaaaaagcaatcgaaatttgagtgttctgcttgtctttcttcagttagcataccaggcttctgcccttggagaggcctgagaattgtgtggtgctagtttctcttctggctgccattacactatcttctgttgtatggttctttttgcctttttggactcgtcctttgtgtacgttattgccctaagccctcactgatgagattttctgcctcagtcatgctgtgctcagctttcagaatgttgttgttacggaggagttaattttttttttaaggtttccttttcgtcatgctgtatttctcagattatctggagggactgtaatccaattttaggaatccttcagggctgagagcctaaactgttttaagcaatagcatctggttgccagggactcaactactttgagcgtgttaaggtctaacggcagccaactctcaattatctgtgggaatgggagactcctgggatgttttcaattcacagagtgtgcaaaaatctcacttaaacggatagtcgtgacctcatcccacagctgagtttaggagagcttctcagtgtgtggttttgttttctttttgttttgttctcttctcacctttgacagtggcactgcagcattgacaggtgccttttatatgttgaatttatctgtacctgatctatttttttaaaccttgtccctctcatctttatttagattccatatgtgtatcattatatacattaagtatgttttaataaactgcctcaattcttttacattttaggagcagtaaaatttatttatattttctttctttgcttattggctaacgtgctcatgggaggggatgtagccaaacagtaatcaggctaccagatagaaagataagaaaactttacaaaaggttagcctctgaataataattgagaactggctgttaaaaatgaaaaaaaaaaaaaaatacgaactctaccttgtcactgaaaatgaggtgaaggccaggcagtgctcctcagtcaagacattcgtgttcacaactgagttgtctccagtggaaatttcatggctactttatggcctaaagccagtgctcccagacgtggtcatcccttggttttaggattctaaaagatgagtttcttttaatgaaaactgaatgtaatctagttgttagggataattatatgccagttgtgcatgacggcaagggcccctggtttttaaaaaccagctttatggaggtataatttacattccagtaaactgcacaaactaacaatatacaatttgatgagttttgacatgtgtatatacccatgaaaccactgccacaatcaagacagcgaacatgttcaccccaaaagtttccttatgtccctttataatcccttcttcctatctctcccaggaagccactagcctgcttgctgttgctatcaattagttcatatttcctaggattttatataaatgggatcatacataatataatcttttccgtctgatttctttcacttggcatacttattttgagacgtattcatgccacctgtatcaggaggttatttctttttattgctgagtagtattccattgattggttacaaccacagtttgtttatccattcatctattgatgtacatttgggttgtttgcagttttagaagcattgcacatctgctaggagcattcatgtgtagctcttcatgtagacatgtactttaatttctcttagggaaatacctaggagtagaacggttggatcatatggtcggtgtacttagaacttttaaagaaactactaaactttcttccaaagtggttgtgctgtttcatattctcaccagtagtgtatgtatgagcatcctctgcatccttgcccactctcggtagggtcattctttcttatttcagccattttatatgtatgtagtggtatctcattgtggttttaagttgtatttccctaatgactactgatgttaactattgttttatgtattcattcactttccagacagatatctttttttttttttttttttttttttttttttttttttgagatggagtatctctctgtcatccaggctggagtgcagtgacacaatctcggctcactgcaacctttgccctctgggttcaagcgattctcctgcctcagcctccgagtagctgggattacaggtgcatgccaccatgcccagctaatttttttgtatttttagtagagacagggtttcacccgttagtcaggatggtctcgatctcctgccttgtgatccatctgccctggcctcccaaagtgctgggattacaggcatgagctgccacacctggccccagatatcttctttagcaaagtatctgaatcttttgcttatttaaaaaattgggttgtttccttttttagttttgagaattttttttttttttttttttaagatggaatcttgctctgtcgcccaggctggagtgcagtggtgcaatctcggctcactgcaacctccacctcctgggttaaagcgattctcctgctcagcctcctgagtagctgggactataggcgcgtaccaccacacctagctaatttttgtattgaccaggctggtctcgaactcccgacctcaggcaatttgcctgccttggcctcctaaagtgctgggattacaggtgtgagccatcacacctggcccaagaatttattaaattaatatattctgtatacaaaacttatcagatacacattttaaaaaatatttttccattctgtggcttatctatttatgtatcttttactctcctggtaactcacagaacagtcactttattttcttgacagtatcttttgaagagcaaaattttaattcttgaagtgtaatttatcaatttattcttttatggattatgcctttggtgtcatagtaagaaatcttagcttaacccaagattacaagagttttctcttagaaattttatggttttaggttttacattcaggtttataatatagtttgtgttagttttttctatttagattgaagtgtggattaaaattttgcatatgattacctattctatcaccatttgtttaaaaaacttatttctctgtagaatagcttttgcctgaaaatcagttgttgatatatgtgtgggtctctttctggactattctgttcctttgatctgtttttctatctttatgccaatatagtgatgcaattttaatgtggtgtgaaagatggcactacagagcacctgacttgctcctcctctaacctactttactataatagttcactgattagcctgtttccctggataagcagcctgagtttaggaattctttcttagatatttccaacagatggcaatgtgtatgcacatagtaggtgttttgatatttgtttttaaaagatgtgaatcttagggattaatgtttgaatgccatcctggatgccttgtacattcctacagatagtagtcttctctactttctaaaaagtttaggctctgaaaatctgttcataaagtccatttgctcaaaagtccaaagttggggactgttgtgaacatatctatctagttactagttttctaatttttcatttcttatcactggagactcattattggtagaatcagtgtttgtaaaaccattcaaaaacaagtacaaatggtatacaataaaccagcaagggacttgacagaccaaaatgacaggacacagccattatgtcattgtgtcattggggacaggcaaagcacttttttctttttctcctggcttgttattttctttaaggtctctaagatcagataactaacagaagaggctcagtttaaattgcaagcccctcacatacatatacatgcatttgggtgcatgcagacacatataccacaaatactttgtaagtgatggactgccctcaggttagtttgcttggaaaaatcaggcggagactttctataacccacttcatgcaaggcagacaaattgtgccctcattttctattgtctctggcttcatctgtaatcagcaaatggagccctgcagcttacatagtgtttcatctgctatttgttactctcccttagtttgcacaacactgaaccatctcattttgaaattcaagagtggcgaggaggcctttggtggaagattgtaatttgggagaagggaaagtcaagagcaagatcgcctattttgaagaaggcggggtgttgaaggaaattgcctttgtcagtctctgagcctctccatatatgtgctactgtgaccctgccctccatcaccagtgacctaaaaatcacataatttcaactattctccaaacctattcacatctgttgtgcatggcttgtacacttaccccctctattgacagccaatatgtctaaatctttttgcctctcagccagcctcttgttggtggctccctggctttcttgccttctttcctgcttcttctatgactgtcaaatgaatgccttaaagcgttttttttttttttttttttttttttaacagatttctttcttatccttctgccctcctgcctttctctcctagtgcttgtgtaagggaggcagttttttttatctttaccctgttagggtctctagctgaggctgagtattaaattgatgtaaaatagattaacagaagaaaagcatatggattttgacacatatataggagcccccacaggaaagtgaagacccaaaaagtggcaaatcttgaatccttatttagtaggttgaacagagtggccgttgtggaaaagtaactaaaataaatgatgtggctaaaggaagataagagttagtaagatctgttggtacaaatttttctggactccccatgtctagaaacgagaaaatttcttctttcctactatagggagatcatctttcacatgagagttttttcccatctcaggtgtttctggtgataatgtttcttttctcctatctcttttgtttctatttttcaagtgcctttagctttaaaataatccttaggcctaaatagcatgttttggggtggcgtgttctgccactcttcatttgctcatgctttccttgcagaatatggactacaatcatcttattttcaaaaaattcttcaggtaattctgatggacagtttctcttgtgaaccactatcctagatcatggtagacgaatgaatcaacaggcctttgaaaattgccattcattgatcccaaaaagtttttttatataccagataatttccctccccatattatagcaatactagagactgcccaggtttccttaaggaagttcttaaattagtgctactggttggttggtggtggaggaaagcattggtgggtgtatatttacaaacaattacacaggcatgtagtcatgtacacaactcttgtgactgttgataagatgattagtttatgatcagtctttgtctttgattcttaatgcttataatggatagtttttgtcatttttctccaagacagtctgaaaaaattaaatagttattttactttataaatggtaagcagtcagtacctgtttatagagggaatgaacaaagagtggtctggtttattcaggatttgtaccaaaaaatctatatagtaatttataaataaaggtagatctttgaaaaaaataaagataatctctagtctctgaaaatataaacctgttacataataaaaagttgttatagactcttcatttcttcttacctcttaagccaccacctctagacacactttgatcctctctctctcttcttccccccccccgagtggaaaatctcaatattaattggagctaagatgattgtactactgctgctaagacttcagcaggtctcttacaagctaatgtcacggcatggggtccatttgctctgtgtagctattctgcagtgcagtgagaattccttgattaatatgctacatgaaaataaaatggatttggaaaaaattatagcatactctcataaatattaattcacatttgtatggaattacacataattttcaatatactttggaagcaccttcagtatgaaagatttggtctccaaagagaatggcataatttttttaaaagcacagtggatacattattaagcatcatttgtttattaatctgatcctctacatgcatatgatgcagggcagtaggtgggttgtgtgacaaagaaaggagctttataccctgtggggagtttttatattacacttagaagtggtacaatttaatcacattatatagaagcagcccatgatggaactcacctggctccctctgctagtgttgccattattcctgagtgtctctttatggcagctattttggttaaatgtgagactaaacacagaacatttttgagctgagcagatgcctggcatagctgactgaggttgtggacactggacaaaggaattcaattcagcagccattcattgaacatttactatgtgttaggcatagcatgcaaggctgtgaaatcaatggccatgtgcgcttgctttgatctcgacttgtcccctgaaacacttttcaccacatcctcattgcctcaggagagctacctctccgatggcagagggttaatcgtctgcagtggtagcagctggaagttaggccagaagctgcttatttgccttgtggactgttatctttgatatcttcttactcttaaggataaggcctttccccttttctggggtttcttgctgtttgctgtgatccttcgtgtataccagcagtgcacactagattccttggtttcctgcttctatcaccctttctggcttgctacactgtatgttagagacagcttagactattttaaagtcagtattgtgctttataggtttggatgttttaactagttgactcctttatttatgtatttattgactaatacattggccacctactatttgcctggtttatgtgaagtacttatgtgaagcactgggattactgagatgaactacttagtccctcccctctttcacattctttcaagagattatgcacccagctgcctcaaggcctttgcacaagctgttctctctgttcagcctttcagatctaggtcaaatagcagtcattttctcagctctaaccctctcctctggactatatcatttcccttagttttagcacccataacctatcctttagcgttgttaactcagtttgcaatgatatatttgtgtgatttgattagtatttgtcctgtaaattctaggctctatgagggtggtgacttttccccacaccattatcatcctaaacataggtcagtgctacattggtacttggcatgtactgggcacacaaaacataattgttgaatgagtgaagacctgagaatagagtactttgtattacaagaaaggtctccctgagtgggcaacactgctaagagtcactgaactagaaaagggaggagtgtgtaagagaggccttttgaggccaaggcaaatcagtgtaaaggcctgcgttagtttgtccaggctgcattagcaaaatgtcataaactgagtagcttataaacaagaaacatttatttctcacagttctggaggctgggaagtccaaggtggaggcaccagcagattctgtgtctggtgagagcttgtttctcatggatggtacctgttctcacatggtagaggggcaaatagactcccttaggccctttataagggcactaatccccttcatgagggttccaccctcatgatccagtcaactcccaaagtcccccatctcctggccaacatggtgaaaccccgtctctactaaaaatacaaaaaaaaaaaaaaacaaaaaaaatggctgggtatggtggcaggcatctgtaaccccagctactcgggaggctgaggcagggaatcgcttgaactggggaggcggaggttacagtgagccaaggtcgtgctgttgcactccaacctgggcaacaagagcgaactctgtctcagaaaaaaaatatattctggggagacacaaacattcagatcataacaaggctcaaggtctcagactaataggaatggctgatttggggagagatgtcagggagtaccatgcatgtaaagttgggagtgctgggatattgcagcagaacagtgagaaaattggatgtgaaagggaggaaagagagcggtattttaaggagaaatgagtaaaaggaaatttctattttggttttgttttatttttaaatgtacatttagatagtaaaaaatttaattgttcatttaaaaataactaaaataatataattggattgtttgaaatacaaaggatacatgtttgaggtaatggataccccatttaccctgatgtgattattacacattgcatgcttgtatcaaaacatcttatgtaagtcataaatatatatgccgactatgtaccccagaaatgaaaaaatttttaaaaagttcatttaggactgcagaaactgaggaagtgtggtaaggcttcatgagggggattttctgtgtaagaggattagatccactagtttccaaataactgagtgccaaaacattttcattttattgcttagtgtgtgcatcatttctcacagggcagaggatatttgcatgtatgtggtttgtttgatgttctgagagcccattttgcacgtggtctcagagttgtagtgacttactccacttctgataatgaataatgtcagtgtccggacactaaaagcccagtctgttggaaccttggtgtgtactgagctgcctggaggcacagaactcttatcaggtcatgtggcctgaaatgcttacctgtagtttctacagatgcagttccccattcaaggacattgatttcccatttcctacccacctcccctcatccccaaccacacacaggaataaattaaaagttgctgttgatcttggtgataatattgttgttacattttgcaaagaaaatggaaataaaggatgcttagaggaacatgtaaaaaaatataatgcattaaggaaacattttaatcatatgaatagacagttctttcttgctggctcacatccacctggacctgataaattcagttgggtgctatttcttttgaattgagcatgcacttagtgctcattttctgaaacataattgatgtaccaacttgggaaatgagtgtattgcacttccttggggaaggtcattgtgtgctggacccagcaccaaatcgaacagaaagctgctatcccagggagcagtgaaatcacttttgatgcatatacttgtgttttgtttagttttctgcccagtaataatagaaaggatatatatatttgtgatggcattaaggattcaggaaaattgagaagccatgtttcttagttttgggtcttctcatatcccactttcctatccctctcccacttagtagtaacaccctttagtatttagcctatattttgggtgtgaccctagatacctttgtaaccaccacttccctttccttctcttcttttctacagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacaggtgaggaagcttgggttcgctctttcctgtggcggcaaaatcccttccttaggtgcttcctccactgtggtttttcgtaacaggtggagaagatatccttggtgggatgctgaagtggttgtccaacaaagctgtgtgcgtgcctttaaaagaatctaaaacccaatctcagctctttctatgaggatttgaaacttcagcatggtgccctttcagtcagatgtgctttatgcaacaaagcttgatgctaagtggtactggtatttagggcagacctgtcttaacagttgtcaagatggactggcttgcaggggagagatctttgcaattaggataaatggaacaggtggatttcatcacatacattgtgcatctcatggttctaaggtgctaaaatgattgcctgtgtgtgagaaatgccttgctaagatttatattttccggggaagctcagatattgtggcatctgggagggcaatggcaaaaaatgaatttgccttttggtgtcttagttgttctccataggctataattcaagactatctttgtgatctgttgattgtatgaacgtctgataatgaggcttactggcctgttaataattaggtttcaatgatccacaagaaagtatggctcttggcatttgggaagcctttctgcctgtggaaatccccacatgagatggattaataatgagatatgaagctgtttatagcagtttttctgcacaaatccagaggcttcagtgcctgtcaagttagttacctgtgtcctgggtgtgttttatttatttttggcaggaccattgggtaggattgactatcactgaagaaagcagaggaaggaattgtggtgtacagagcaggtgctgctaattagaggtggaataggtaatttttggtttgcagatgtttctctgcagaggcagggagatctgggatcaaacaaaacaatggttcccaaaccacacagatcttgagaatcatataatgagagctactaaacctaaatttctggcccctctttaggacctaatgacatttgtagttttagaaagtttcctatttgaaaacagtcagcctggttggaagtcactcttacaaagaatcaagagtgtatttgggtgatggtttttagttaaaagattggaaagatcaaaagcctcaatatgatgtagtgggcagtttggtgtcagaattctgccttatacgtagtgaagcatataatcctggtaaaacatctggggtgatgggtttcagatggacccagaaggcttccaaggtaatgcctaaatctgacaaccagcacagtgtttccaaaggtacacttgtgtcctgaaacgccagactggagttataatagtaattattaacatttacctaatgcatactatgctacattcagtgagggagtttttatagtataacctataatttgtacaacaaccctgcctagtaggtaatatcatggttacttaacagctatggaaacgagggctcaaagagataaagtgacttgtctgaggccttgtcaatgagggaaggagccagggtttagacccagatatctctagttccgtggtttgttctgttttccatatttagatgaagttttatttatttttttcttgatagggagttggggagagggaggaaagcctaagttctataaaaggtgatgttcctgtggtatttgtgactcctaactcatgcctctgtgtgagatatgtgagaaaagtaattaatctcagtggagagagattgcaatgtaaccacccccctctccctcaggcccccgccccagcagggtaagaaggaagccttcttactctgagttaacaccaagctgcggatcctcatccttgaatctttttcttctagacgtgatctgacttttctattctgtgtcctcagaattattctttgtatttctttctacttcttcgagactttcaaggtcctctggtgacagagttttatgatcggaaaagaagactaagacgtaacacatcttaaatttgagtagcttttggtcttaatggccaactctcttgtactaatggtatttgaaatcaaagctatctttgttttaggtaacatatttgaaaagcaagtattttgactctttatgaatcatggagaaggaaagcatgaattgtatctttggccctatgtaaaacttttaaaaacaaggagtattttcttaccttcagtgttgatgccaaaatatgttatccaatcaagtgttatatttctagtaagaaggaatgcagaaggtgataattgagataaggccataatacttctcatttttaatattcttagaatcacttgtgctattatgaaatcccaaacaagtcaccatctggtaacagcccatctggaaaatgaagggcttggacttgaatgtttcttaggctcctccctctgggtcccatagttttttaaatttatgaataacacaaatacagtgttgtaaaggtctgtaaaggagtctgtaggtctgaaggtaatgccgttttggagtcagtctgtaactgataggctctgtgaagacatttatttatttttaatgtttttttttctttaaaattttgttttcatgtaatatgaagacatttaaaggagaagggtaagatgcatttatagtaggagggaggggagtggtccattgtgtgtcagtccagacaactgccatctgttatgtgatcattggtaaaaggtgacacatgagtgtttaatgaccatagtagatgttcaaaaagcttgtctgaagaatactcgtgattgctttcctatcatcctagatgcctgtaaatatcacaattactttatcgcctgcgtttgcctcttatcaggtaaagaaactgaatctgaccatcttagctgggaggggaccttgagatgagagtgagctttgaggagcatttctacattaatggattgtcatttagtgcctgttattgagaactacagatgaaatagggaagaggcgagaacttagtctttatttctgacttggttagaatgaattaggtttgcatcttattaggaaatggtacttcctgagcagacaacttaatgcacagctttcctgtaattatgggaagatgttactccttagtagagaggaaagaataggatttttttttctgagactccgttgaaggcaactgatctttttactcggagggtgcaattataatacttttataggaaagatgtatagttctaaaaccaaactgcttattctttcacttgcctggttgtaaaacccaagttcttgtgatgtttttccatactaccaaaagaaagcttttaaactgacacttatttgttggattatgtttttaagtataaatacatactgccttagaagatgctgaggtggcacctgtcttggcaaatggttgcactttttgatatgagaaatttgaatacttttcttacttcccaaaggggttaaaattatgaagaaatcaataaattacctcttatacaactcttatacaaaatagcgcatgtctttctgacctctgtaaatgaactatttgttcatgatgtaagcacttagacatgatataaaaaaagttttatcatttacttacaaggacatggtactttttttttctcaatggagatttgggggtgggaaaagcaaaagaggttgcacatggcctctccttaaggagctttattctctaattgggagaccaagtcacaatgaaaccactcaggaacacaaggaagtcaggtgtcgctaaaccgataagccaaattataacttcctgagaagcactttgggaaaacttaacccttcccagggcattgagtttaatttcagtatatctgacttctagaccatggagaattcttaaaaaatttaggactttgtagtttaaaacacacagagagcaaaagggttttaaaaatagagtaccaatgatgaaaagttgatgagcattcagagaactctcagatttggctctgactggatttctaaatctccatttagtccattagtctgtcctttctctgtagtatcaactgagccagaggaaataggcttaagtgagctagaaggcatttttaggttatatgaactcttctaacagacaccaagatgaatcatcaaaataaatcctgtggtctccctccttaactgaattttaggtgccaaaaagccattcatcttagggcagaatttcctaaagaaagaggcaacctgttgagattgctttagtcacaggagaacatcattttagaggaaaatggaggaatttgtgaatatttcaggagcctgttagtagactctaaccttgctggtaaggatggcttatgtgggaatgtcttatgtggtttaaaaatctttatacaagttgatctgggtaggtatttctttttaggaataaaaatttgctcttctctctctgaaaatccagtatggtgggagatttgtagttgacattgtaaactgtagacaccaaaagtgtctactgctttctaggaagaagaggaatccatcccagtgccaggcatttaaaattagagtgattactagaactctgcatggttgcatctgcttcatgtattgacattgtaccttggtcttccttggagtaagtgatagtggtgctatagacttaagagcccaggtgactgagccaccctctcttcccacctgtcctgatggaacagtctatcccagcccatgctctttcctgttgagagtgtttgctaccagaggctggtcccttatttcagcacgacttagacttactgcttttgtctgaagagctttctctaaatttgttactagtagaaattaacttgcaaaggaggatttataatggaaaactttgattaaacggatccagttcaagtctcgtttctgaagatctgctaattagttttggatggaaatctaggccaaaaatcacacaggtatttatccagcttgactctagagcctacaggtttctggaaatcagagcatttgagacacgaatgtaatttgggattttactgtcataatgaaaagacatgaactttgctatgtgctctttcatacatacttttgttataatatttagatgtctgctggtaccttgaactagtattaagaatgtcagttaaaccgtttctacctcatacttcaaaatttcaagtttaccatgttaattgggatttcatttgctttcgaaaaattttgtagtcatgtgaaggttacaagctaaggtatcaaataaaattctttatatttttttcctttttatgaatttaagttgcatactactttttccccttgcctaaagtatagaaataagaaaaactgtaaggaaagatggagggaataaaagattggcttatgatctctctttggaatattgattgacttgaataagagtgagatgctagttttaacatcaggtaattgaagaaccccaatctaggcttgtctgtgttcaggaattactcacgtattgtattggaagtattggtttgtaactgggattggtaaacctgacactaatataataatgagttatatgaaaggtgttttgcttttgttttatcttgagcatttggaaacaggtttattcgtgtttttcattttgtgtcttttgactctatactttgttgctgtgagccctgaatgttgggaatagtgagcataaacatcacttaacttcagtgagatacatctttggaatgttatgaccagtaataattttatcctaaatgacatttgtaattttaaataaaaatttagtaaaaattgactatgaaaaggacatagcatatgtattaggattctctggagagcaagtaccagtagaatatatatgtgggtagataagaggggattcattcggggaatttgttcacatgattatgggggctgagaggtcccataacaagccatctgcaagatggagaccctgggattcacagtatggctcagaccaagtctgaaggcctgagactggggtagtcctcaagtccaaagcctagagagcctagagtttagatgatcaagggcaggaaattatatcccagctctaggagagagagagagaccatttcgcctttcctctgtttttgttttatctggacacccggctgattgcatggtgcctgcccacatggagggcagatccttccctacttagttcactgagactcacatgccaatctcctctggaaacaccctcacaaacacacccaaaggtaatgctgtaccagttctctaggtattctttaatccagtcaagttgataccctaaattaaccaacacagcacattaactaccacctcataaaataaaacctgcagagagaaaataagctgaatgggaaaaggaactgcaatgaaaagaatgggccataattcagcttgggtgatcctgatacctacaggagttgttccataaaacagtgaccttttatatttcccaaagtaagaaaattttatatgtgtatttgtgcatgcagaactttattaagggccatttaaatcccatatattgatagaggagttaagaaagataaagtgacaggagtgattctcaactctggctcccataaatttctacaatgtcagtgattgaagaatgagggagcacatctttcctttaataaggcctagccagtacacttttggtagttgatgagggtaggacagaactccctttctttatttgaaactgtgtatttttgtgctgattaaattttacatttttccctcttgtgatgatataaagttatctgcatgtggccagatctcagctaaagaacatgaaataagcctctgtacattctgcattctaatctctgttcacagcaatcttgtatccacacaagtctgtacatgacaggtaatgagtgggaagtgggaggagatgggtgtctgtgtggtttgcactggtggtggtggggaactgagcagatggttgtgatagccacatgctgcgtgattcccgtgggagttgatggtggtgacaggcgactcacaatgtgctatttacagtttgggtttgcagtctttcggtgacatctgaatgctctttagcaactgctttcattactgcctttcgaggagctgttaattgaaaatgaaattgtgggtgggctttaagacaggcagacgcaggcaattctgtgtggtaaatgttgcttgagaactgttggatgtcttcatgcccaatttgtaattcattttctaagactgtaaaagccaaaggtgcatttggagattcagttatgtatatacataggcagagttgaatgtcacaccttgcccaaagggtcaaacatacagttattggtatgggtgctgtggttcacgcctgtaatctcagcactttgggaggctaaggtgggaggattgctttgagcacaggaattcaagaccagcctgggcaatatgatgagaccttgtctctagagaaataaaaaaattagctgggcatggtgacgcatgcctgttgtcccagtttcttgggatgctgaagtgggaggattgcaagggcccaggaagttaaggctgcagtgagccatgttcacgcaactgcaccccagcctgggcaacagagcgaggtcctgtctccaaaaaagaaaaccacacaaaacacctatttgtctggaaaccaacctaggggaatgcttggcaatcccagctgcctgctcatgtcttacctttgtgtagttctctttaaatgtatacaactgtgtgaggttcttatgtaaaatctgctgacatcttgtagtgttctctgtgagtttatcgtaggacttcatcctcctttcttcctttagctcttcataaagttactatgcaggagtaaatggttatttgttctcttgaactttgggatacatttttccttccgtatccaaggaggattctttccaggactccccatggatactaaaagctgtggatgttcaagttccttaaataaaatgttatagtatttttatgtaaccaacacacatcctctcacaaactttaaatcatctctaaattatttataatacctagtacagtgtaaaagctatgcaatttgttattatattgcattgtttaggcaataattacaagacaaagagcctgtgcatgttcagtatataagcaaccattgtaggccacatttttggtctgccattggttggatccatggatacagagggccaactgtatcatattcaagttcttacatataactttgtttcttgtaaacattttcatatgatacaactctgttaaaggcagttggagcccagaggcaaacaagagaagaaggaagagagagggtggattttattggactttgacagtggttgatgatcttgattctcttatggctgcccccagctgcaggattgtgatttgtttcttatcttcagagttgtttgctaaagcattagtagcattactgaaatggtagcttttgtaaatgtttatatgttgaattgttttattgcccatagctttgcacagaaatcttgtgctgaacaaggaatgacctccctcttggaagtgctgttaactctctttttaattaaatatgaatatagatacaatataactgcatttttttagttttcccttgaacatttcagtgaatactatctgggacaaaaccgtgctgaattatacgctttcactactatcactctttgctcttagagagcccccgaggcttggggtgaggagacacaccccttgctgtacttaaccctcagtcccattagacctgctttgccacaggaacccagctgttttaatgcatttgagttgctgttgggtcctaatgatgtttaaaagaacctgtcttggtattctaaatgaactctggagcattgcctattgatgcaagtgttgatgattttatatcaggcagatataactttgttatttactctggggctttttacacctaggggtgtgcatcctcacaccagtgctcacaaagacacacacaggagcagaaaccaaaatagctcacaaatgtgggcaagtcctgtgggggaccaccttatgtctctcaggaggcctgatgagctgtgccatgtggccttctggaacattatacctgcattcattgatcacagctctgcagaagctgccacttctcctatgtgcctgcctgcagtgacgctgatgtagcaggtcattctgtaatcactgtttgcacctgcatttgctcaggaagtgtttgctcatacatcttgaaatcatgtattacaaacctggacaggtcctaattgctggtgatggttctgagaggttgagattggctataattagatggagaagcaattagctacatattctgagtagggaacatacagaataatgtttctcaaagggtggtctttgaacccctatgtcagagcaactgtggatcttttgttaaaatgcagattcccaggtaatcaccttggcatagtccattgggtgggggtcagggtgtggcaacaaggaactggagttccttcagtgactccagtacaggtgctgcaggagccatatttttaaataaactgtacttattttttattttcaattaaaaattgcaatattgttagcaaaacttgggaagaatcataaaattgtaacaacatatcttgcggaaattaattttatcaataattggatcatatttttgttctgtacatttactaattgagttatcttccaaaatgtattggcaagaaagaaatgtttctgccagatgatgtagacattatataacaaaaaatgatgttttcaaaatagctactttttctaggtgtttactagaatggacctgatagaataattgtattctagtattctctccttaggcccactggctcactcaaataatagctgtttataaagatgctaaccggagttttttatttttcatttttttaaagttctaatttcttgttttttcccatctgtagacaatgatgatgagctcttaaggtttatacattttttgaacccttcaaattacaaaagttggtgatatttggtactgggggtcaagtgtgaaagaaatctgaaaatattgcccatatcagtggagactaaaggccatttgttattttcttcattaccagcaaagcttcagtttaataaaaatattataattgaatttacgattttgattccacaaattcaaaaagaaatattttcctttctaaagccaaacagaataaaaattctcataagaatttttgtttaaatagcaaaacctattcttaggatttaacaattgcctgaggtttgtcaacagtaggtagcattctttttttatatattgctatgaggccaaaaatgctattttcctggagattagtgcaaaataatctaccgaatagttgctaatgaaattatcatatgagaaagattattaataatgacttttgattttaaaaaatactatcatcaaattttcctaagaaatgatgatgagaaaagcagttttgaaatacaaagctgggtggtagtgggcctggtgtgcactgctggaaggttgcatggtactttgtgaaacttcagcagcccacttgcataatttatcattacctgtcccctacctctctctacttaattctgaatctgtatttctcagataaacatggcagtaggaaggatagggaaaggtgttgaggggatgtgattatatggatgtttttgaaggggagtatattggtgtcatgggatccttgggatgtcatcttgccagctggaatcctctgtggcaggggtaccttctctctgagtattgctcatgctcactgggcactgggcttgttctgcccagttggcccagcaggctgcacttggctcatgctactggcccagatcccacacctgccaagggcgagccaggcgtagagtggcaaggggtgtgtgggtgagtatattagttcttttccacgctgccaatagacacatacccaagactgggcaatttataaaaaaagaggtttaatggacttacacttccacatggctggggaggcctcacaatcatggcagaaggcaatgagtagcaggtcacatcttacgtggatggtggcaggcaaatagagcatttgtgcagggaaacacctgtttttattttattattttattttttatttctttgagacggagtcttgctatgtcacccaggctggagtgtagtggtgtgatctcagctcactgcaacctctgcctcctggtttaagcgatcctcctgcctcagcctaccaagtagctgggactacaggcacctgccaccacgcccagcgaatttttgtatttttagtagaggcagggtttcactttgttgaccaggctagtcttgaactcctgacctcgtgatccgcccgcctcggcctctcaaagtgctgggattacaggcgtgagccactgcacctggcctgaaactcctgtttttaaaaccatcagatctcttgagagttactcattatcacgagaacagcatgggaaagacccccatgattcatttgcctcccactgggttcttcccatgacatgtgggaattctgggagttacaattcaagatcagatttgggtggggctacagccaagccatatcagtgagtgagcctggggtatggccactgctcacagccaggcatgcctgctgctgcggcagggtgggcagccccaggcaccagaacaggtgctggctccatgcaaggctgtggctggacaagatgtactgcatgtggcttccactgtgggcacccctgtctggatgagggcaacaaggtggcacccagaagcttggagataccaggaaccacagagccccaaagagggtgtcacagccctgcctcagggagcccctaggtctgggctccctaaagggccgcagctcttctctccttctcattaactgcaacgtggcgagcaggggggaaagtgtgtttcagccctgtttgtgttacagctcatcagtgctgccattcaacaggtctcgagttcatgtcccatgcctaggaagaatgaggtacagcagacaactggagtgtgagcaaggcagagaggagctttatttgatccacagaacagctcccaggagacctcaagtgggtaactcctttccacaggcaggtcatccctatgagtgtccagctctcagtggagaggcgagccgcagtggtagctcctttctgcagctggtagtccgatgtctgtttgagcctggctgagtctcgggtttttatgtgcttagaagggaagaagtacatgttgattggtccatgggcaggcctggaaaaagcaccatccgattggccaaatggtcatcaatgaagtcttcactctgggcggcagactccaccgggaactggcaccctggccgctaggcttcaggttgtccctggcttgaaggtggaatttcactggggacctgtccctttctgccctgaaacctgtctgcctcccaccatcaatgtgccatccatggcactcaggctgttgatgccaagggacacctgtaggcccacgctgagccaccttcagtcctaccttggcctccctcttgtgctcatgggtgcccaaaatctggagggggtgctgaggtggcagggggctggcgtgtcaatgccacccgagtgcatgcatgcctggccaggttgtgacagcactcaggcttagcctcaattttcctctgaaatcagagtgggctccaggtatggggagaagccaggtatggggagaggccaggtagcgagagtaggcacttccaagactgctcgggcaggggcacttccccaggcgcctgagagctcagggatgcctgggtctggagccacagctgggcagctgcatgtgtgcccaggagcatgaatctccctctctgccaactcagtggagggtggggctcctgcctgttcctggccccagccggctcctcagagcatacagccccggctgcagccagcatcttggcagcggctgctccagacaggctgccactgccatcactgggaccatgtagggagtatattagggctgccccatggttctccagatagactaaggagacaaattgacatagtacagtattagaaggaaagaatatggagtttaaaaaccgttttcatggtcattctgcccctgctcttctcttccccctttcaaactgagcagacccatatttctcctttcatctctgtccttgagcctaccttcagctctttggctttcattttactccctccttccacccagtgtcttttgctagcttcttgacccagccaggattgcatgggacatcacttagatctgctctcagagtcacaaaatgcctttgcttcctgtttccttgttccttttactgtgctggttcttttcggtaaacttttagatttatcatctctagattagtgcagcattatttagctcattgctattgtactctggtttaaaaaatttcagtgaccatccacagccatctaaataagattgaagcctcttagtataggacattttaggccctgactaatcctgctgcaatgtaccttcccagttgcctttcccactctctgtaaacaccaagctgcaactacaactgctatttggatgaaccctgtgttttctccacattcctgtgcctgtgctttggctattttctttgtttagaatattcttttttgacatatttgtcttccattgactagttcagacccacttcttccttgaagtttttatgatctttttccttgtaagtaattgcattgtcttcccaactcttatgatcctttgtttataacaagggtcaccccagaatttatcagctaatttaggacattactgggaatgaaagggggaaccattaataattaccttggaacaataagcattaatcaggacttcctgaaaaactgggatatatagtcactctgtaattcacttttggcctttttcataccatactctgttttgagttggaggtatacattttcttctttccactgaaatgttgagctcctcgaggacctcactgtgtgacacagcaaggggcctaggcttatgtcacatattgggaaacaacacccttaaaaccactgctatcctttactcgaggatacccttctcatatttatagtttccattcatgtctctttccagtcttttctccatatgctagccagagtgatcttttaaaaatatacatatgatcatattattcccacaagtaaatcctctcaactgcttctcagggtattcagattgaaaatcagactcccatcatctgcagtgcccagttatccagtgctgtttcttcagcttcatgtcatgcttcccttgcttactggctccagctcccgaccttccattccctcccacatgccaagttccttcgtaccctggacaccttatgctatcctctttggaagaaatggttccccctctgttttttgaatgatgagatccttctagtcctttaggcttgaactgaaatgtcatctttcataggggcttttctcgaccatatggtttatttaactcaggatctgccatttgtcttctgtgttttgcactcacctttttaacttcctaacaccacatttataattatagatttttctttctatgtccttccttatgtctgcaccttctgctgcactccaagctctactgaggagagatatcacctccaccacagtgtttgtagcacattgcctggcacacagaaggtggcactcaataattaaagttgagtggtttgaataatttttgcaatggatgacattgctaattccacactcctgttacattccaactttaattggctacaaaaaaaagcacacacacagacacagacacacacacacagacacacacacacacacacacacacacacacacacacacaaacaatccagaccccaatacagtatgactgttgtcttctctctctggggatatgcaatgtaaaataagatactgatgagcgcatgctgcacaccaagcaaaaatttatcccaagcaacccctgcgccctgcgtggaccgtgtctgctgttctcccatggaatctatcagcagtttgtcttcccagggttgtagcctgtcaggatggtagaattgctagtgcagccaggaaaagctgacctaggaaaaccatagccttccatctttttagaggtaatccaaaagagactagacaagcagaaagacggagaggaaagttggtgggagtgaggtgaaattcactgagtactcttttatatgcaaatatttgtgtggggctctacttttttaccatgagtacaaactctttttagtatcaatgcatgaatagcgtgtcttttcactgaaaaattattgtcccacgtgccctcggtttaaaatgttttgatcttagaaaacagtttatttccttttaaagtggcccaattaattcattttccacatatttgctcattgagcaaacatcaactgaacatcgtttgtgtgcaaaccttatacaagaaactctgacataacagggaggatatgtttaatgataactctgcccatgatgtgtttatggcttgctagatccattctgacccacctattgtgaagagttcatggagagctcttaacaacaagtgaggctgaggctggcagattaaatgcagttcaaagggagacaaggttgaacatctcctagagagggaataccttcagagatacatattaaagttctttaaaattgtttctttcttattgtgccatttttgttgacctcccttctgtccttttaagaaacttttgagaaaaatgcattattctaccgaaagcatcggcaaatgttggaaatagtattttgtgtatcagttttcttggctgcttatttttaaaaataaaggcttaaataaggttcgcacatttttcactcaggtgcaatttactgggaattacctggcgcattggttttatgcttaatatttacagattattaaaatctcagtggctttcaaactgcatggaccaagaaaataggtgtattttctagaaatggttttgcttatggacactgacccactttgaaacgacttactcttggaactcttagtacaggaaagtcttatgtttctgtctagaggtggaactgtttatgataaatagaaatagctttccttttctatcatttctgttttcttggaagtagattatttttgatgcaagtagaccttcagaatttgaatagaaatttttatttatttatttatttattgagacggagtctcactctatcaccaaggctggtgtgcagtggtgtgatcttggctcactgtaccctctgccccccgggcttaagtgatccttccacctcagcctcctgagtagctgggactacaggcgcacaccaccacacctagctaattttttgaagagatggggttttgccgtggtgcccaggctggtctcgagctcttgagctcaagcaattctcttgccttggcctcccaaagtgctgggattacaggcgtgagccaccgtgcctggccttttgaataaaaatttagacttcagatttatatagtgagtatactgatgggagattgaacaattacgtgatctcaggagtagattatagagctgtttctaatttactatcaagttatttttttcccaaaagataatttataaactgcttttttgtttgtggaaatcctgtttgttaggaagtgttacaaatggtagtttcccagtgaatttatcaaaatgctgtttattcaataacattcactcctccaaggatactactcactgtcccttgacattcattcattaaatatttattgttcatgtactgctatggacagacataattttgggtgcttatattagtgaacaaaataatgaatacatctgccctagtggaagttacattctcttcatatattaaattctcttagtagtatacagcttccatttaaatgtttaacccagacctttcttctcaacttctagattcataaactcagctccttatcagagttttgctgcctagatcattcacaaacatttcaaactcagcatatctcactttgaaatctataatggtggtccccaaattgctcttcctcctcaatttccttccttactgtgtgcaccatctgctaagcatccaagccataaatctgttcatactagaaacctgcaagtcaaactcctcttcccctcttccccccattcttacatcctatagatttttatcctatgtatttcttatctgaccctctctcttcaatgttttctatccttcctgcgagtgcagtagttcaggttctctttctcttggaggtgtgatgactagcttctcatctgacttctcagcctctaatcttgccactgttaaattctgctcctcaaattcctccattattgtgttcttgacagcatgcaaattgaatcgtgtcatttgtttcaagagttttcattgactttacttataggttaatttcaactttctttatatggtatagaagcccacacatttttttgttttgttttgttttagagaggatctcactctcttgcccaggctggagtgtagtggtgtgatcatagctcactgcagcctccacctcatgggttcaaaatgtccttctgcctcagcctcccaagtagctgggactaaaggcatgtgccaccacacctggctaattgtgtgggtttttttttctttctttctttagagatggaggactcactgtgttttctaggctggtgcccacacattttaatgcctttcagagcattccctttttttttctttttttttttttttggtgcttcctaatcccatgcccctatcacatcagacttaatctattttctataatgtcttccttcacccactcctacaaatctgaattttttttttccttcagtgagtctgatcttagttacatgtgagaaatgtagtcctactaaatcagaaatggactatactacctcttagaataacatctcttgaaagggatcccctatagctttaaggggcctgctggttttttgttaacatgggtgaattgtatagtggtaaaatctgagattttagtgcacccatcacctagtaatgtaggttataactacatattgtagtagttacaatatattgttttttgtccctcactcccctctcactctgccctcttctgagtctccagtgtctgttatactactctgtatgcctttgcatacccatagcttagctcccacttataagtgagaacatagggtatttggttttacattcctgagtcacttcacttagaataatggtcttcatttccaaggacacctttgttgttgttgttgttgttgttgttgttgttgttgttgcgacggagtctcgctctgtcgcccaggctggagtgcagtggcgcgatctcggctcactgcaacctccacctcctgggttcaaacgattcttctgcctcagcctccctagtagctgggactacaggtgcccgccaccacacctggctaatttttgtatttttagtagagacagggtttcaccatgttggccaggatggtcttgatttcctgacctcgtgatccacctgcctcggcctcccaaagtgctgggattacaggcttgagccaccatgcccagccccaaggacacatttttaaactaagaaaatgttcagtttgttagaatttaatgtggcatagggaaaggaaaatgaattttagaggaccagtcttttacaaaagattactgcaaattttggtggtttcgttcaaaaacgtaaaaaagatcaatttcttttttcataatggtagttgctggacccttgtattggtgtggccattggagattacagaagccttttgttactggaaataattttcaggcctcagagttgtaagtcaagaattgcctatactgaaccctttggagtcttttcattgttacgaggtaactttgcttatgtgtgaattaatgcttaggctttcaaagcaagaaaaactagacatgatatgaactttgtcattctgctaagttaatactgaaatgaaaacttttactgatacaaagacatttctgttaccagtaaattgtgtagactttgtgaggattttgagatgtgatttatattggcttattttttaaaaagctggcttaaaaagtgaccacaagtgtgctaaaaggtttatttgaggtaaccacagtattatagttcccctggcataattattccgtattttgtttccatgagtcaaggcacaaagcaaggataatcataatgattgtaggaaacagcgcttagagctgggatcctaggattttaatactaggatcttttacttgttgcagcttccacattcctttttgaaaagctttttttaaacaatattttttagggcacaggcgaactattttagcagaatgaagcagtaatttaagaaaaatctttatattcctgtccatttccacattctttctgaaaggctactcttgggggtagaaatacagctgtggatgaaaagattgaggtaaggaatacttttctcttaaattcttgtagcttgggtcattaactattgtcatatatgtcgacctagttcatggcagccagaggagacaaggtataaaattgactgggttgtgattcagagggggaaacaatggaaaatatattgaacacttttacattactgagaccccttctacacttttttcctctttggttttagactgtataaagtattgtgttggtactgtagatacagcgtgtggctattgatattgatataagaaaatctgttaaggttcctctttcagcagttatggggatcttcattcagagcaataagatcatttctcctaggtgttacatgttggcagactgaagaagacaaagacgtcttgtcttcacattgttttatggccacgactttgaattcatttgatcacttaagaggtatcgcagacactgtagctaattagaaggaagggggcagttttattgtgaatatgttcagtgaagaagatagcagtgtttgtattgcacaggctgtatgaacgtgtattttgttggggagagagagactgagaatctggattcttgggttaaagtttctaccttgctgctggcactttgtccttaaccaagttattgctgctctttgaccctcagtttctgtgattgtaccagaatgcagatgttgtattcttctaacactgtgaagatgttatacatgctggagtacttaaaattccctcttccttaaaattgagaaaaaaaagtagattaaaaaaactaggaactacctggactttgataatattaatattttagataaaccagcactgaagtatgtgatacctacaaagaacaacacctcaagagtttctgctttgtggtaatgactcactttggtaaaattatgctgtgcacatggttattagactactgtagataccagtgggtacattagattgaaaaacgtaaatgaagtggtcttatgtatacaattttttgcagttgccttttgttgggaagagattaatatgagatagtgtaacttttttgtttggggtgggcgggggtgggcatgcctattggtggtgatctgaggattgtaactttagatcttttacattgaaattatagaaatttgattgttatggataattcatggtgaaggaatgtaatgaaattattattattattatttttaatgactaacccatgttcctagatgtattcatttttggcttagctctcctctcctctcctctcctgtcctctctctttctttcttttatttttttttagagagggggtcttgctttgtcactcaggttgaagtgcagtggtacaatctcactgcagtctgaacctcctggctcaagcaatcctcccgtttcagtcccctaagcagctggtactacaggtatgcaccaccatgcccggctgtttttgtattttcgggggaggcagggtttttccatgtttcccaggcttgtctcaaactcctgagctcagagaatctacctgccatggcctcccaaagtgcttggattacaggtgtaagccactgtacctggcctgcttttcagtttttcagtaagtaaattgtgaggcatatatgttgattcttctggctttggaaaatccttccctataccctatttatgtagactgaatgaaattgataagatacagtattttcttcctagactgttcaacactggcgtgaaatggttcttgtgtaggactccttgccctcttccaggtagctctctttattcagtacatgttttacatgcattctctgtgtttcaaacctgagagatgtcagaggaatataagagatggtccctattttccagggcttcacctctgggttaattactttgggacagtttaaagtaaataaactgtaaaaaaatactcttggaaaagttggtgaatgatacgtgcttaatttttcactaatctccctcgtggtttttataatgccatgtgtttttcttgggagggtttccttacagctgtatttgtgatcttgggctagaatttatgagctgccaccatgaaggtctgcctctggctttggcatcagagatggcgagttgtgtggtttgttttcttattgttaatgtgagaatttttcctaatcaaaataaatgcctatgtgtttttcctgactttcttgttggattgactaaggaagttgtgtgaattataaaaatttcttcctgaaatgaaggacaaaatttccaaagcaggatgcattgagattgtctgaagaaatgtatgtcttctggttttagtatttagacttgaagtttttttttttttttttttttttttaaccgtaataactaggaaaagtagaaaagttaaaagaaacaaaaaacatcacggtgggaaatagaaggagaaaaccagacatttatgaaaaccattctggatctcacagatgctattaagattagtaaacgttggccgagcatggtggctcacgcctgtaattccagcactttgagaggcagaggcaggcagatcacctgaggtcagaagtttgagaccagcctggccaacatggtaaaactccccatctctactaaaaaatacaaaaattagccaggcttggtggtgtgtgcctataatcccagctacttgggaggcctaggcaggagaattgcttgaacccaggaggcagtgagccgagatcacaccactgcactgtagcctgtgcaacagagcgagactctgtctttaaaaaaaaaaaaaaaaaaaaaggccgggcatggtaggtcatgcctgtaatcccagcattttgggaggctgaggcaggcagatcacctgagggcaggagtttgagaccagcctgaccattatggagaaaccccgtctctactaaaaatacaaaattagtgggcatggtggcacatgcctgtaatcccagctgcttgggaggctgaggcaggagaatctcttgaacctgggaggcagaggttgcagtgagccgagatcacgccattgcactccagcctgggcaacaagagtgaaactctgtctcaaaaaaagaaaaaagaaaaaaaaattagtaaatgttgactagtctcagggatatttgagctgcactcagtaggctactttgcatttgtaaaattctcacacatcaaattgcatcatctttggctttttgatttcatgcacgcagtctgtgaaaggctaagccaggtatgtggttacatataaacttactaccaactagcgctgtcctttttctactccttaagaggtttattggggcaataaactgttggcattattactcacctagcataagctgatcctttctttgactgtttttaaggaagatgttgttttatctgctaaaacaggtagcacgagattgacttcaccaaagcctcttctaagactttagaaatggcttaagcttcgctgctttcttagcacttttactgtataggccctggtatgtggtattgatacatacagtaagtataaatgtgagaagagaaaccacattttcatgctcttaagtgatccatgctgttttcacttctcagggtgatttttggttgtagccaactcagaaactctcaatttaatttgagattgtgtgaattgctttcctagtctgtacaccagaaagaatgcttctctccttacacatttcgacacttcttagtgaagatcatttacttatagagtgtatgcattatattagcatatggcctgggtaacttcagacttgttaacatagcgtgggaaaggttactgaaagcatgaggaggcagtatattatctctcagttgattttgtacaccattttgaatattttctgtacattccctttcctctagtgttggtttcttatacttatagtaaagggaaactgatgttgatattgttcaaaaaagaaatgaagtgaatttttgtatttttaaagaataaattaacatgctttaaagtgcttaaccagttgttacaatatcagttatcacagattggtatgcgttggtccatgttatgtatttgcctgaatcaaccctaagactggttggcttatttctgccttttcttttccaaaaggtatacttgacatgaagtagactgtgcctgtttgattttaagttttgaatatggtgggaggtatagattaaagttaatttcttttgcatatggatattcaatttttctgaaggcatttttgaaaaagctgtccattctccacctttgcattgcctttgtacttttgtaaacaatcagttgtccatgtatgtgtgagtttatttctatactctctattctgttcctttgatctatttgtctatctttatgcctatactatactgtctttattactgtagcttgctttgtagtaagttttgaagtgagataatgttacatagttttggctttttaagattcttttcactagcgtatgacttttagaatcagcttgtcaggttctataaagaatctggccaagatgttggttgagattatattgatcgtgtgatcaatttggggagaattgacagtttaaaatattgagttttcaactctcgaacaaggtctatctctctatttagatcttacttatttccttcagcaatattttgtacttttcagtatataagcctttcatatattttgtcagatttattcctatgtgtttcatatttttgatgcagtattaaatggtggtgttttttaactttagtttccagttcactatcaatatgtagaaattcactgatttttgtatattcacttgcattctgcaaccttgctaaactcacttattagttctagtagttttttttgtaggtcttactggattttctacatggatgatcatatttttagtgaatagaagcagcttatttctttcctcctaatctgggtatcttctctgtctttttcttgtctgatttctctgtcaggaacttacaggatcatgtttaatagaagagacaagactggacactcctgcccttttcctgattttagggggaaagacagaatcttttgccattaattctgagcttagctatacgtttttcatagtgccctttattaggttgagaatgttccattctaagtttgtcagaattttaatcaagaatgcatgttatattttgtcaaacaccttttttttgtctatcaagatgatcatatgatttttctttttttgtttattaatatagtaatacattgattggtttttaaatgtgaaaccaaaatgctttccttggtaaactctatttagtcatgatatattaacttctaaatagattgttggatttgatttgttaaaaatgttttaaagaatttttacacctgtgttcatgaataaaaattggtctgtagttttcttttgatctatttgtctggttttattatcagagtgatgctggcctcataggaaaggtagggaaatattcccttttcctcagtttcttagaagagtttgtgtagaattgttattatttcttttgtcttttcttttctttctttctttcttttcttttttttttttctttttttgagacagagttttgctcttgttgcccaggctgaagtgcaatggcgcaaactcagctcactgcaacctctgcttcctgggttcaagcgattctcctacctcagcctcctgagtagctgggattataggcatgcgccaccacgcccagctaattttgtatttttagtagagatgaggtttctccctgttggtcaggctggtctcaaactcctgacctcaggtgatccgtctgcctctgcctcccaaagtgctgggattacaggcatgagccaccaggcccggcctgttatttctttcttaaatgataggtagaatttgtcagtgaatccatctgggcctagagttttctttctgtggaaaggttttaaatgaaatattcatgttctttactaaatattgaactatttatgttatccatttcttcttgagtcagctttggtaatttatgtcttttcaaggaattttttcattttatcaaagttgttgaatttattggcataaaattcatataatattccttcattatccttttatatctatagaatctatggcaattctatatctgttgatagcctcctttcctcccctcttctctctctgtcatatcagtatgactgggagtttattaattttattgatcttcttgaagaacaagctttattttcattgatttttctctgttgttttatatttcattgatttccttctttctgcttactttagttttactttgcttatttttctggcttttaaaagtaggagctgagtttgttgatttaagatctttcttctcttctaatatagccttttgatgctataaatttacccccaaatattactttagcagcaccccaaatattctgatctgtggtattttcattttcattcagtttagagtactttctgatttcccttgtgacttctaattgaaacactccaaatattttaggggttttccagggatctttctagtattggtttattacattaaatcagtcaattaattaattaagagacaggatctcaccctgtcatccaggctggagtgcagtggcgtgatcatagctcattgcacccttgaattcctggtttcaagtgatcctctcatatcagcctggcttttaaaaatcttttgtagagatagtgtcttactatgttgcccagcatggtcttgaatccttgctctcaagcagttttccctccttggcctcccaaagtgttgggataacaggtatgagctactgaacctggcctggaattggtttcttatttaactccattgtgatttaagacagacaaacactttaactgggtatggtggtgcgcctatagtcccagctgcttaggagatggaggtaggaggatcacttgagctagtagctgagtttagcctgggcaacatagtgagaccttgtctctctaaaaacaaaaaacaaaacacacctagaaacaacattgcttgtatgacttgtatccttttaaatttattggcacaattttatggcccagaatatggtctttctttgtagatgttccctgagcacttgagaggaacgtaattttcttctgtagttggtaggaatgttctataaatgccagtcagcccaagttggtttatagtgttgctcagttttattatatccttacggattttttgcctgcttgttctatcaagagaggtatattgatgtctctggctataattgtggttttgtttctttgttcctattgtcctgtgctattttgaggctttgttatttggtacataaacatttagggttatgtggtattgattgattgatccctttattattatgagatgaccacctctatccctggtaatagtctttgctctgaaatctatctgtctgtctgtctgtctatctatctatctatctatctatctatctatctatctatctatctgcctgcctacctacctacctatatctgtcagtcatgtatctcactttattatctcttttaattggagtattttccattcaaatgttaggtttgagactttcatgttgccatttgttttttgttagtcgcattttttttccttaccctctttccctgcagccttgagaatgaataaagtatttaagatttcattttatgtcttttgttcccatattagctacaattattttcctcttttttttgtggttgcattagggaaatactatatatacactatatataataaagatatataaatatatataaaatatatataaagatatataagatatatagtatatataagatatatcatgtatatatagtatatacatataaagatatatataaagatatgtaagatatatagcatatataatatatagtatatatctatcatatctttatatatataaagatatataacatatatattatatatatacagtattttccctaaagcaccacgaaaaacaaggaaataaaaaattgtagctaataagggagcaaaagagataaaatgatatgttaaatactttattcgtccacaaggccgcaagaaagagggtaaggaaaaaaatgcaactaatgaaaaacaaatggcaacatgaaagtctcaaacttaacatttgaatggaaaatactccaatatatttatatatatatatatatatacatactatatatatctttaatttacagtggtctaccttcacatgatgttatatcacttcatgaataatacaagaatattatatttactcttctatttacttacatttacgcctttatagcctttatactgtcgatgacatgagttttacttttgtatttgttaaaaaggctacaaaacattgttactatttctgcttaaacagtgaattatcttttaaggatattttaaataattaaaaaaaaaatcttgtatatatccccatgttttcacaggatccttagggtgtcacttcgtcagccagaaacctctgtggccagcgttgcctctgcttcagtttttctcattcctgctgggctcattccacccactctgcccgacaggctgcgctcagcttgtgctaccaacctcggtcctacgccaagggtgagccacatgcagagtggcaaggattgtgtgagcaagtgagcgcagggtctggccactgcacacagccaggcttaacggctgctgcagtggggagggcagctccaggtgcccgcacaggtaccggccccatgtgaggctgtggctggaccagatgtaccacaagtggcttccactgtgggcaccaatgtctctggatgaggggaatgcagtggcacctgaaagtgcagagaccgccaggaaccacagagccccaaagaggggtattaccgggctacctgaagggctgcaggtcttctctccttttcattgcctgtggtggtggggtgttatcccatttgtgttacagctgtcttagtcttgccatctggcaggtcccaagttcttgtctcacatccaggaagaatgggttatgtggacaattgtagggtgatcaaggcagaaaggaactttattgagtgacagaccagctctcagtggagacctgaagtgagtagctcctatctgcaggcaggtagtcccagtgagtccctgagtctggctgagtccagggtttttatgggctcagaatttaggaagtgtgtgctgattggtccatgggcagccatgggtgggcctggaaaaagcaccattctagtggccaaaaggcatcaaggaacttctcactcggggttatggactccactcagaactggcagcccagcccacagacttcatgccatccctgccttgaaggtgggatttcactgcggacccaccctttcctgccttgggacctgtctgcctcctgccgtgatcaacatgctgtccacagtaaggctgtctgtgccaggaggcacctgcaggcctatactgagctgccctcagcagctccagcctccctcctgtgcttacacccaatgtctggaggggcctgaggtagcagggggctggtataccagcatgaccctgagtgtgcacatatgccgctaagtcataacagtgcccagattggccacaactttgctccatgctgcattaggcaccgagagagcagggagaggccagagaagcaggagcaggcacttctgagcctgcagggcttcccgagcccccaagaacacatggatgcttgggtctgtagccacatctaggcagctgcagctgcagctgcacctgggagtgtgggttcctgtcccgccaactctgtaaggtgcagggctcctgctaggatcacctgttcctggcccttgctggttctaagtgaacaggccttccccactgcagcgggtgtcctcgcagtggccaatccagacgggccaccattgccaccatcaatgtggttaccatttcttatgcccttcatttctctgggtagatcctatttacatctgagcgtttttcttttgcctgaaggccttcttttaacatttcttactgagagaatttactgatgatgaaatcattcagcttttgtatgcctgaaaacatcttcactttgcctttgttttcaaaatttttttctgggaatataattttagttggacagttactttttcttttagtaatttaaaagtgttgctctactgttttctcttagtgtttgccatgacaaaatttgtgtcactcttagtttctggtaatgtaacttgtctttttttttgactgcttttaagtgttttctctctagtgctgcttttgagcatttggttacattgtgccttaccctagtttccttcatgtttcttgtgctttaggtttgttgagcttctttgatctaggattcatcatttttatgaagtttggaaattttgggttattatttctttaaggttttttccccttctcttctgctttaccttttcagggactccaattaaccagatactagatagtttgaactcttcctagagtttcctgtgctactttgatttttcttcattcttttttctctttgcatttcagtttggatagttgctgtgtctcaggttcaccagtcttttcttctgctatgtcaaatctgttgttagtcctattcaatgtgtttttcatctccgacagcagtttcatttctaaagatttggttacagtgtttttaaaaatacttacaagtctctatttaactgtttgaacttttggaatacaggtacaatgattgtttcagtgtccttgtttgcaattaacctcagtgccacttctgggttgttttcactttattgattattctactcattatgggtcatgcttttctgcctcattgtgtaactggtgatctttggatgccagacattgtgaattttaccttgttggatgctaggtattttggtatttctataagtcgccttgagctttgttctgggatgcagtaaagttacttagaaaaactttgatcacctggagttttgttattggcatttgttaagggaaatctggaaaagagcttagtctaggccttggttattcctcattacttttgcaagacctttttgagtattcaatctaatcatctgtgaagtatgagttttttagtctctctcatgggaacaggcactgttcagagtcctgtgcgagtcccaagaaatgttctctataattcttttgggtgtttctttccccagccttgagtagcgtccccctgctttcgagccagtctgtactgtgttgcaggtgaaccctctgtagatctccagggctctctctctgtgtaattctcttctctctagtcctctatcctatgaaccccagctgccttgatgtcctcagactcaactctgtctcctcaattcatcgagttggcctggttctgccccagtttcatctcctggtattgcaccctggaaactctccagacaataaggtgggtcagttatagggctctcatttgtttcctgcatctcagagattactgtcattagttacttcatgtctggtatcttgaaaaccattgttcatatatttttctgagtattttttgttgtttcaggcaggagactgtatctagtcactgtttctccatcttgaccagaagtggttctcccatatttcatttaacaacatcatgaaatctctttcagccaagctcaagaccataatttgtccttctctgccttctcttttgacccaatgccttgttctttcagtcttgtcagttcttacttcctagtatatttgacattcttttgtacttaatggtaaaaatctttaggtaaacatcatcattattaacttacactaaaaaatagtaaaatcattggaatggagggaatattgtcagaatagttataagttttggtgccctatcccagtgccatctttaaggtgagtattcagggaatatttcttatacatcttaattcagtgtaaaatttgcatgttttatatgttgatagagcagaattatttcaggatgagtatatttgtttagatcttttaaaaaatgtatctttagggaggtttgtgcttttccagactgagccagaatgctcgtactgcattttggatttacacacacacacacacacacacacacacacacacactacttttttactttccagtttcccctgttacttggtgtgctgcttgaaaccagacttgccattcttacatctccagaacctcataccatgcctggcatagtggcactcaattaaggtctgatgatttgtactgagtaagctatagttttaggcttggagcattgttaaggctttgcatagaatctctgcattatacagaatcttaactgtctctacattacagtataatccacatctgcatctttgcagcttgctattatacatctttggtttgctgtgaaagagctgtcagagaatgagctctttattgcttagaattactagttaactattgttttgccattgatcagaatgtctcctttttctgttctgctgtattcattgtggtattttgttgtaatcagagatagtcttggaggtgcaagacttattggatctccgtttgtgccattgtcgcaacatcactgacttggtgaggatcagtcaggggtttcttccttctgtttttgtcatggcagtcttactttttgaaacatttgtcaccttctctgatcctgcctcctgcttttccccatctgcactctgacctatactgttttagaaggaaaagataataaaggtcagattttataaaactctgttcaagaaatactgcataaagggctcttcaagataaaagactaccccgcttgtcaggcagcctgctaatttgagagtgctgacgacttaccttgatgaggcaatcttcgaattgatgactctttttaattaattgtcttttcattgataaaacagaattgctttgttttccttttactgcccatctcttcctcacaaaatatgtttcctctccgaacacacaaactgtgttttcagaatctcccctgagtctggaggtctggacagtagtgtgtttgtgtgcttgtgtgtgtatatgtgtgcacacacatgcacagcttgtgtgcatggtatctgtgatttctgtgtgtgcttatatttttcactattttggattcatccagttctataaagacatacttgcttgctttgcatggttctggctccctctgcagccccaaatggaaaagtgctttgttgtcttttgttgctgaaaaatccagctctcggccttctttctttgagtagagcatcccagctggtatacaagtatagattggatttcagatttagcaatgcattgtgttttgacaaagcttattgaagatggaagtcatttttcaggagcgctctaagaggtgagaaaatggcaagggagggtggggaggaaagggagaaaatgcagaagaggcagacacaattgcaacattgatttggtaaatagaaagttaatgtagctacaggtattgacagtaaactttggctaagatattggagaattgcagattggaaggctagagctatttcagaatttccagggccattttattggattatacaccttagaaccttaacacacagcttctgttgattagtacagtttggcctccagtgtgagtttggctttgaacactcagtgtgactttggctagggcttggcacctgtggacttcagcttctactttagtaaaatgaatgagttagaacaaataattgttacattcaaatccagatttatgagtgtacgatagtggcttcacattatttgttttaagttaccgttgagaatttggttctcagtaatctagagctactattttagcagaattatacatgggatgcagaatagaagcttttaagcaacagtcaaccagattggtctataataactccaggataaatacaagaagaatttctggacacattttgccccagtgaagtaaaattatttacattcaaggatggatttggaaatgcaggtatttttctgttgatctgcacgttggttacactggtgtgttcagtgtgtaattacacttccatgcagttatttttgtttttgtgttagatttcaataaactattattttttctaacagatcttaaactttaatgcttctttagagtactaatcaaagtactgttacataagtaatggctcatgtgtgcgcacaggtgtctgctctgtgaagtagtccatttcaaattataccacattaaattgtgtctgctttaaagggttaaaataagtacatgtatatatttagatatataagatgacttctatttaatagataattagaatgtttatgtaatagatttatgctttcagagatttcatattcacaaagtaagttttggaaccttgaaacatggataggtcagtgtcatttggtttcttttttcttcgtttaatccttttcaggacttcggctccctgtgagttgttaatgtatagtgtttatgaatccaaataacattcattaactttcttggaaggtcacagttatgttggttctgttcgaaataagtactataaattttttagaataaaaaaggaaagtattacagtgagttttgctatccacttgccactttcctttcccttcctttttttgttttttgttttttgttttttggtagggagggaggtctccctgtgttgtttaggttggtctcaaactcttggcctcaagcagtcctcccacctcagcctcccaaaatgttgggattacaggtgtgagccattgcacttggccctttcccatttttgtgcttgactagtataagtgtcatttttgttttcttgaaacctttgttctttcccatgtgaatacacataggatgacaatagtcacaaaactctttccgtacttagaagactaaaaccagaaattgttgcttgaacatgtaatggataattgttaaaattctgcactggtttgtactgttctcgaatttttatgtaaaggtctagtttagagatttattatttttattgtttagacttaaaaggaaaacagttagctgcggaatctagtttttatcctggagcgaaactcatataaccttgttgattttagtgggaattagaaagttcagactctttttttagaggtctcccaaaattgtttccactctatgttgaaaggaactctaatctacagaagtggaggtgacagtaaggagggcaggggatgctcttcccaaaggagtttctacaatgcagctgagttagagtgcagtagaaagagcgagatctcatagtggcatgttcctgtcacagcatgtgtatagcagtcacagactctgaacccaaagactgtatttctagttggagcagacattgactcctttttctgggctgaaaacagtgaagtgtattggttttggtagcttgggttataagaaacctaaattagtttgaagtggaattatcctgatgaaagggcagttgaaagcccttgacactggacagaggattgtctagtgtctaatcttggctcaaaatgcaccagacataatgagagtcattatgaactgctgatctcctacccctcccctcagcagaccctattagacttgcaaaaatagcaaacactgtgtgtgtttggcatggtgcctgctgtgtagtagaggaagaaagcgtaccttgtttgcaccacaaccagatactggtgcatcatgttacagctctgcttggttctgagctcctctgttcaatctcgtcttgacagatgctgtcgttgccaccccttagcaagacaaatgcagccactctgcaggagttggcttttgcccagctgtgcttgccagggccccaaactgatgtgcgtgtgtacctgtggaaaggtaacaggctgtgggtgtgttatcctctgccattatgtgcattaccttttgagtttttgccattcccgaaggaaaagttacggttttgtttgttcagataaatctgaaccctcaatttctcttactgcttttttcacaacagatgttgttaggcacccactaaagatccccaggaagggtccctgccccatataagctcactttctctgtaggtagaaagaaatgcaaacagtcacataatcacaaccttaatagctatgtgtataaaggactctgggaaaaaaggacggaggggatctttggaggtgcatgccaggagagagttgtctcatacgagctatgaaggttaagtattgcttaggaggtgtagatatatgtgttgccagggtccaaggtgaaaaaggagaagtggtttgaaatgagcttggtgaacctaggtttgggcctggttttgaaggctactggcaatagggaatcatcatagaattttaaactaggtgagtagccttttcaaaatttttttaggaagcattattctggtttcagtctggagaataagattatataaaaagtgctgagagttggaaaagtgccagcctattatgttgggagaaggaagcatggagaggttttagatgtgaccattagttcagatagagtagtgaagggagataggacttaaccaacaggaagagaaattaaagagagtaagaaaggaaggtctaaggttttcagctaatactccccaggcatagtatttatagggaaacagggaaggtagatttcagtttggggcagactggatttaaaatacctgcggaatatgtaggtattaatgagtaaatttcagtgtgaagtttgtacccagagttgagaatagagcaggctgggcacatagggttctgggataattgatgttacaaattagagtctggtttagcggttagagccatgagaccctctaatccaagtttgatgtcccatggcagtttgatgcaggatgggaccaacattatagacctactgttacctgctaaaaaaggcatttagtatatttcactcctgagtccagaaagccatttaccaagagcatatctgaatttgtgcggcagggaataatataacaatgagttctgtgtattcacaatttaggaattaatttcacaagaccacaggttggaaattcttgtcctctaatgggattgagcctttgtggaaagagtgtcacctgtattttcctcatctcagtagatgaagtagttactgtttctttcccacattcagccaatagcatacattttgtagaaagcaactaaagtttttcctccaaagctttaggcctcttctctttcagttcctcttggtaagacctggcctgtattggtcagtctgcctgttctttctacttggcttacaccatctgcccattgggacctacagattttttttgttttgttttgttttgtttttgagacagagtctctctctgtcgcccaggctggagtgcagtggcgtgatctcggctcattgcaagctccacctcctgggttcacgccattctcctgcctcagcctcccgagtagctgggactacaggtgcccgccaccacacccggctaattttttgtatttttggtagagatggggtttcaccctgttagccaggatggtctcgatctcctgacctcgtaatccaccagcctaggcctcccaaagtgctgggattacaggcgtgagccactgtgcctggctgggacatacagatattttttggctgcttataagtttttgttctcctaggggatttctgggacacttaaatatgattatatccatcagtgaatgaacaatccatagagttgacatcagtggtaaatacagtaatgtgagagtctaaaacgtgagccaaagttccatttaaaagatctaaatgcaaattatctcactaaacttgagaattattgatcatctctgtccctttctcctttttctctcccttttctttccgtcgttcctccctctcttttccctttaccctcttctcttcctttccccgctccctgttctctcttctctttcccccttttttcttcccctccatcttactttcccttctctctcttctcatttgatataactgacagatttgagcagaactgtgaggctcttaggagctgtgtgtgatgtggagtggccagatgactttatgtgagtatgcacgagggactgtaaagaggctgtccagaggccagcctccctccaggttgttcctaaccctggagagtcatcatatgttatttctcatctcagactgccacagaattgaggagggagattgaaggcagctcattaaaccactttggccacagataagagtgttaagagattaagaagtagatttatctgggggaggggtttggtcccggatgaagccttttcctgccgtcggaaaccaaagatttccttgtctcttttgttctgatccatggaatggtgtggcttagctgcctctaaatctgttttggcaaggttgtttgtaaggagacatggcagggtctgtctggagggaacagaaaagagagtacatattgaatgtagatgcttgaaactagatcatagtttacctaattgcagaccttgaagaaactcttggggccacttggatgggggtgcttctggaagtttgtctctgggggtatgtgagtatggacctcttccacactgagaagagggcagagcccagtcatcagttttcatgtccctgagtacaatattaggcttctttttattattatcattatttcaactggtaacaatgtttcccctcaggaaatgtctttacctctctgaagagaagaccgtgatgccagctgttagtttgagaaatgctgcagggtcctctcctacctgctgtttctgtgctctttccatgtgttgtggtgaagcccctacctctccagccatggggccttgttcttcatcatttgttcctatcttcagtttgggatgtggcaaggagaggcagagtgcactagagaaatctgatactgtaatgtgctaggagacagcatgatgagaggttttgggtgggaagtccatgctaaacatcttaaatgcttcagaaacttctttacagaattctctgcctttaggattctcctgttcaataaatatatttttcaccactttagaaataatcttcttaaagcccttccttgaactcatgcatctgtaatgactgcccatgaccagcagtactacattgtggaatgcaagacctaattagtctaagcatgaaagaccttttagtttcatcagctaagcccccttgtcctcccaggcattcctctttccaggtgctgtctccttctgcagcttcccgtaggcctcttcccactgctctttctgctcttctataaaactccacatttaatgcctacaccttaccaaactccaggaaacttccttgactcttgcgggctatatggatctctacttattttagtttttgctgttgcaggaggaaagtatgatttttaaaatacaataatccttttgtatgtctacagaagaatgtggtttggtgagttttacatttgatgcatgattgtatccaccattgtgagattataaataaatctcaagacatgaccttgccctgaacccaaaactaaacatgaatgaaactatagaaataactggataacctctggtacatagagggtcggtgttacagggagataagcagtacaccctaacctagggaagtgcaatgagcagagaggggatggagtatgtaggtggagaagtggctaagtgtcttagatagacaaggtggaaccaaagtacatagagcctggaagctgcagaaaagaacgtaggctaagaaacaagatcaattataggtggttgagtaggtgagtaagacagaaatgtgtgaggtgattggaagggactgctacgataagccagctgtgcttacaatggtgaagataaggaatggtgacttgggaagatgtattggagaaaaatgatagggcctgctgactgagcagctcaagctttatgggaactgctgatcatgtttttaactgctatagatatatttgatttaagtaaatcaatttgtaaagatttagatttcataatgatatcttagaccatatttgcacagcaagtgaaacttaaatactcttgtatccctatcacatcatgttatctttaacatgtgtatcaactttcttacctataaatgctggtgacacctcccagttttctaggcttaatttgtagagggctcaacatgtgaacaatgaatttggtgcaccattcaagaagtaaaattcaatcatttttttctcctattcatttctaaggataggaatctttgccttatagaaatattttaaaggagcccccttaaatgtcacactctctttaggcttaaactattcttatttccaaaatgtaacatcagaagttcagaaattctttctacttaggttctctgtgccccacacaacctcacatttttgcctgagtctccccagtcttgctgcaggagctggggtagcttcagcccacttacatcctgccaggggataaacttgataccttttgctttcatgaaacactatctgtgtgaagtgagctctttgatccacagtcttttatgctgaagctaagggaggattaaggaacacctctgagttgatgaatatttgatgaggtttatataatttaaaattacactcttgttaaccctttcactcaatggagagagaagagaaacttgtataatcgtggttcctacttaggcataaggtactgtgtcttctctgggtgcatcctccttatctatgtagagcagagcatgggaacttagtaaatgtcaattgatgattggcattttttacagcttcatagagagaaatatctctttgcttcattataaccatactgagtgagatgctgaagtggaattgggatcacacagtatctgtgtatttgacattgcatgtataatggtgaacaaggcagatattccactcatcataacaacaacagtagtaatcataccaccaggaagcattctttcagtgcttactgtatgcaaggctctattctaaactcttttcatccattttaattcttagaacaaacttataaggtagatgctattattatcatttctattttataggtaacacaacccaggcacaaagagactaactcccacaaggtttcacaacttacaaatagcagagtcaggatttgaacctgggcaggcagttctcagagcctgcgttcctaacttctggctggacccctcatggtgagaagggcagagagttgacaaatcctctgaagtatggtgagttctgtaggagtctgcaacagggcgaattaacctagggaagaggaaggctgggaaggctttcctgagaaaatgtcttttgggatgaaacatgaaggatgagtaggtgctctctaggtgagggctcatggacaaaactattccaacatgtgtagtggccacaggctggacagaataaaataggtgatttggaggaacaacagagagaagcccattaggggtagagaaagtgagagagtgtgtgtcatggagtgatgccacaggggccaaatcatgaagtcctccgtaggtcccacttccaggatgtgggtcatggaaatataaagggctaaggacaaacggagcattcaaggggtagaaccatgggtataacatgatgagatgtaagctttaacgtgtttctcactagtgatgtgtctaagtcatagagggagacagtagaggacaagagtgcagtcaggcagctgatgctgtaatccaggtgaaggaggatggcagcctggaccaaggtagtagaggtaaggatggatagaagcttaggagcttattaggatgcagataataggagttctggatgtgggagatgagggtgagggaggaaccagtaacaatgcctatgttaacagtcagaagaaggttacaatgtaaccagactggaacatgaacaaattatctgcagtggagcttatttgctcaaaagaaggatcctgcaagagaacatggatggcttgtgtcatccaaatatggatggctttgcccagttagagaataattcctgctgagagaatacacatgcacgcaagcatgtacacacgcacacacatttgttgtagagggttataccctcccaagttaaggtaatttcataattgaggtcgaccctctcgatgtggtaccattgataagccccagcactacagttcagctaccaacactgagtttctcattgagtcaaagcgtgggatgatctgacagcgtcagcagcactgcacaacagtgggagggacggatgaatgccacatctataaggaattgccacttggattcaagaggaaaaggggtaattatccacatgggtaacaatttcagtttcatttctcccttgagctaactctattcacctcaaacgtctttcctgtctagagaaccaccaaaagtgtcattctgattaccatttgtaactaggtgttttctgcttaacatttggaactgggtggggtgagataaattccaagaagatgggaagtttttatattgcagtttatactacagcagcagctccagtctgccctacagaccttctagattttttttttttttttggctgtgtgacaggtgcctgtggagtttatattttgatatttgatcaaactttttaaacctgagcttgtagtaaccattatagtcgtcatgcttgagaatgtgtatttgctagtagtatagagttaacctcagtttatgggggcagggattactttgtgaggaattaaatgtggtgtttgaaaaactgggaagtgaagatcttctgcaacacaggagtttctaaaggaaaaacaattgggccagactggatgaactggttagattaaatgctatcttcctgactcagggttattatttttggttgcttattttatttttaattgttgaagatttattgtaccatgctttgctcaggacagtgtgtaaggtatttagggaaagacctgaaagagacaggaagcatgagcccttccatcaggcacctgaataactgatggtggacatattgagaatacgtagaaaatttgtatcttatggtcatattgcacttcagacttttcacaatgcccttgtatctctgttacttgattctagttttcttggctcagcatgcacagttgttttctttacttgtttatggtctgtctctcccacttaaatatcaggtccttgagagcagatacttgttctcagctacagcccagcacctagatcaatacctgacatattgtgggcactcagtaaatcttaggaggataaatgaacaaaaaacctatcttctgaatatcagtgataatcatataaaacaggcttggtatgctaccatttatgtacttctgattttgtgttttgacaggttttcacctaaggtttgtagtagttggttttcctcagagaagtttttgggctatttttctttttaagaaagggtgagtgatgtcattatgaagttgaagctataggactaatcatatacttgccctgcatctatggtgacttttttttctactggaaagaaagcccgctattaaataattattacttccaggtctgagggagactgtccagcatctgcaagagttttgctaggatgcagggctttgttcccccactgggctgtgattccatccatggagtaagctgcattgtggtagcaagtcatcttgacagtggcaagtatagcatatttcaactggtgatttctgcatgatttgcatgaatttctgtatgacaggagtcacaacaaaactgttacgtgacttgtgtctaaagctatcagtcagctggagctgtgaaaatcagtttgcatgtgtcaacaatttaatcttctaatatgcttgccaatagaaaactgacactagaattatttttctgtatttactgactagaaagatatggttatcaagtgcactgattgaaaaatctttaaattccagtctttaaatcgggaccatatgtgtgttctttccctagccaaatctatttgtgcattcacccacacatgtgtatacatatacacacacagtacagttacattgatatgtgtttgcgttatatatgtatgtattcacacagagcatgcatatgcctcatgcatattcatgagctttaaatgtgcttatagattaagatataaggatgttggggaagtttccctatctgttaactgagaataatactactgcctaccttccaagcaccttgtaagaattaaattagttaatataagtaaagttcttagaacaaggcctggaacatagtatgtttcctataaatattagcttttattattttagagtatgtcttcattctgtcagcttcaaatgggcttcaaaatttagcttcagaggcagtatggcaaagcctcagaattattgcataattcatttgatgaatttactgttattctaaaatgcctgcaaacaatttatatgtcatgcaggaaatattggtatttgtatttctaaatcaaagccatttattaaataccttagtcatattgattcctgttatagtaaattacttctctttctatgtcatcattatctcctagggtctatcagggagatattttcagtgaatttgtctttcattatcagactaaaactaacttcactgaaaacatcttcatttgggatttgaaagagaacaaattttccatttactaagaaaaaaataggtgtttgtgtattggtataaaaataggtatgtatgtaagtgatcaaatagaaaataatgcaaagggacatagaagaatttgggaatggaggtaacatacacctagaaaaacagtgacaagggcacatactattttgaagcaggttttagcaggtaatgatggtactcactgtgggaggaaggtgtgaatcatcagtcaaaacgagtgtacaaactggtgatatgaaatgctgcttaacagttgttttaaataattagatttttgttggggataaatagttcattccagacaaaagtactagggactctatagctcatctaacttcatagattaaaatgaaggcccagataattaaagtgaagacctcagagttagttaatggaagtgcaagtttcaaaaccaggctgcgatgtgggggagacagtgtcctccatgacagctctttaacagatggcatagaaactcgacttgtgaccttgaggggctcacttcagctctctaagaataattccagcccagagctacaccatatatagagtctgtagactattcctaataaaatggttttcttgtcttagagaagagaaactcagcacatacctactttgagtcaggtttgggcatgctcgaaaagggggcagcgtttttagatggagactgctggagtagactcagggtctctttcagcatggctgcctgtgtgatttgattcatgtgcactttaaaaacctgttttatctaagtgtaagactgtagaagacatatatatttagggtattgcattgatttttggaaaccatttgtgtagggtacagtatctttgaatttcactatagtaaccgagttacaaaatgggccactgggtctgctgggctgagaaccatcaaactgaatggtcagcaactttgttcatgcttcatctactttttcttttcaatcatttggggacagataatcttttggtcgctttttagactaactttgagattcagaggggcagtgtattcttggctaaaactttttgtacgaggcacactttcttttaaggtttgtgattttacccttacgtatcagatttcatggtatccaaatgcaaacatgtatttaacagttggtagggatgggagagtttgaggacagcaaagcagcctactttgatgaaagggtcagatagattttaggatctgcaccctttcttagcatcctaagcattttgagaagcagttgtatgtaggtaaaaacaaacaaacaaacaacttggtagttggtgtcagctgaactgctttttactgaatctctgctgtactagctgtgtggctctgaggcttacttccctagtctgcaaagtaaaggtaatgatacctgtttcacaatttaaaaaatagatttattgaaatatatttcacataccataaaattccactaatttaaaatatatagttcagtgattttagtatattcacagagatgcagccatcaccacaagcaattttagaacattttatcacccatgaaagaaatcctgaacccaaaagggccatttcctccctaacttccctaactctaggcaaccactgatctactttctgtctgtgtggattcacctgttttggacatttcatataaatggaattatataatatgttgtgttttatgactgccttcattcacttagcataatgttttcaatattcatgttgtagcatgtatcagtacttcattctcctcaccccccagctttatattaaagtataattggcaaaaaagtacatatttaagatgtataatgtgatgatttgatatatgtatatattgtgaaataattagcataatcaggttaattaaacaccttaatccaaatccattgccttgcatagttaccattttttgttgttgttgtttgtttttttgggtttttttttggtgatgggaacactaagaatctactcttctagtaaatatcaggaatacaatacaacattattaacagtaatcaccgtgactgtacattagatcttgagaaagtacttattttcacaaagtttgtaccctttgatcacatcttcccatttcccttgtccttgcccttggcaaccaccattctactctctgtttttatgagttggatttttttgttttgttttgttttcaagatgggctcttactctgtcacccaggctggagtgctgtggctcacggcagccttgacttcctgggctcaagcaatcttcccacctcagcctcctgagtagctgggattataggctcgtgcccaccatgtctggctggctgattttttattcttatttttattagtgacagggtcacactatattggttaggctggtctcaaactccaggcctcaagtgatcctctcatctctgcctcccaaagtgctgggattataggcgtgagctaccacacacagccgaatttgatttttttgaattctacatgtaaatgagatcatacagtgtttgtatttttatgtctgacttctttcacttagcatatgtcttccaggttcacccaagttgttacaaactgcagggtttccaatggtgtgtagtaaaggggatccttgtatcgtgttgataggaatataaattgggacagcattatggagaaccgtgtagaagttcctcaaaaaattaaatatagaactgccgtaggctttatcaaatctgcttctcagtatatatctaaaggaaatgtagtccatgtctcaaatagctatctgcactaccatgttcattatggcattattcataatagtcaagacgtggaaacaaccttaagtgtccattgatggatgaatggataaagaaaatgtgatgtgatacacacacacacacacacacacacacacacacacacacacacacacacacgcacgcacacagagacaccctctgttatatgtgtgtattgtattatggaatattatttagccataaataatgaagttcactaatttttattgccaaatcatactccattttatgaatatatcacattttgtttatccattcatcagttgatgggcatcatatttttgtgacagtgaaataagacgaagtatataaagtgctttatgatgtcttgaatatagaagcaacgtgtgttttgttgtttcttttcgtctggttggtagatttctggtgaattatcagccgcccctcttgccttgtgaggcaaggaaagcagtcttattgagtagaccatctgtctgccagttctctcatgttagtcctcaactcatggaaaatcctggtgggcactcgtttgatactagaattcacactgcttttttcagcagccagaagtgtttgagtgttaccagcagtgcttgttgtcgttacagatgctccgtacaaaactgtaaatgctgggtttaaagggattgagggagggagccattgcggcttacacagatgtcaactaatctagtgttgatcctcattctgaacctgagcattgacaccaatatcaagctgtggggtagttatgttgtgtgcaaggcttggagggaaatagtgctttggcagttcagtgcttgccgacttcacaaaacacagaaaattgctgagggcttatgtgacagaaagttcatgttacacatatgggcatcttggcgagaaaagccactgatcgtctcagtgtaaggatttggaatttcaaaatcctaaatgattactaaatgacaagtaaaatcttgattgagatagatcgttgctaacgtccaaagagattatctaaaagcattgatttttattttgttggctgtggaaataccgtggaattcatttattaaaagtagtatgtctaagtttctacttattttagatactgtaatataaaattataaacaaggcccaattgttgttacccactaggcagatttttttattatccaagtttctgtttcgggccatgaaacaagttaaaatcaaaactttcgctggttgccattttaaagataaatttgttatataggctttctaagcttggttgccttgctccacaaagacaaaacattaataatagcttacatgtattgagcagtgaatctgtgctaggctttgtgttaaccactgtatatttggattatctcattgatctaaggtaggtacggttgttattcccttcttataggttaggaaactgaggctcagagagattaagtaacttgcccaatgttacacagcttgtaagtggcatttctgtttaaagcttcccattttataaagttttgtgtttttaaatatgctttagaattttaagtttttactctgttattatttcgcgaagtcctatgtctacatacacatcaaagcaattctgtggttcttagggaattatttaataaatgaaatagccatagactgtaattacattatgagtggcatcttttagctgtgcccagcggtagcccagttgctaatctttatcccttgagtagtcaagtagataagaagtggataagcaagtggagtggtggccactcaagcaggcctccaccagaataattccaaataacttcacacagtgaattgcaacccactcaatccacttcactggatagcattgctcaaaagatattcttttactcttttatctaccttgttggcaagcatccccaagaggtcttatgcctgtggcctacagatcaaagatattttctcaaatactgggaactttgctgctagttagaattaagcaaataaaaacatacacctccagaatgtaagcaaactagtttaaaacactccagccattgtattacttatgctttaaaagtttccccacaaaacctcattaatcatataaatattttgacaaacagaaaggggacagagcagacttattattttccatcttgtatgaatggctagacttttcatctgtgctcttatcctaacatgtctttaactcttctgtgctaagatttttatttaaaaacaaggaaattgagactcagtgagatgaactgctttatatcactgtggtaagatgtgttaatagcatttgaaaaggaaaagccaaaattttctttcatttatttatttatttatttatttatttatttatttatttatttattttgagacagagtttcactcttgtcacccaggctggagtgcaatggcatgatcttggctcactgcaacctccacctcccgggttcaagtgattctcttgcctcagcctcccaagtagctgggactacaggcatgtgccaccacacctggctaatttttgtaatttttagtagagattgggtttcaccatgttggccaggctggtctcgagctcctgaccttaagtaatccgcctgccttggcctcccaaaatgctagaattacagacatgagccaccacgcccagcctatttcttgatttttattagtcacctagccttattgtaatttgcacttatctaccattagaacatcataaacccaagtgatgaacagaatggatgtaacttagtgcgtgtatgtaatgcatatgatgtaacatacataaagacaaatggaaaatgcctgcaagatagtttccctgttgtctcatgcctcagcagtaatgaaacatatactgagtgcttattgtgggtcagttactgtgttaaatgtttgtcacgaatcatcccatccagttctcacaatcaacctgtcatgtaggtgctatttttgtccacatttttatagataaggtggctgagacttagaaaaagctaacaccacttgcctgtggtcatagagctagcaattagcaaagccattgcttctaaccagtgtgcattttgccttgcacaataaactacattaaaagatttactttagtttttctacctcccaattgaagccactatcagatatatagtctaaacttagatttgattctgtttagaaacacttaatgttcctaatgttatcaggaaatttgctgttcattttttcaagatctgagtagaatgtcacattctccatgaactttccatgatgctcttcttccaaatgtttctgtagcacctggttgtagcctggctcttaggattcccctgtctgtgctctggacttctttagaagcaccttgtctggttcagttactgcctttgtttgtattgctggcacattcctttgtgcttggtgcatagtagataattaatagatatttgttaaattgaactggatgcttaataaatgtttggatctaattatgatcttaactctggtgtgtacttcaggtacttcaggaaggtcattgcagcattagatgactatggagaccctcagtgttttagactgagatgacttgccattcctacaagagatcaattgaatgaataattggggctgatttttccctaagtattgcttagaacatatactgttttttttctcctcaaaaattgccagttatattgccatactggacaaaataaaactgttagctatatatctatatctatacctatataaattttaaaaacgtagcacaaagtttctgcaccatactttgtgagcagctctgtgtattccaaggctcagaaaatcagactttcaaagctaaattttaccaatatatatcccattgaaatttgcatgagcaagcagaaataatgtggatgttggagttaggtaaatgaatcaaatcctggttcagccactttctaggtatgtgattttgggcaagatatttaatttttttcaacatagtttttttatttttaaaatggaaaagttatgcactggcagatttggaggatgaaataatatgttgggagacagtgtgttaagttacttctcaaaaagttctattataattataggttgctaatttttggcatattttcattttaaaacttttattctaatttcattcttaaacagtgtaagcatattcacagtagcttttctgatcaccttatacccaagcactgccacatgacttctggtccagtgttccaagtgaaggccaagtaatgtcaaggtatgctgtatacggattttctaggagtgtgaataaagaagaggaatggagccatccatggatggcaaagtcatgccgttgcaataagtactacatttacatatttagtacagatcccatcttagaaagggtggatttggtcgggtgcggtggcttacgtctgtgtgatttcagcactttgggaggctgaggtgagcagatcgcttgagcccaggagtttgagaccagccaggacaacatagcaagacctgtctctctctttctctctttttttttaaaggctccctgctcatgaggaatggggagagggaagaaagggtggatttggagaaggttatagcagtgagtatggctgtaaatttgcaaggaataactttttttatttccaacagtgattgctttagataaatattttattgtagatttcaatattgttgcaattgtatttgactcagcaaaaatagtttttataatttgtcaacagaacttctttaaaatggcttcctaagttgtttcagctaattatgaggtatggtgatctcaacctccttccaaccactggtccactcttgagtcttcaggcttttttttttgcttcaagagtagcattgtaagtttttagtcttcagagaacaggaagaattctagtttctcagttcttgttctgatcaggattgtattttcttttcgtcagtttgtgctctgaaactgcagggccaggcagagtccatgctacctgataaagcatctggaaccatggaaaactgagggtggatatgatgagcctctctaataccagagatagtggacagaagccatccgttttgcatttggcttttttgaggactcagtaaatccacacagagaattagctaaggctgtttgagaaacagcctgtgggataatgaacacttttatgctttttaaaatgaccacggggagcctcatcagaagaggcgattccaggattccaagatggcagctgggtttttcattgttcctgtgggacttgcactgtgaagtgtgattgtagctgatttttcctttcaacaggaattcattaggggtatccattagctaatgaactattgatataagaaaaaaggtcagttattttagagaggaaaaatgtggctttaactctcgattatttgtgtgttgggtccatttgaaggcttcttcccctggctcaaaatctggaaaactgatttgaaagaccttcagttttatttagaaagaaggaaaaacagattatttcagttactttatgttttgtgatttttactcgatttacctaaagagaaagtgctcagatttaaattctaggtaccttcgttgctaattattttttactgcacttttatggccattttttatttctaaggattgaacccttttttttgtagttttctctcaagggctaatatttatatttttttgcttccaaaaactgttaaagtctgaaagtgtaaatttatatttgtggtgtttactttgtcctttaaatgtttttgtgtacccatactttttgtcataaagatggaaaaatgatattaaattaaccaaatgaaagtaattaatgctgaacattcactaaattattaagatgttaatgtgattccaaatgcagatagttcatgggcagcagcatgtgtcctgggactccccctcaaaggttggcaaggtttgggcaattttgagggagggagttaattcttaagtagtaagctttttcgtttacctctactatttataagctaatatgcaggatcattgtaaattagtgaaaagtgcattccattgaactagtagttgtaatactgggttaaatatctaagttgtgtgactttgggcatgagtttctgcctctgtgggtcttatttttccctgttatcagaactgtagcattggactagatcatgtttccttgtgtgttttttggaaaatgtgacaatatactaggacctacatgaagtcacagtataaacacccaagggacacaacaggcatatcttcctgcctttcatatctattcacttgaggcttttggtaagacattaattttatacttaagcaaacatattaaagactgaaaggaactcatatatcttcatatagtgttaaagatattaacacaaaaatgaaagaaatattgtccatacagcaggccacagatagatatcccttgttttgtgatcagtcttttctgctatggagggcactttggacacatttgaggatcactgcattagatgacaggaaatgtgtttcttcctatgctcaagttgtgtagccatgacatttgaggatatttacattttgaatttccctcctccctcccctaaattagtggcatgttctagagaagggttcatgtgctttatttacataaaacctatctcaatgttgtttgataagaatctgttaagagatcttgtcctaaaaggatggcacttagtgttggaactggagaatggtggggtgtgaggagttaaagtaattccctaagcacactagacacgcctgatgcccctttcaagccagtctgcttccacgtggtgattctttctgattcccattatcactgtgtccccctcacccctgccatttagcctagattctggcagaatggaaatccacgtttctgaatttagtatgatttttttttctttccttctattctcagcaacaataagtactcttgatggcagctgctgtattaagcccaagagcttaaaagattaaagaaaccactaacagcagtaaggaggaagtttaagggcctgtttttctgaaggtttgtgttttcattctgatggttgagtagaaaattacaaacaggttgtgttcggcagctggaatgctctccaacatctggggagacccagccttctgtttatttcccattcattggaagggtggccagccagtagcagaaactgcaggcagagatactagaactctttgggtacataagccgttagaaattctttttttgtagaaatttcttcatagaaataccttgttctctattttttcataagcttgactgagcacttaacttcaggtcagttgctgaggaagaggtctgaaggtaatattagtacccccccaactactttcagctggaaacaagagttgtttgggcccttactgagttcctactttagagtcaagggctggccttcccctgcatctgtctgcatatacctcacagctgagcagataacatatttgtgcagctattcccttatgatttcctctctattagagagaggtggagcctatgacagactgcagagtgtttgctccattcttccccaccccgtagctttactgaggtatagttgataattaaagtatttacatatatttaaggtatatagcttgattatgagatatataagtatacattgtgaatattcaaaatcaaactaatcaatcactccacatagttaccgcttttctttttatagtgagaatacttagtatctaccttcttagcaaattttatttatgccacatagtgactatagttaacaatattatatactcaaacccagttattttaatttttaatttttttagagctaggatctcgctctgttgctcaggttagagtgcagtggtgctatcatagctcactgcaacctcaaactcctgggctcaagcagtcccgccatctcagcctcccaagtagttaggactacaggtatataccgccatgcctggcctaatttttatttttagagatgaagtctagctttgttgcccagactggaatgcagtggcatgatcatagctcactgtaggctcgaactcctgggcttaagtgattctcctgccttggccccccagttgctgcgagaatggtgccttgttctcaaaaccattttgtaaaaagtaatgtgctggccaaataaaacagaacgccagtttgttatttttggacagcttcattattttgtacatgggaaaagagaagttcgaagttttgccttatgcaaggtcataaagctggtcagtggcccaaccaggtttagaacctttatctttggggctatttgagaaattcaagtgatcccagttcaatcattagtggcatttgtggtcttcagtctgcactgagcaagggtttcatgtttggtgtctaatattttaggattattagagctaatctagcctttggagaagccaaatggattttgggggttgtctgtaagaacccatcatgatggctggaacagctcttaagtggaacttctacataaatcaacttgcatttgttctgtaacaccatgtgaattttcctgaatttccaagtaaatatattttgcatattgcttacaaattgcttaggctgtcttcatgaataatgaaagctgtgctgtaggaagctggatattaagaaggggtgtttttaaaaacagtatttcatttcttttgcttatattttctgtagcctcaagggtgtgttcagaggtggtagggagggagggtgctgttaaggtttctcaacacctgtgttcctttacagaccattatctcttctgctatcaaagaggacttgccagttaggtcaggatgcataaacctctggacagtgccttctcctatgcttatctttgctatatgtcttgttgtgtgtttagcttccataacaaggttctctacttctccagtttaagaagaaatcatctgttgtgctgaacctctattcatctcagtagggaaggcaccagcttcaagaggctgagaagagacccagagccagcaaatgagacatggggttttattaggggcttacatacaggggagagagtccagtggtggcagactggacaacatactggcaccgctcagtggcagagggctgggcaggaaaactgcagccgctttgcaaacagcatgcagtttatatagcattttcaattaacaccctccccttaacaactttcacctggcaacttgcatgccaacccaaagtttagggcctcaattccctgtatggcccatgttccgtggcatgggcagggggctcagatgttcctcctagacaaggaatgaatctctggattggccactgtgggactccctagctcgacacacacattcaggtgcatctgccatacagtgtcattttaagggtatgctcaagttattgctctcagaggtgtttaccctactattatcatttgacaataatacctatatgtgacgtacattgtctagtgacagtcctgatttccagtagctcccacaacaacttcataagtatcatagccccactttttaggtaaagaaagcagaggtttggggattgtgtcttccctagtcgacacaccttgacagtgtagaaccagcattcagaggcaaatctcacttaggcctggtgttctttccaacatgcctcagctgctgctttgccttctctttctcccttcacctggcattttgaccacactaattgtgctggcatctcattccagggagtatgggatgagatgccagcactagagtatggctttcaaaacattttttgtcccagctcacagttacaaatacagtttatgtcatcaagtatacatacatatgcacatgctcaaatgcacatacatacctgtgcttacatgtactcatataaaactgaaagtttaattatatatgcagtaaactctaatatttccttttctgttttacactgttaatacatactcacctgtaaccgttattactcactaaattggttttacaatcaagatcacctgcggttgaaacagtgctatagagtggaaatctttacggtgagttatgtgctctctcccctcaaccccttacgagatttttaggataatccatgggagcacgaaaaaaacggttgaaattatattttgatttatttccatcttaaggaagagattaaatgttgctgttacttaatatccgagttgacagtgcagcatcactcgggctgtgaaacagtcagtccagtgctctgtagagtgtggcaggtcctgaaggaagagtgggagttcctaaagtggcacactccttcagcctttcgttgtgtgatgtgctccagtttgtatggctcataaagcatgttagtaggttatattatttacttttggcaaagagaacaagtggttttatttttatttttcttttgagacagggtctcattccattgtccaggctgtaatgcagtggtgtgatcacaactcactgcagcctcaacctcctgggcacaggtgatcctcctacctcagccttccaagtagctggaaatataggtgtggatcaccacgcctgactaagttttttctttttgttctttctttttttttttttttttggagagacggggttttgccaggctggcctcaaactcctgctgaagcaattcgcctgccttggcccccagaagttctggtattacatgtgggagccaccgcaactggcagagagcaagtgatttttaagagtttcatcaaagaaactgtggaatgagagaacataaacacagggcaacagcaggaaaatgacagagttgacttttttgttttaatgagctccttatcaaccgcatcgctgggtacaaacagcgactatatagtcatatctagtagggagtcagacaaaaaattgaagctattttaacaagtgagaacttaggtttatatccatgattgttaatgatttaccttgtcctgaatggatgttgtaccctgagatattagctaatatcattatgttggataaaatattaaaagttgtattcattttatctttgtgtcattccttatgtttatttgtatattttatgatatatgtgatatatctgtgccttatagttacatatatattggggaatatgttagaatttttttgtactgataaagattcctaattaaaaacatttggagaccatttctattctggaggactaagtaattattaatgggtatcttggggtctagatgaagagaaggaaaaggtgaggacacaggaagggagtgaaacagggagggtgtttgtgtacaaattagataacaaccctcccaagtggattcagttccaggggcacatggtttggtgagtggcctgtgccttcgtgcaggttataaaaagtctcccctttctcctggcatagcagctctacactagggcacatggtttggcaaatgggttgtgggctggaattcagcaccctttcagcccttcatccttctgcaagtgtagcctacacaagtaagtatatgtaacagccctggtggtgaggtactgaaaataaataaataaaagggcgaaggacaggcattcatggatgtagtgagcagcaacagctagtcctcactcttttattcattcattcattccttcaccagagtatttatagaacacctgctgtgtgccagccatcttcaacagcaggagttggcaaactatagcccaccggccaatcccgacctggtatctttttttgtaaatcgggttttattggaacatacctgtaccccttggtttatgtatcttctgtggctgcttcttagctataatggcatagttgaataattatgacagagactgtatggcctgcaaaacctaaagtatttactttctggccctttactgaaaacaggcgtgaacctctactctagaatataaatcaggacttgcttctggtgccactgcatgataacttagccatggactgtttggcttctatctcatgttccctacttgcaagaaaatacttccatcagggccaagtggaggtgcagtagagcaggggcagagctaaaagcaacacagctgggcacatttacttcttaggtctctacacaaaccatgtagtgtaaggaggagacaaagggctaggagtccagagactgacactgtgtggccttctctctgggcctgtttcagatagtcactctgcaactacaagatggcactggattagtgattctcagacgtttttctgcaccaaaatcacctaaaaggctggtttaaccgactgctaggctccacctccaaggtgtctgagtcggtaggcctgaggaaggcctgagaatgtacatttttaacaagtcctcaggtaatgcaggtaggcagtatgactggattgtttttgtggttgcctgcctctttttggcattggaaaggggaaagccagagtattccttgaggaatgacatttggagagaaccaaattttagatgcttctgtgatatgtacaccagagctattctggactagattgtaaattctcacatttcacctatgcaaaaggaaatactttctggtctcctattagtaatcagttgtctcaaattttgcccgttacctctggaaattctggaccctcaagtgatcagtcttttaaggcagtgtggaagaacagcacctattatggcagttgatttttcatggtctctaccctgtccttcctaatataactgctattctttaccttcctgtttttcaaaactctcgtattgttcctgttgtgttttttctaaatattttcttggttacaataaagtgctaatatttaaagagcttttgggagcctgctggtgccagaaactattcaagttacttacagaatactctcattcagttctctcaaaaatccttggggaagttttatttttctcattttacaaatgagcagtaattacaaatttggagtcagagaagctaagtaatatgtgatctggacaatttcaatatctatgtatatcaaaaaccaagcttcctaggtctttgacctcctctccagtatccctcaccttcacctgctaagtatccattctcattttggatctcggactttgttatcacctaggattcgcccaggatttcactttctcggatcatgaccttccacatcatactgtcactgcatctcaggagtctgtttcttggaaaagctttacgtctcttatcctttttcttttccaacagaaatacctttctgaactatttctctctcttaaacctcttttaaaatctgcacacttcatactaaattgtattgattatgcttctagttccctagtacataataacctttggaaaaattgttttgtcttactaattgtttctatagaactctgtactgcacctggtgtatagaaggcactccataaataatggtttaactgagctagagaatatatggccagggtctgagtccgagtctgtcttgcttcacagtatggctgctatagtcaggtctgccacagctctaggcctatttttttttaatctgtctggatgaagaaggaattgtttagtaggtgatgtcatttgtgggatgctttgtctatttctgcgtatccagcatgcttttagtgatttttcattttgtcagactgcattttctcttttcaactagagttcaaacaaaataattttagataacatcctaagaacatttggaaacatgacatttcaggtctattttccctctttgccttaaaaaagtatatacagctataattactaattgctgcgctctaagtagagacagatgatacatatgtttgtgacaattttccagagggagagctaagtaaccaggctcatttttccataatgtgaatgttattcacaaactattaccataattgatgcaccaaaccactgtagagtaaataatgtgttgtgtgtgggaagcaagctagtagtcaatgaatattaaagaacaaaacctcattttaaaagagaaactgtaattaaaatcattctgaattcatgctgcacaaccagttaaaataacttggctgccatttatctgtgtaattctgtgtataaagggagtaggtatatgatttgttatatagaagtaagtatttacatgcacatttttatgaaaagacacaatatcgaacttcagaatcagtcgttttccaaaaacatttgttggagagatgaacatgcagagttaatcagtgaaatatatattgacaggaaagatcaccatttccgttatcttatcttttgcttttctaggtgttttatgtctacctggaatgtcgtgtccctttccgtggacctaatcagcttctgtattttctccaaagcttccttttcatcagaagttgttcttgtccacttttaatccctcttactgctttctaggtgctcatcaacttctgtgtgtggtatattgatttgcacttttgggatttgttgttttataagaggaggtcataagtcatttcttgtgtgtatcattagtcttctcaacgagactgcctaggatttcagtctcagattattctatgtgtgtgttgggcgtgtatgtatgtgtatcattccttccggtgtaccttgtggagaatggtttgctgtccatgtgttcgctaactcctcagtatgtattgttggttacctgttttcatgcaccagatactgcattatttttgtaaaatctttacattttgtgtttggctaccagtgtctccacagagtcttgaatgtaactggtaaggatcagatctgttggtgtagagtttttgatggaacactcaatcagcaatctgtagtatggcttatgtaaaatgtataactccctctatctctgataagttctgaagtctaaggggaaagtgcttccctgtctcttgaatttgagtgttttgggtgagtccattttatagatagacaaggtgattgtatcagagcttacttttatattttaaaatggatcatagtgtacctattcttaggaaccttttaggaaaatctctttaacattgatcctgttgttagttgtaatctcagtatattctgataatttcctttgaatatgtaactgttcctttcatactgtgggcatctgttgtcttctctttttatagcaatgaaagtatgaacagattccaatgtgggttcttagctcaaaattctctggctctaatgtcaggccaatttatttagctagtttatacaactggacatatttctataatagaaaaatgactaaatgtttcttaacatattgtttacagagatagagcccatgttgtaaggctatgtaactcttcctctcaaaagaagattattggttttagcatgttttcctccctttaatttaatcttaagcaggtgaacctttttgagggctttttggaaagctctgaggaaaaaaaataagaaaactcatacaacctcaaggaattctaagtatcaaggagcacctctgtgaaggtgattggttcaagcattgaacactattttctatccttccacacatggcagggcattattcatgtatccagctctgtgatagcttgtttttgcttgccctgatgatacgtatggcaagggaggaatattatccaggagtggacactgtagagaggggaaggaaccttggaactgacctttatagaggcggttctcatcctcaactcttcttccttacaagatggcttggtatcccttgagatcattctcccaccttcaaaatcctggatgggcctcttgcctggttcccttaaggactctaaaccacttagcttggagctggtgccatttaattctgttcttggcagtgggccctggcttctttcctgctaggccctgtacctcttaggagcagagaagaggtcagatgcagataatacaggcatgatttctgcctcctgaaatgctcagatgatatgcacttctccgtccccctaaagatttaaggaagtacacatttatcatgggatgtaatgagtaggaaagagcatggggctttctttttctgctgaatagcagattgtaagatagaaacagttttgtttacaattcagctctatctttgtactttgcattgcagttgaagttatttttagctttactgttaagctaaacgtctgagttgtttcatttgcaaattctttctttgagggtcaggggaggcttttgtaaaatgttcaggtctgagagaattttgagttaggtaaaggtgagtgtgtgcatgcatgcatgtatgtgtatgtgtgtgtgtgtgtgtgcacagctcgtgcataaatgcctgtgtgcttgcttgggtagggactaggagggctgaaaaagagagagaaagtcattcttagcagaagaaaagcacgtacaaagggtggaagacgtacggtttttgacagatgaatgaatccttctaaaggttttgtaagagctgtgaccagctctgtttgctgagaaaagggaaagtccttgagcacccatcatacctcttcagactctcttaaaaagcattcagatgttctgccagaggaaatgatgtgttccaactacagctgcagtggagggttctttttgtgcagctgaagcaattcctccacatagattgtcccattttaacagtaaactgtctgtttaaaacaaaacaaaaaaggtgggtgggaaatggaaggagaaggagtttatgccaggaaatgaaaataagttgctgcagaagcctgttttggttgtggtttcagagttaaggataagttattaataataataataagagcccacttgatagtttgttatatctctgtgtgtgtttttatgaacttttaattttccagaaaacattaaagataaattagagaacacactcctgttggaggaggtgaccatcttgcagctaccaaaccatagaatctttcaccacttaacaccttccaaggaaccgggtagacttctggtgtcctctctggtcctcttcccttccttataggatgtcaggctttggacttaatcagaggataattaaggctctatcatagcaggtgaagtttctgagtggaagtctaagaagtgatgtttctataagtgtctttagctgactgagctactaagcagaggttaggaggttgtgatgtaatttaaagtgacattgtggttaccttttatcaagctcaattgtgagcctggagctatgttaactgcttcacagctatgagcctatttaattcttacaggaatcctcattttaagataggtttgattaccctccgtttacagatggggaacttgaggtagagagataagtggttagtttgcaattacacccagcatttggcatggctgggattggaaccaggggccttcagtcttcaaagctcttacatgtaaccactgagtgatgcattgtactctctcctgtaaagtagccttttctccctgctgccactggttcatttccttttccttttttaagatgctttaaaaagaacaaaaaccaataacgtacctcctaaattgaggttgatctccctccttcctatccaataagtaatgttctagactcatgcaaatattagatatttgggagaaaaaatgaatagaacatgtccctcctctctttagctctaagaaaatttgtgtgttcttattaattcctactgttccactatcctaccatattacctgatacatataatacagttacagtcttctcagggagactcttctatgcagtggcatgctggagccaggaaagcttgtaaacccagctcagacatggaccagctgtgagaccttggtgaagtcactttaccctccgggctttacttcttttatcactgtagtgtttgatccaggtcagttcgcagcctggaaggcacagccttttccaggacactaaatagggcacatgtgctacccatttgcgtgcacactatccttaggcatttgttgaagagatggttaataaaatataaactcattaaaaagcattactaaattcttacattttgtgtttctttgatcagtgaatgactgctaaaatttagtacgttatcaatggggaatttgttatctctttttgcataaaaggggtcctcggttttcgtgaagtttaaagtccctccccaggtagaatatccataaagcctatgaatgagtcttaactacttgattacccagattctagctttttggaatctttcattaccttacttttttcccttctcggtgagcttttggacttaggacaaacggggaacgatcacaaggaaatggattgacatctctactctttcacaatctttcctgaagacatgatttttttttgctatcatgtctctaagtacagttggtcagttgtcactctgtcaccttaccttccaaccccataattcctgtgaaaccctggacacctcactctttttgcagaccatgagctcctctggcctcactcctttccttgtccagcttgcagtacttgagtaatcccctcacccctcaccaccttccttattagtacccccagttccctgaagctcttgtcctgcccatttcctcccagcagcatgtcactcatctgccctcatgagcctgtgttccccttacaagaatcacatctctatctgtactgttattatagatcagtgaacttcaacatctgatagctttttcagtgttgcccatcagtgcatttaccgagttgctttttctatccttttggtgatagttccaaatgctccccactgtccccacggctataatgataggaaacattaatacaaaacttggttgtgttggagaaagtgtgctaagaactttacatgcattgtctcatctccgttcttgctaaaggatctaacttttccttccaaccatccagcaactactagcgaggcatcaactgtgtctatgcatggtgccaagccacagactgtagctatgattgatgcagattgggtgcttgctctcaagagacctctaattcagagggagatgcacagaagtaaacaggcagcaataacattgtccgataagtgctaatgaggggagaagttcaatacgctatagatgcccccaacccagacttagggttgaggataaggaaaacttgcaggaagttacagctcagtgccaatctaaaggacgagagactatgagggaggaacataagggcattctggacaaaaagaatacctggctgctggaaagatttcagggaattgagaggggccagtaggaacagagccattcttctcagagaaattagaggtcttatttttggtgtgaattccatagactctcttttctacctcctctgtgatctgtatcctcacttggttactaactggaattagaatcccctgcaatccttcactgtatgcagatctcgtaagacacactttctgtcaatctcagtgtgaagttttactatgcacttgtatagctgctccactgaaatactattagactgttaaggtgagtgtagaggacaatgcttcttcaaaattattacagggaagtttataataatggtgactgacttgaggtaggggtagggtttttcaggagggtctttcagtggtaatcacgcctaaaattttgaatgcttaaatgaagctgctgcttagctcaatgataagtaatagcagcttctttttccatgaggacatttattaaatgatgttttaggtctcagcaaatgttacgccttcagacaccttggctcaggaaagcctgatgtgcctccagtgaaggatttgtaggtccacatcttcgatgcttctgcaacacagagttagggaaatgaaacagtgggtcatacatgctcctgatccattgccaacagcaaagggacttgagcccccacataccttttgacccttctggtcatgataaagccacccactagctataatgctatagtcagcagtagaaataagagggagcacaaagcaactgaatggtaaaatatttcagacctttttggaccactttggaagatggaagctgataacatcatacatccaaattcctctgcattgctgtctctctctttacaggtggggaatagtttacagcaatcagtagaatctacttttgattccaaatgggtcttaattattttgtatttgggaaatattttttacttggcaatagagatgtgccataatattatttaatattttggaaatcactgtttcccatgtgcctgaacatctcgagcacatttaccctgagcgtggcagtgcctgggtgtctcacatccatgtatgctcaaaccatgctccttgatttcacccctttctctctgtttctttcatctcgtaaactgagtgctgatgccatttcacactttttcttggaagtttaatgagttagtagtagtataacaaaaataaaaatattttctttacgtttctgaaaagaaatatgtctataaagcgtcaatcatttttccaagctgttagttcctgctgctgagtactaggagctgttctgtcagcaagaccacgtaagggggaatagtaagagaaagctgtcccaattttctttctctggtacaaaaggttagaagatgttgtttcagctggagaacttaagatggattcttattcactatttgctaaagagactggactgtttttagtgtgataattttctgtaggcgtggagaaaggtcacctcctgatcttgttttggagatcatggggttaaatctgtggcagtgtccttttcctagacacagcctcttgtcaaaataatgtttggccaggtgttaatctgtgtcctgaggggagtgctggaattcattattcatcccgtgggagtaggggtcagaggagaaggttgtccttctgggaggtaccaggggacatagcctgcctcctgcctttactgacatgtgccatttgtgaggagggcagttgaagtccatttgaggaattctcttgtcagccggccaacacagaaacacagagggagtgggagggagggagaggcaggcagcttggcaaggcagtcctggagtgcagtttccggagcaagatcacacacagtgttttaggagctcagggaaggtgtgcaggaacataaaggggaagggggccaggtttgaaagagtggatttttcctattttttccaccttttattcctcctgtctttgaatacttgtcatcctttggaaaactcagcatcggaaagaagcctttgctgacacactgctttttctccagcgctatattgtgggttttttgtttttgctcttttcatttttcttttcctctgagggcaggaggtgagacaatgatcaagtcaagctggttctatgttaagttcaagtatgcagagaaggtaagtcaatatggtttcttttcccaggggaaacctgccacctccctccagtcttgtcatgttgatgggctcctctggccacttggggaagtgaatgaagctgagaagttgtatttgtgaatgtatttcctttggcttaatgatccttggatgaagcacaagctctttgcttgcaatctgacgttgccgctgaccaagtggaagcaatcttcagactctgttccggaggcatgatttagagtttaaagaggggaaataatgaaactacaataacaggaaaggcaggatattctgctttagattgaatagagaattttcaaggtattatttgttacaaaggtagatatatttttggttctgaaacaaattgacagtcacttcctattacctgttggcttagaatttttttcctctttcagttaactaactgcttactcatttgtagtcttacttggttgtagaaagaatccccataaggttgtctgaccatatatgagatgatctctttactgtctgtcaggggattatattttatgaatgaattttggttgtacctaaaattttgatgttaaacagttccactgtattttaacataccatttctggacttttaggggaaaagtgtactttctaatacatcttcacttaccggggctgtttgacatctttttggttccacatccatatgtgtcacttactctgttgggaatttacaggattagaaatgaggtttccaggagaggatatagctcagaggtagagcattggactgcagatcaagaaatgagatttccaggaggatcctaacgtgtgcctcccttttgaaatcttccctccttgatttgattgttgaaaacgttggcatattgattgtagagttaagctgaggctctatagaatggaactgtgatgtggcaagatggaaaattgtgcgactgtctttatactccttatgattatatgcataagcacattaaatatgcctcttccattcacctagtttaaaaaaaaagttagaacattttcaactcctttttactgcattttttttttctgtgtggacttgtttctgctgtgtttttaagacagcaaaattactctttctttacccatgttgaaattacaggatttttatttaaaatatccattttttattttaaactcacttgcattgttaactattaaagctattataagtaaaatattatctattcatgcacaggattgggaaagattgtggtttgggatttttttttctcagtagattactttcctttgagaagccgaccatccattgtttgctgttatgaattttgataactgaaaactgtactctgccttcttatgctttcccttttatcttgaatgttctgtcatgggaacctgaaactcaagagttaaggcacgtaaataaactaatgtgaaaaggggaaaagcatttccagaaatgattgtcataaaaagaaaaagaaggagaacgttaagttaattgcttcatttgaattaccatgctgctattcctttagcaaccaaacaagcagagaatgcttccatatggcaaggcacaagtgtaatgtaaagctaagtaatgtaaggctctatacctaattgaaggatattcgtcttgattttatgaggatagaagaaaaagagaaatctcattcttgttcttggcatggttatggtgctcaagatctcagtgattctctgcagaacttttgttctttcacaatgattcaatttaaaaattttcattggagatttttgttttccaaaactcatcaagatggattgagttttaacctagagagataataagtcttagtgtaaacacagggacagcattgataacaaaacaaactaaaaccatcttttttgtattcctctaaaaagccattcttacaaaggctttttgatttggaatttccctcactatctttaaaaggacaaaaaaagaaattcctctcttgattgtcaactactgaccattttgatttgatataagcttgtaattgttggaaagatatttctgctgtgatgtttgtccaaaactataagaaaatacatcacacaatctcttcaatatccatctcctagtttatcatttaggaagatgatttaatcagtcttcagtagtgagaaagaaaaattaagaatggcaagtaacgcatgaccaaaaacattggcataagagaatactgttcacttgtgatcactggaatcatgatccctttcaaaaattaaaatatataataaaacaaacactgtttttttaaccaccaccacactaacacacatgttcctctgtaagaatttccatctaaattatttatgagttgtctctttcttgaattagattggtgcctagctatctttctttctaaaagagtgcttacttcaattaatttcatcctataccccctttctctttttattctacatattctccctgagcaatttcctttttggtgtgtttttctatgtcctataagtgatgattccaaaagctctatatctagcataatatctttcttgagtttctgaggtatatatttaattggttaggtagatatctgtcctgaagttcaacagattcctcaaatgcagcatttctaaagtatagttaatttcttcttccttaaccaaggattttcttcctcttacatctcctagcacagctaaggcatccctatccagccagtcatctttgttcccaaaggagctgttttagttctgttcttatcatctcccttctggcttattagaggagcctcctaatcgatctccctgccacattcatggtgcttccagtgctccaaaaccctgctagaggtatcttaaaaggtcagtctgagtctgttttgctgcttgttaatggttcccctctcccatctaagcattctcactacatctccctcaacagtgctagcccttgaccttgtatatacataatacaccttattgtaatttcttattcacctgcgtcttctatagtaacatatgatcctagagatacagaattacattgtgtttttgattttgatttttctatccagaatccctgcacgtaatagatatttattccctgttgggtgttgtggctcatccttataatcccagcactttgggaggccaaggcgggagaatcccttgatcccaggagttcaagacaaacctgagcaacatagcaagacctcattatctgcaaaattaaaaattaaaaaattagctggtgtggtagcgtgtgtctgtggtctcagctacttgggaggctgaggtgggaggttcacctgagcctgggaggtcgaggctgcagtgggctatgatcccaccactgcactttagcttgggcgacagagcaagaccctgtctcaaaaaaccatttttcccccctaaatgctactgagtaaatctgtgactttttcccaggagtctggccgacctgagtttgaattctgcttctgccatttactggtagtatatgaccttgggcaatatattgaaactcaattgaattgttttctcatctattaaatgaggagtattatcacctaatgtatttttcagttaaacttcttattttgagataatggtagtacgtaataatagtacaatatgcagttttaagaaataaaatgtaaagatcccatatgccctttacctagtttcctcaatggtaacatattgtaaaaccatagtaaaatatcacaacaaggatattgacatcagtacagtgaaaatacagaacaaccacatcaccaaaagtctctctcctgatggcctttgatagccatgcctctttccttctaccttcacaacccccatcattaactcctgatatgcaatcacttttctccatttttataattttgtcgtctcaagaatgttatataaatggaatcatacaggatgcagctttttggaattttctgtttttactcagcataatgttttagagattcgttcaagttgtatgctattagtttctgagtagtattctatggtatgggtgtaccatagtttatttaatcattcttctgttgatggacatctgagttgttttcctagaagtactatgaacatttgtttataggttttgttgtgaacataagttttcttttctctaggataattgtccaagagtgcagttgctgggtagtatgtatagtatttgcgtggttaatttttaagaagccaccaaactgtcttcctggctgactctactattgcatattctctttagtgcactgtattagcgattccgtttacttgcgcattcaccagcatgcaatgatgttggtggtgtttctggttttttattttagccattctattggtgtgtactgatggtgtccagtgatgggttttaatttgcgtttccctaatggctaataatgttgaacatcttttcatttgcttatttgtcatttgagtatcttcttttgttaaatgtctcttgctctttaaatgtcttttgcccattttctaattggatttaaaaatttttactgttgagtttttcacagttcctaatattttctagacagtaagtctttattgggtatgtggtttgcacatattttcttctaatttatagcttgtctattcatcctctttcagagtcttcctcagagtagaagttttaaactttgatgcagtccagtgtatggatcctttcctttatattcttgcttttattgtcaagtcttaaaactctttgcttatcctttgatcctgaagatttttcttttccttttttcctaaaagctttatatttcatatttaagtccatgatccattttgagataaattttttataagatatgaaacttaggtcaaagtttttctttgtgtgtgtgtgcgtgcatgtgtgtgtgtgtgtgtgtgtgtgtgtgtgcacgttcctgtatatgtccagttgttttagcaccacttatggaaaagactattctttctccattaaattgttcttgtacctttgtccaaaatcagtttactgtacttaaatgggtctgttttgggtttctctattcctcaattgatttaatgtctgttcctctaccaagatcaaaaagtcttgattactgtagctattctttttcaaaattgcttaagataaaatagtacctgtgttttttcatataaattttataataacctcatctgtgtttacagaaaatctttccggtgttttgataagaattgtgttaaaccaggatattggttttgggaattttttttttaagtactttgttgagtctttctcttcatgaagaggtttgtctctccgtttatttagatcttgtttgatctcttttatcattttgtagttttcagcatacaagtcctatatgaattagatttataactatcacttttggggggcacttgaaatggtattgtatttctaatttagattttacatgcatattgttagtatacagaatacaacttattttcaaatgttgttttttgtatcctgtaaccttgataaatggagttattagtttgaggaacttatttgtagttctttgaaattttctgtatagacaattatgtcatttgcaaatgaggacagatttatttcttcctatctgatatctatgctttttaaatttccttttcttggctaattgcactgagtagaacttctcatgcggtgtgaactaagagtggtgagagtgaatatccttgtcttgttcctgatatttggggaaaaatgcattcagtcttttgctgtttagtacaatgttagctgtaggatttttctctatgttctttatcaaattgaagtagttcctttctattcctagttttctgagattttttttatcatgaatggatgtagaattttgccaaatgctttttctgtgttaattgatataattattaggtttttcttttatagcctattaatacggtagagtacattgcttgattttcagatattgaaccattcttgcaagcctggaaaaagttctatttagtcaatgtgtataattctttgtatgtatcgctcaattttatttacttatattttgttaaggacttttgcatctgtacttacgagaaatactggtctgtaattttctttttgtaatggttttattatgaggatattactggctccataaaatgatttaaaagtgttcactccttatttgtttgctggaagagattatgtataattggttttcattcttctttaaacattgtgtggaattctgtagtggaaacccatctgggtctggaaacgtcttttttagatattgttaatttaagaaattaaattttcttaatttaagttattgggctacttaaattactgtttttcatatttggtgggttctggtagtttttctttgtaaggaagtggtccacttcatctaagttgtcaaatttaagtgtgcagaactgttgatagtattctttattgacttcttgatgtctgtatagttatattccttgtttcatccctgatattgataataatgtctgtgtcttttttctgtgtcagtcatactagatgtttgtcaattttattgatttttttcaaagaacaagttttgtgttccattgatttttctctcttgttttcctgttttcaacttatttttttctattctgttatcttaattatttcttccatctgcaagctagaaaaccaggaaagctggagagtgtagttcagtctgactctgaaggcctgagaatgaggggtccagtggcgtaaatctcttttcaagactgaaggcctgagaaccacaagggctgatgttccatctccaagggcaggagatttggatgtcccagctcaaacagagagtaaatttctccttcctctgcctttttgttctgtttgggtctcaatggattgaatgaggtccacgtgcccaaatagggcatcttctttaataagtctaccaattcaaatgctattctcttccagaaacatactcacagacataccaaaaaataatgttttaccagctctttaagttgacacataaatttaacaatcacatgtatctttttttaatttttgctgcctatattgttttatttaaagagagtttcttatggatagcatagagttgattcatttttacaagttactgtatcattgctctttcttctgtcctagtgacttaagatcctttcttttagctatttttttttaaaaatagaacttcctttagccattcttttagggtagttctcccagtaactatttatttatttatttatttttatatgaggttgtcttgattacctgttgcttactgaggaatgtttgcacttgatgtagaattttggttgacagtttcttttgtctttttctttctttcttttctttttctttcaagccattgaaaaatgttgttctctttcttctggccttcagggtttctcatgagacatccactatccttcttttgtctagatgtcatgacttctttctccctggctgcttccagatttttttgctatctttagcaaagtttaactatgatgtgtcttggtgtgggtatctttgagcttattctgttttgtattatcatagctttttgaatctgtaggtgttgtttttgccaaatttgagaattttcacccatcatttcttcatgtacttttaaagccctattttccttttcctctctctctgggactctgaagacacaattgttagatctttggttataatcccacagatacctgatactctgttttttgttgttgttttgtttgtttgttttgtttttcagtctctttttttctcttttgtttagatgagtaattttagttgttctttcagttcactgattctttactctcctccacctggtcttgagcccatccgttgaatttttttaattgttttttttttatttttatttttttgaggtggagtctgctcggtcccccaggctggagtacagtggcatgatctcggctcactgcaacctctgcctcctgggttcaagcaattctcgggtctcagcctcccaagtagctgggattacatgcgtgcgctaccatgcccagctaatttttgtatttttagtagagacagggtttcaccatgttggccaggctggtcttgaactcctgacctcaggtgatccgcccaccaaagtgctctgattacaggcttgaaccatctcgcccagctgatttttaaaaaaaatgcattttactctggtaaagatgtatttaatgaaatttaccatgttaacggttattaagtatacagttcaatactgttaaatatattcacattgctgtgaaacacatatccagaagttttccatcttgcaaatctgaaactctttacccattgaacaactccattttccttgctcctctcagcccctggtagccaccagtctactttctgtttctctgaatttgactactgtggataccttatgaatatggaatatacagtatttatctttttggcactggcttatttcacttcataatatcctcaagtttcatccatgttgtagcatgtgacaagattccttcctttctaaggctatataatattccattgtatgaatatacggcatactgtttgtccattcatccattggacatttgagttgcttccacctcttggctattgtgaatagtgatgctataagaccctgcttttagttctttttggtatgtatgtagaagtgggattgttggatcatatggtagttctgtgttaaattttttgaggaacctccatagtgttttctatagcagttgcaccattttacaatcccaccattagtgcacaagtgttctaatttctccacatcctcttcaatacttgttctctgtttttcttgatagtagcaatctcaatagatctgaggggataatgcatttctctaatgattagtgatgttgagaatctttgttggctacctgtgtattatctttggagaaatttctattcaaactttttttcattttttaatcagttatttgtttttcattgtttggttgcagaagttctttacatattctggattttaaccttttttcgggcatatggtttggaaacattttttcccattccataggtttctttttcactctgttgattgtgtcctttgatgaacaaaagtttttaagtttgatgtagttccatctgtctgtttttgcttttgttacctgtgcttttgttgtcacatccaagaaagattgtcaaatccaatgtcatgaagcttttcctcaatgttttcttctagcagttttgtgattttatacttttatgtcttacatttaggtctttatccatgttgagttaatttttgtatatggtgtaaagggtccagttttattcttttgcatgtgagcgtccagttttcccacaccatttgttgaataaactatctttctccattgaacggctttgacacctttgtcaaagattgtttaaccatgtatgtgaaggtttatttctgggcttgatattatattccattggtctgtttatctgtcttcgtgccagtaccacactgttttggttaccacagttttgtaatatattttgaaatcagaaagtttaagtcctttaactttgttctttttctaaattgtttggtgatttggagtcctttgagattacatatgaattttaggatgcatttttctatttctgctaaaattgccattgggattttgatagagattgtatttatggatcatttgtggtactatggacattttaacaacagtaggtataacaatattaaagcccatggtcaaccacaaacatggaatgcctttccatttatttgtagctcttttatttcagcagtgttttgtattttgggagcagtgttggaagtctggactccagtacttgtctttacagtttccctcttttctgattctttggctaaagacaacaaacttttctaggggcttgttttggtatgtgtcattgacattactgggtttctgttttttcaactccaaatctgatgacatcatatatcatatcggatatatgagacctataaaatgaaaactcctggagaactcaccaccatgtcatttttgggggcccccaggttttaagccagtacgtcatcttcttttcacttttcagagtctgtttatatttattttatgtataatgttgagggattttagttgtacttagtgtggataatagggaaaagtatgtctactccattttcttggaagcagaagttccctaagatgcttttaaaacagtggttaaataacataatgttgagagtatttgcatggtgcaaggcctgagtgctcaatagagggtgataattgccttttattatcttcatctttctcctatttgaagtatcagtcacactttgctatagaggcagctccagtttaagtttaccttgctttagataaattgtattatcactaacacatacatttgcatcttcataccctttattgcaattccatcaagatgtagattccagaaacaacattgtcttttcagtatttttctttttccaggcaattttgacaatgcatttttgtaataagactggaattactaattctggttttattgaaaaactgttagccatttcagccagaagaagatcatggaggaaacaataaattttcttcatgagctattcaatccaacgagatactgaattaagtgcaggaaatcagtacactttttgtttgataagaagtgttcctctgaaaaaccattcttagatcattataaatattattggttggatgcagtggctcatgcctgtaatcccagcactttgggaggccaaggcaggatgattgcttgagctcaggagtttgacaccagcctaggcaacatggtgaaaccctgtctttataaaaaataaaaaaataaaaatttagctgggtgtagtggtatgtgtctatggtcccagctaattgggaggctaaagtgggaggatctcatgagctcaggagattgaggctgcaatgagccatgattgcacctctgtattccagcctggacggacagggcaagaccctgtctgtctcaaagaaacaacacacacacacacacacacacacacacacacacacacacacgcacacacgcacacacacacgcacacacacccattaccagtcttcctgggaattttattctatatctgtctataagtttaaagttatgtactctagcttagcctttaacttcagagttaatttgaaatttatttaaaaactatttttggaaatttacataatcatgatgactgcatgtaaactgttagtaatattttatagagtttccttgggttttctgttagaatgaagtaataaatttgtgtcagaaaactatttgggaaatttagaagaaatttaagctaaggaacataagctgtggagcatggccctaagaatccttttattctcatttgataaacagtagaatccagacagggaagaaccttattttctctgcctttgctagttggtggaggaaaacttgctgtttgagacaagtaggacttgatctttctatcctgtacttttttcatcatcctcaaagagggcttatttcagtggatagaccattcatagttttgacagctcaaataacccttaaggatgagcaacaactgaaaagttccaagggctttatttccaatggaaggatttcaattacagtcattttttcaagttagtacaaggaggtaaatggaatcacagtttcaaatgttaaatttgaagactacaccattaccagtgtattttggaaataaaagatgcagccaatctaaatcaaagacatgattccagattacctcataagagtatgaggaagactacaggcagcaattgagccacttgatatggaagagtatgcagtgcatcaaatgtgactttcattaagccgtgttacccttgtttgctactgagggcaggaggcatccttttcaacagcctgtaatagcttcttgttgaaaggctgcctgctatacagatgcagcagcagagagagaaaagagggatacagattcacatattcgccttgttttttaaatgccatttttgccatttttggagttggtttccagtgcttagaatagctgtaagtatatagtagttatttactgtatgtttttgtgtgagtaagtaagagaaggaattaatgaattaggctttataaactggaagtttttgttgtgcacacattaagctaagcttctatcccttctcttctccacatggtaccaccagacttttccccacttcaccccctcatctaccattttttgttttgtgtttttgtttgtttgttttttgagatggagtctctcactctgtcgcccaggctggaatgcagtgatgccactgggttccagtgatcctccagcctcagcctcctgagcagctgggattacaggcacctgccaccatgcccagctaattacatcaaccttttaaaacttatttttctctctagaatttgtttgtgtgcacttaaagagtaagtgggaggatctcaagacagtacagaaagagttggacatctagttcagttttgcagagggagtgcagagaaacttccttggagttatataattgatttttggaacctcatttgtaggatagttgtgtggagaaaggcattcaaattgcattcactgtacttcttaggccaaggtagatctggttatgtacatacttgttatttggtagaatactgcttatgttggcattatcttttccatactacatttatgaactggaaacagttaaagcttgaaactgttaaaaaaaaaaagtgtacgcttacattgtatgtattagaagtcatatgattacacatcctcatcctctcaccagtcctttcatgtagagcagcggtttgcatctttggctatacattggaactaccttgggaattaaaaaaaaaattgatgtccaagtatcaactctggagattctgattcagttgatctgggatgaagccttggcgtcaatttttttaaaaagatccccaggagtttacaatgtgcagtgagggctcgttttagaatggtatattgatttgtgttccaattgttctttcttgcataaatcacatctgtaattcattgaccacagttgtctatgaggcttattaaaaatggtataacaacttacacatacatgaataattggaatgcagaatcattttaacttccctttcccagtctttctatagtcagtttgtatttaattcaacaattgttttttgagaggcccacatttattaaatgtttatcttgtccagcttaatttctctagaaacaaaatctcaccttcattttgtacttatcactggtttacatgtggtaaataaaattagcagaaacaggtttgggtatggtccactgtggtacacgggtgtcttatagagatgagtattcattggctatgaaatgttcagtaagttttacaaaggaaacgaagatcatcagttgatctagctggtcagttggggtcagttaaaagagcattattgtaaaagatttgtggtttgcctgattttagatcagttaacattcacccatgagaaggtaggatgtatgtcatttttattttataagtgaatatgtaactgtatttttttattttgtatttaaatttttattcaatatttcaaattaattaatttctaatgttaatacctaatatacatagatataatcaatatgatcactgttatctctagagtgaagacagtttcttgccaacaatttttatatcccattataaccatccagatgagttcattatgggctttcagtacacactatcagcgcttaagagtcttgagttcattctggtctttgattatcacatgtcttgaaatacacaccacattagatttgtaaataaattgtagaaaaatcttaagactgaaatttagatattaacaaacattatttcctcttgagatatgctaacagacatcagagcattagtaggtcactaaagagtgaagatgagtcagacccatcaaaatacatatactcgttctaccacttgatatgtacacacttcgagttggtaatttattcccagttgtttgtgacggttgcatttgtgcttatcttctcttagtttcacaagggtagctaatcatgagtttttgtctgtttttgctgaactttacctactgtcttattaatcttgtttatatcagtgtgagtttcttaaggacaaggactcgtaggcaccaacacagaaagcaattttaggaatatactgtctgaattaaatgtattaaatcagtcaacaaataggaaccttttgagaaatggtcctgaaaacatttttgtttgctttttttcctagagaggaaataaacgggtttataagctgctgagtgcaagtatcatggtctgtgccttttcttcttgactgctctgctatattctctttcagaaagctgagtagctcagcacagtgaatactaaagggaatgcattccttctctctcaggggactgaagcagtgtttaacaccactgtaaaatcctcagctgtggctttctctggtgtagaatttgtctaagaaagattaaaagaacaaggaaagctttgtgtgctgtttctctttcttttcttcacccctcctgctccaggctatcctgaggggggaaaaaaaacgtggagtattttccttggacctctggagtatgcatgttatgtatgtgtgagtcttagagaaaaataaaggcaaatgcaaggcatgcctgctagtgggagtcatcacccatgggtgaaatgaagaaaactacatgagtgcgtttgcgtttatacggccactttttccattgaatgacccaaacaagatgccagtgacaaagcattggtcctacatgtgataaaacagcggcctggccatttgcttaattggtggagaactcaggtgtgttactcttggcagaggtgaaagccttcatagagaattagaaggggtataatttgggcactgtactcagaatctttcttggtatattgtttaagagcttcattgcagtgactgccattcagcaagaaataagagatgacttttaaatatttggccagattttatagtggcaaggacagagttttagagctgaagagccatttagttcaatcccatcaatctgcaaatgtgaacagtaagcccagaatcacatttagtgttagtggccagaagggagaccttggctatgaacatttaccctaccggaaactaatggcgtaaccagatttgaaccttttcttccattctgtactaggttgtcttttctttgttaggaaaagcctattataaacggaacattgacatgaattttaatttttgcatattttcttacaacatttgcccttactgcattttataactaattgtatatacttttatattttcctttttgtactcatgattctaatgtttctatgtggcatttctcacaatctctgtggggttttattataatttgctaaattattcccttgtttgggggcatttatataaactttttttttttttgccatgaaagagaaagccacagcaaacaatgtatatatgtagctctttattctctcaagttattgtttttgttctcatcatctgagttattgggggtgacttcattacagcagtggaaaacacatggtaacctgccagcatcagaaggtgtcgctttgtactgtgtgtgtgtgtgtgtgtgaaggttatgtgggtatgactgtgtaggaaagaaaaaaagtgctactctttgtagatcaaacaattgatgagtcttaatgtaggattacgtgttgcctgttaaattgctatttctgctgagaaagataaaggcatttttattagtgtagttgattagctttattaatgttggacaaaatcaatgttatgaaaatgaaatctatagttttggggtaaaataaaatttaataggtaggtgacccattcatacacttatgtgaagtaatttttgaaatgataacatgcatgaaaatttactatctatactaaatgtatattcaaagatattcttcctctagggttctagttataaacccttataaacccttataaaatactatgattcacatatacaacttataaaatactgtgattcatcagacagctctagtttcattttatctattgactctgatttaaattatcactcttttttatgcaggaatatgtggtaacaagttatatggtaagaaatttaaatgtaaagattttgacctaacgttgattcagattgtagagctgtcagttgaaaagggaaacttcatgtttagaaatttgagttctgctgggcgcagtggctcacgcttgtaatcccagcactttgggaggccaaggcgggcggatcacgaggtcaggagatcgagaccacggtgaaaccccgtctctactaaaaatacaaaaaaaattagccgggcatggtggcaggcgcctgtagtcccagctacttgggaggctgaggcaggagaatggcgtgaactcaggaggtggagcttgcagtgagccaagatcacgccactgcactccagcctgggcgacagagtgagactctgtctcaaaaaaaaaaaaaaaaaaaaattgagttctaaaatgtttgtgaaaaatttgataggttctttaataaatgtttatttccaacaaaaattttcctggtggaggagttattaggaccagtgagcatgcatttttttttaccgtcttgattgtattatcatattagcttcaagaaatgtttgtttcacgttacttatctttgtttgtcaatgaggtcagacactttcccccacgctgagaacagtatccactgcctctgaggtggatagtctctagaaatcctttccctgtcctggagcagtttgcctgaaagtgccatagttggtagcaaattcccttccactcctcttcctgcctgttaacactttctggaaacccaggtccccatgtgctttagcactctctgtaatcatttgtgggcctctgcagatgagcagtctgggagctgtggatgaggggctgggcaacttctgtcatgtgccattgctgtgagatcttttcttcaccagaatctgggggtgatttagaataatggttagttagtgacatgaagttttggaaagttttttgttgacatttttaagaagaagaaaaactgatgatgaactaaaataaagctgttctttcagccatgtctctgaaaccattgagaaggtttccaggtacattttgggcagtaaagaagatgtggactgggcattcctgtaatcccagcgctgtgggagcctgaggcaggaggatcacttgaacccaggaggtctaggccacagtgagctatggtcatgccactgcactctagcctgagcaacagaggaagactctctaaaaaaaaaaaaaaaaaaaagaaaggaaaagaaaacgtgccctgtttttctgttgttgagccttatttattttccttgctctcagcagctctgtggttccatcacttggctgccttcacggtgcctctgactagttttggaaatagaagtggtggtacaaacaacggggtggagttgcaggatacattgtggtgatatagtcttttcattctctatatttcagccaatatgatcttttcaaaacacaggttacattatagcattctcctgcttaagatcctctagggcttcttattacgctaagaataaaatccaaatacttggtcatggcctatgaagccgtatgtggctccctgcccacttccattcccactgtccatctaggtcctcaggattcccttatcaaactttcttcagttgctctaccacacatccccatgtggtgggttccattctgtactgtagctcttaactcaaacattagctctttagtgtggtcttatcttaccaaccatctaagtttgccccctttacttttttttttttttgagacagggtcttgctctgtggcccaggctgaagtacaatgaagaatatgattcactgcagcctcgagctcctcggttcaagtgatcctccagcctcggcttcccgagtagctaagactacaggcacgtgccaccatgcttagctaattcttaaaaaaagttttttttgtagagtcagggtcttactatgttgcccaggctggtcctgaacttctgggcttaagcgatcctcccgcctcgacctctcaaagtgctgggattttaggcatgagccaccgtgcccagccgctttacttatgtcttactctgttattgtttcctctgtatcttcttaataccacttataaacatctgaaattacccctttgtaaatgtatttgcttatttattattattttcttctgacttctttcattgaatgaaagtaagttccatgagagcaggaccttagggatgttattaactgttacatccccagcacctagtgctatgcctagcagtgagtaagaacattaatatttgttgaatgaatgcttgaatggccaaaacaagcccctgttatgtggcaggagctgtgctagcagtaaaaaatttagataagttgaattcagtctctgcaaacaatgttttccataatctggaattgttgtttggaattctttacagaaattcacatccaggctcacttggaaaaataatcttgctgattgtaatttttctcgttatggttgttcttggcagtaaagtcagtttccaggtgagaatgttactgctcttggccaaaggccactgtaaactttccagtattcctgagggtcttcaggccttactccttgaataagacagtgctccttgcttgaagaactaagttttctgagagtagaagggaacaatagaaagtgtacacatcagcattaccagtttattgttttctggacagttatccaaatttgcttaaggacttaattattaccagatcaaataatgttcccctcactttttagtctagtatatgctgtatgctaccctgtctgtgattctgatttcaaagtgagaaacaaattagcaagcagttgtttggtgaattttaaatgcagtggtgacccttgcccaatctttcataaaaattattttatatttaatgagttatatcttggggttccacaaatagtaggttcgatatttaggattaggtgcataatacctggagttaagctttgcagagctggaatttggactgtgtgtcttggccagaccctggaagcacaaggacaatgttgagatgaaaagattgagaatttaaaatctgtaagaatttaaagccattttacatcacaccataatttctcttcgctggattaagacatttcacagctatttataaaggagtgatttgctactataatttaattcacttgacaatcgtaggacattggatccatagttatgtcaagctagattagatgcaaaattggtaggaagacttttgtagattaaagacatatgacagtgaaatgcagaatttgagcttctattgaatcctagttcgagggaaatgctgtgaaggtcatttggggacaactggggaaatctgaaagttggactgcattagatagtattgaataaatattaaataacctcttgagtgtgttaatgatattgtaattatggaggacaatatgttccctttcttgttctttttgctttctgatagggtcttgctatatttcccaggcttttatagagcagtggtgtcatcatagctcactgcattcttgaactcctgggctcaagggtcctcctgcctcagtgtctctgtagccgggactacaggtgtgcgccactatgccctgtaaatttttttaaaatattttaatagagaccaggtcttgtgatgttgcccatgctggtctcaaatttctgtcctcaagtgatacccctgccttggcttcccaaagtgctaggattacagggatgagccaccatgtccggactttaaaaacattgttttccaatacgtcatgactattttgactatttgattggttttaaaatatctagttcattttcatgttgttccagatgaattcacttttatattgtatcagttgatgccatttcaaacttgaaaggtaaaagtagtcactgttcttcaaaccaaaatgactactaagaggtgtgcgtgtgtatgtcaggggaggtggagggaaattgtggatatgaatgaaaataatgagtgtaactttgatcacacagataatacatctacagcctttactaaagctgcctttacagtttctggcttcagagatgtggtaagtgcctcttgaaaggttgatatattacttttaacaacataaaaatgatatttgccttttttagagtctcttttttgttcactcagatttaaatgtatcatctaacagtcttctctttgtgcccatgttcttccatgagacacttagaatgtctaaaaagatgagtttggtattgttctagccttccctttgtttttaagggggactttgagtctatcaagagtgtgtgtgtcagctaagattgtatagctggctggtgcaggagctggaatttaatgttgtttttttctggcctctcagtacatcacattgtcacttaagtgagatggcaagcatttcaggtgctcttacatatatctgcaagcatggataacatttaatgccagctctcataattatgcatcacttgttgaattatttattgtacataccctactataaattgtaaactcctcaagggcaggatttttgtctgttttatgcattgcttttttttgtggtatgtagaactctgtctggaaggtgataggcactcaacaaatatttattgaatgaatgagtgaatcaaaatagaatgaactaggaatagattaatggctgctcactttgcaggatttcagggaaataattggtcagctttaacaacacatccccctctaactagctgatctaaactgaaaaattagacactggcttcctgtttaatttcccgtactcgtgggagtgataatacattaagctcacttaggtcagtgatttgacaacttagagtgaatgatttcaacaacccctttcctaggagcactttttgttgggggcagggaggacgggtggagtgctactaagttgaagaaaagtacagatggaaaggggcaggaaaaaagaaagacaaggagatgcaaagacaaactttgagcgtatcatgattttgagcaggacaactttgctggtatgtgggttaagaaatactttggaataaatggcatggtctgatctgtcaaacttgttcatggtcctgtggtcccaagaatctgtaccatgtaatttgtaactccagatagtcaagacttgaatttggtaactcttgtaattcttggtattgtgtatggatgctcatgtacagtttcaggagagtaagctgttgttcccatcttatgtgtggcttattatatcatgagttattactgtttgtcagttattcctgggtaacgctgttaagaaaatgctggcacttcaaggggtttgaggaaatgttgaggatcagatttatttaatatgtgcaaaattctagattaggtagaaagttgttgaaatcatggatctaaagtgaaaaattgagctttttagagcacctattagagatcagacaatttctagtgtagagcctgacacataagagttacgtaataaatatttggtgtgtgggatgagagggaaggagagaggaggaatgttgtgagcagctactcattgaagttgtgaatgcagccaagctgatggttccatagattgtttttctctatgttgaggctttaaatggtatccttaatttactgctacctttcagatgaatgcaactggacatcaagtagactaggggaagaagagtacatctgttttccctagagaacagggaccccccgccccgggccatggaactggtacctgtccatagcccattgggaactgggccacagagcaggaggtgagcagcaggctaacaaacattaaggcctgagctcctgtcagatcagcggcggcattagactctcataggagtgctaactctattgtgaactgtgcgtttgagggatctaggttgcctgcttccatgagaatctaatgcctgatgatctgaggtggaacaggtgcatcccaacaccatcgccctcccatccccaggtctgtgggaaaaattgtgttccatgaaaccggtgcctgatgccaaaatggttggggaccgctgacatacaagaagagtaattcaaaaaacagaaatagcaatacaaagttgcagtctgaatttgtgcatgctattttacctcttggtgcctcaatttccttatctgtaaaatagggttactaatgtatatttcattgggttttttgggtaggagtaaatgaggtaattggtaaaaaggagtttagatacagcatctactgaaatatcagccagtagaagtattttgcggtcaatttgttttgtatgtgcccagagggaagggaaatatgcttaccaattttgttcattgttaccgtctgtatagaattttgactatttgattggttttaaaatatctagttcattttcatgttgttccagatgaattcgcttttatattgtatcaggtgaggccatttcacacttgaaaggtaaaagtagtcactgttcttcaaaccaaaatgactactaagaggtgtgcgtgtgtgtttgtgtgtgtgtatgtcaggggaggtggagggaaaatgtggatacaaatgaaaatatgagtgtaactttgatcatacagataatatatctacagcctttactaaagctgcctttacatagtttctggcttcagagatgtagtaaatatccactggaatgttagctcttaaagctggtggtcatatttatataggttgggtatcccttatctgaagtgcttttgacagaagtgttttgggtttgggataattttggattttggaatatctgcattatacttataagttgagcatcccaaatatgaaatgctgcagtgagcatttctttggagtgtcatgttggtgttcaaaaactgtttggattttggagcattttggattttcgattttcagatttgtgttcctcaatctctgtggtttaaggctgagagaatagatctaatcagcagtcagtagagctcattagtagaggagagaggagagttttcttttaagaaggctatggggtcttgtgaagagacgagatagcttgtatttaattcacctgacagtcattagctagtaaaaatgaaagagagtctgggaactggaacagagagctggaaattcagctccttccaggcagatctgccttgaaattccggggaaatcagaacaggaacctcttcatttcttcatttcccttcactgcgtagtagtttattttgtgcttttggtaaaatgattcaaggtccaggagacatcctgaggtgatgcagtgtaggaaagcatttcagaaaggtaagatggaagacagatctgggcacagcaatgtgaattggacatttcgttcatcctttgggcttcctagaattagctgtgatccataggactgtcctgtccatcctggtgttctctcagaatcaggagcagctcactgtgcgaaaacccatctgaggaaaacaagaatgagctgatggtcactgtatcccaaattgacacactagttaggtagcccttgggtgtgaacttccttaaaatatttaaggaaagagactgctgttaacatactcagggaacaattatatgttgtttaccacatgacaagagaagaaataaacgttagacatatttctgggagcttagataagttgaaatatggaggaattaaatgctatatggtatgataatataaatcatttgaaagttgaaagttttgttagagctaagaaaggccttgaaaccatccgatctcaatcctgtaccttaaaaattgggaaactgaagctgaaagatgggcagtgatttctcccaaagttttgttgcaaaatacagggcttgtcttgatatcggaatactttctattctaagacattttttttgtctttaagataaccagatatgtatctgagggtagaacatacctcctctgtactatacctttgaagtttttgtttatatatatggtttgtgcatacttatgtaagtgttgccctcaaaatggaaaagattcaattaggcaagaatatcaggtgttgaagtcattttatccaagagctatgaagtctcatattagtcagttgggcatatcgtcttcatgacctttttgctagtgttcccatctgttgtatcattgctgattgtgtccatgtgagacggaaaaggagcattggactcttagcctaggaaccatataacaactataatttaaagcagatgttattaacctagcataaaagatgtgagaagtctgaagtgttagagccagagaaaaggtgagattaaactcaaatcttctgaatctaaaagccttgttccttccaaaataaagataagcatatccttctactggaaactttacagactggcaagagtaagaataaaaagagcaggtgatatatgattgattgtgccattattgatagttactgatctgttgcatagtaatggagagcttgattggatggtgatcctccctgtgtgcctcctgagtgtatttggaacatcatccaggaaggccttttaaagaagacaatacttggagaaggttttgaatgtttgaaaagaagcatgggccaggtgtagtggctcatgtccataatcccagcactttgggaagccgaggattataggagtttaccagtcctccagtgggaggatcccttgaggccaggagtttgagaccagcctgggcaacgtagcaagacttcgtctctacagaaaaatgaaaacataagccagacatggtggtgtgcgcctgtagtcccagctacttaggaggctgtggcgagaggatcgcttgagcccaggagttgaaggctgcagtaagctgtgatcgcaccactgcactccagcctgggttacaaagtgagacccatctcagaaggagaagaaaagaaatgtggtttcactagagttatggaatcaggttaaaagacagtattacctttaatgtaaattggtggcacatctctgcatcttagcctcaactcagaatattattggtttaagagtcagagagcttaggggtaaaaggctctaaaagcctctgaatttcaggaggttggtactttcagcggtctgtctccatctctcagcactacttcctctatgggcttcttgtggttcagagacaaagacgatgactgttctgcctgctcagcagtcctgggagagagcaaggctcatcgtttctgtgtccaacaacaatcttgcagcttccactttacagtcctcctttggttatgtggctattcttgactgattgactggatatatgtatagtcatcccactataccctttagtggggcgactctcatggccctctcagcattcccgaaactgctgggaccctgaggcaggtggggttaattcttcaaaagagacttcagctactgttaccaaagagtgaataaaagggctgaggtggcaaaaacaataatgggtttttgaatatatgttactaggctaggcacagtggctcataattccagcactttgggaggccaaggaggaaggattacttgagcccaggactttgaggccagcctgggcaacacagtaagaccttttaaacaaaaattagccaggtatagtggtgtgtacctgtggtaccagctacttaggaggctgaggtaggaggatcgcttgagcctgtgatgtacagtctacagtgagccgtgatcatattactgcactttagcctgggcaatagtgagaccctgtcttcctgtctctctgtctctgtctctgtctgtctgtctctctccctctctctctctgtatatatataatcccagtatgtttttatttctttctacagataggggaaggtgatctatttgaaagtctaatgcagaataaagtagtagtagttatcccctggcagagtaaaaagataagcaaaacttgggacgtcaacttacagcaagagctgtatggaagagaacagtgtggtgtgtagagagaaatcataaagctggctgctttgggccccaagaaagtctcgcttgtgatggttgtatacatggccgtgtggagcttcagatataagaaaagaattaagagatatgtattaataaggctgggcatggtgcatgtgcctgttgtcccagctacttgggaggctgagtcaggaggatcgcttgagcccagaagtttgaggttacgatgagctatgattgtaccattgcaccccagcctgggcaatagagtgagacattttttccatcagctcagtgtattaaattggttttctaagttaaaggttcacaacttcattatcgttactatgcagaattgcacttggtcctgaaatctgtctgaatttctgaataatagtttcttgtcctcaacttgtgtggtctcaggttttaaaacaaactaaggttgttactgccaatttctaaccactgttgcatttgtagtaattgagtgccagtggttggaggtttagagaaggtttaagattaactgattccaaaaatatctgtgtgtgtgtttgtgtgtgtttccatgttgtctgtgtgaatatgttagaataggaatagcatatgttttgattaggcatttttctttgttcaacatacactttggaaaacctagagaatttcagtgggattatagtatataatgactatattctgataaaatcgtggagtcttaacatttcgggtaacagattatctgctatttactggtatgttgattcgtggacagatgcttctctgtcttcaggtaggctccccaggtacactttcttgcagtcccttctaccaggtagacatgcaagaattaacaataaatgccacacatgtgtgttttctcttttttctgcttgtgagaggtgtttaaactttgtggaaatttattagaaaagatccattgtttggtagttctgatagcatcaactcgccctttatctttcatgatgcattgagacttccattactttgtagcgcctgactgctagaattgttcccagagttcaggggcttccaaatgacaatgggctgtaccgggctttgtggccttaataagccctctgttactggaattttaaatattggcatacctatcagagtctggccgtgtgtcaggagaatgttggctttagagccaccactgatggatcacatgtttttttctcaagagagcaaacaagcactttttgtttaggcttactaatgtttggcaaagaaatatagctgtaattatatatcctcgttcttgttactctctccccatctaaattttactctccctacccctaactttatataaaagcaactagggttggatctgaaataaatgtcatgaatgaataataatttctttcatttacacagtaattcaacctgttgaatgctgacttaatgctttactacactctaatttgactggaagatttggccttcgtgaatgcaaagaagaggtaaaaaatagaaattaaataccgactgactatgaaggaggacatttttcagaagggttctccctccttctatttctcatcttcttgtgtttgccccctgctttctgtgatacttaatacttaggagttgttccacaaatcattctttactttgtgtacccagcagtatcccagcagcaggattctccagggacaaggcctaggtctgccactgagggtagtctgcttccttcatcagaattgccgctgctggccttctggaccattagagttctttctggttgttatccacttttcattccttctcaacccatagaattccaggtggtgagtcagtttttctgtatgatcatgcttgacaccccaaaatctacctgaaagtttgacagatgcatggaagccaggagcattttaggaagctgtactgctcttctgagattttctgcctacttactgtctgagcattcaacctgtctctctcaaattttctctttctctaaggtgggtccagtaatgcgagtcggcagcccactttgctgttcttggaagcgaagtactttccaatagaagtcagttttaatcttctttcaccgtgaggaatgaatgaccattttaataaataattcattcctacagttcactccgtaaggagcttctaagctccctccatgatggtttctgatcctgccagggtactgctattttatctgtcaaatgtgggttgttagaggtactgtgtcataagaggcagtgcagttcggaaccctggaacccccttcataaatttgcaaaacacagtgcatggggcctgctatggcaaggtatgctacatggagcctcagctgtctgctccctctcttctgtcagcacagctagcagtcagagacaaatggctaaccctctttgagtctcttggagtaaagcctggttgtgttctgcgtggattgcatcctgtgcagattgtggatagcaagggcttccttgcaggcctgttgggagcattgattgagatcatgggtgtagaaagcctggactatagccagagtcaataattattagttctttatcttgagacaaagggaagtgttaaaatatttttatatcaaggaatctcctacaaacactgtcctccccactgcccactgccagtatttacatgaattaattttctccttatcttcttactctcgcccacccgcttccctttccttccgttccaaagttatactacacttattcaggatagaaatttcctttataaaaagttgtaaaaacttcaaagtgcctgttgtagtatatatctttaataaatactcccctgctatatttgttaaactataattatgagcatacatttcataaaaataaagcccatttactcataaactgtatgtttacatgaaaaaatacacattttataacccactccagacctactaaatctgggcgttagaatctcaatcttgggttttccaacctggctcctttttcgaaataacctggaacacttaaaaaaaaaaaaaaaaaagcaaactccaggctcaatcccagatgatttacatcagcatattttcagggttggccctgggcatcatttgtttaagcttctctggtgattataaatgtgcagccagggttgagatttaacggtctatcctaagtgcttcttaaggtctgaaactataactattaagtgagctggcttaatttatttaatctttgcagcaaccttatgaggcacagctggcattatccctattttcagatgagaaattatagaggcttggagaagtgtgaggtaataataccaagaatgagagttacttgttctcctatgtcttataatcaaatagtatatatagtattaacatctacttggggatgcaataccttttcacgtgatggtcacaatctatgtattacacattggttttggcatgaaattaaactgaccatctcaatatgccttggaaccaagtgtttgtgtgctgaatccttttgaaatatagacacctggtgtgttagtccatttgtgttcctataaacgaatacctgagactgggtaatttataaagaaaggaagtttatttggctcacagttctgcatgctatacaagcatagcaccagcatctgcttgccttctcgtgaaggcctcaggaagtgtttactaatggcagaagggaagggggatccaatgtgtcagaaggagcaagagagatgccaggctcttttaaacaaccagctctcacgtgtgaactcacagagggataactcactcattccccctggagaacaccaagccattcatgaagggcccacccccatggcccaaacacctccctatgcccagcttcaacattggttgtcatatttcaacatgagatttggagaggacaaaacatccaaatcgtattacctgcaggttgacattataaattcattttgttaaactcagtggaaatgagaatcaggttgaaactcggggtttattactgacttataaacccaggtgtgctttgaatgcattggaaagcaggagcaatttaacattctgtgatttttagaggtttggcagtgaaaccctttggtatttatttaataaatcctgccttcacagtcatggattctttttgaatacacccaatttctcctgcttcccaactcttttttcaagtgactttgttaccaggtaccgttgttgcagaggagtgatttgattattctttctctgtagaaatggtgatgatgtggggcaaatctacctcaaactgtaaactatactcactttttccacagatggggtcttgttatgttgcctaggctagacttgaattcctggacccgggtgaccctcctgcctcagcctcccaagtagctgggactacaggcacatgccaccacacacccagctatattcacattaaaaaaaaaaaatcatctgtaattctaagagctccctgtgtggagccttccaagtggcccacctgtgtgggaaagctgccctgcaatatgggcccaaaaattttccttggttttcatgtatctgagcaagttgcttaaaggtgcctggttctgtgtgtttgagattatttattccatttttactaatagtttagagaaccatgattgtgcatacatgcacctgtttgtttagtaaatatttattgagctcctaacatatgtcatgcattgttgtaagtagtattgaagttacagcatccaaaccaaatagacaaaatctctgcattcgtgaagctttatttaatggggaatatagaaaaaagtataaacacataaatcttaaaagtattttggaaggtgagggatactatttagaaaaagaaaacatgtaaagaagaaatcccccttaccatatttggggaatggtaaaatttttaataaggtggttagggtagacctcactgagaagatgacgttaagcaaatggttgctggaggtaagggtgtaagctatgtggatgtctaggaagaacactgcagacagaaagcactgccagtgtcaagttcctggagtgtttgaggctttagcgaggaggtctgagtgctatgtgatatgtttactacctacctataagagttttatggatttggagaagttttctctgcaatatgaatatatagtctcacaaatgaggataaagtttatagcaaattatcatggatttgattatgtcatggcacttgaaggaaagagagggtgggctgtgaaactcccttaaaaataacccatttttgaactcgacataaattttcagggtcctataattttcttatcaggagtgtctcacactgattgctaggtgtagaaaaatgtatgttgcctgaatctgaaggcatggattgtaggcctggttataccacagttacttgtgggactttaggaaacatgcttcatctggtcctgcttctgtttctgctatcttacaatgaagataattttccccctactttttaaacttatttgcagtgaagactagataaaaaaggatatgactaacacattaaattctgaagtaccacataaatatgacttatttttgcaaaatttaagagcacagaatgttggttatcaaagagtgtttaaaatgacctttctctgttttttgtaagtgttgtttgagagcacagtgatgaccacttaattcctttcctggagcaagacatgtttcttgtgggtttgatttgtacattatcactgaaaaacttcatcagtgacaacaacaaaaaagcccaaaaggaacctaatgaaaatagtagtgaagttttacacattacatagttacccccctgccacacacacacacaaagaacgaaaaaaagaaaagaacttggtgaaatatggtactttatattttaaaaggcctaaatcttgcttgtggaagtgggctttagaaagtttgcagcttttgagttatggagaggtggtggaagatggattatctggaactggatggaaagttgttctaccaggagtggctcataatgcacttggcaaaccgaagtagctgtggtggatgtttgaggtgtgtgcacatgtgcattttgtgtatccctacacagcttaattcgactggatgcagttttctgaattcacctgtttcttgcaggtgaaagtgcacacaaacatgcaagattcacattgtgctcaaagtgttcctgctatgtcaagcacattgaaacaaatttatgttttcaaagtaagctttataacagagctgtctgtacaggggatgattcagtccgatacagtcagggaaccgtacatagaatagaatgactagagtataatctgcaaaggatggaatggcagaagtagtcagaagaggtatgcaatggttggatcaaaaagagctttgtatccagcgtcacagggcctcaaattgtactgtaatcatatgtcttttacctgttctctggcatttaaatattcttgtaaagagctaagccattactgataaaatgtctgttgtgtacagttgtacaaattaaattcagtcacaaaactgaaagaacagcagtgggacatctatcctagtgaaagttagaatacacttttgtggtctttaataacagagttgattgtttaccttctcctttggttagaagactggtatggggattgtttggaatgaagaggtaggagagagaaataattcaattctgtattctcccatcatctttatatttgaactgagaaatgtgtgtttctatcattcattcaaattattaaacaaaaacagagatcaaaataataagaacagatgattaaagagagtcccatctgccccatatccaacctttctctcttcaacctcatttctactcagattagcagatggcaccagttttgggccatggtctctcattttctgattacaaggggttgttcttttgcccgcctcctttaaaacaacaacagaaaaattggtaatgactgactgtatgcccattggccggggcaccaattcctgaggactagacagaagcttggcattcaacccagccttctgccaggatggttctgcctggcagcaaaaagcctggttgaattaagcttgggcttttagatcctagaagtcttgtctattggtggctggaaaaatagctagtactagcagagcctaaaaatatcagagaaaaaaaagcagaggctcttagaagttgcttttcctttttgtttctttctcagacagagtctcattctgttacccaggctggagtgcagaggtgtgatctcagctcactgcagccttgacctctagggcttaagtgatctttccactttagtctctcgagtacctgggactacaggtgtgtgccaccacgcctatctaatttttgtagttttagtagagatggggaatcatcatgttgtccaggctggtctcgaacacgtgagctcaagcgattctccctccttggcctcccaaaatgctgggattacaggtgcgagacaccacacggccaagtttttttctgataaagactataaagggaaggtagggaaaggtgattattgccaatggtggttggtatagtgctgagtgatacagaatgcaggattcatgaattctaattttgcatgtgacctctctgtaaaggaaaatgaccctctaactaaatgggaaagtaaggtttcacagatgagatagaagttcaaggtgaaagaacagtctataaggtaatacctgcctgtctgcagagaatggattcaaggctcctgatgcaattgaattatagcctcattgtcatatttttttttttttttttttgagactgagtttcactctgccaccaggctggaatgcagtggcctgatctctgttcactgcaacctctgccttccaggctgaagtgattctcctgcctcagcctcctgagtagctgggattacaagcacgcaccaccacgcctggctaatttttgtatttcaagtacagatgaggtttcaccgtattggtcaggctggtctcaaactcctgacctcaggtgatctgcctaccttggcctcccaaagtgctgagattacaggcgtgagccaccacacccggccttcattgtcatctttgagttaaatgcattttggctttaataaaaacaatatgagtaaattctgaacctataatttgagtcccaatagtatttcctaacaagtgatataagtaaacactgagaaaagagtatagtgcttacagaatgacagcatgaattcagcaattcctgtttagcaagaggtctgggccaataacttggggatgtcatagacagaatgcatttggctttcagcaaaatttttggtctgctctcccataatctctttgtgaacaagtagaaaaatataggcggggtggcattatgattatcagtattcataattaattttataactttttccagtggtgattaaattttatttcactctagagatgactttctaagattatcataaataatctatccttggctctatcttatccagatttttgtcttagactaggatgaagatacaattttaaatggtaccaaaacttcttgggtcataaatatggtagatgggaggaacaggacacatatagattttaactcttttggcagtggcgaaaataagatttgctaggactaaaagtgtgattatgtttgaaaatccaactgtgaaaatagagaattgatagagatgagacttacgatttttagacgacacttacagtgagtcagcagcatgtagttagctggcaataaagctaatggtattttcaagtaccttataaaatatgttttatgtaccggactgtactttgtatttggggaagaggggatagaaacattgaaggtaagatttgcccagagtcacagatactgttaatgttcacattcttcacattttatttgtacatcactcttagtctttaaaatcaaaatacctaaatagctgtgaaaattcagtggattaaaagctactttgggaaagacagtaaaactttattcaaatagggattttcatataatgttaattttttgaaaaatcaacaattttaagaaaaaaataggatatatgaaaaactagatagttaagttgaagtttgagcatctttcaaagagtagggaagtttacatattgcatattatacatttaaaaatcagttccagacatatttttgttcattcatatatatgaatatattatatatgactatattatatatattcatatatattatatgaatatattatatatgaatatattatatatgaatatattatatatgaatatattatatatgaatatattatatatgaatatataatatattatatatgtgaatatatatattatatatgaatatattatatatgaatatatataacatatgaatatataatatgtatgaatatgttatatatgaatatattatatatgtgaatatatataacatatgaatatatataatatatatgaatatgttatatatgaatatgttatatatgaatatatataatatatatgaatatgttatatatgaatatatataatatatatgaatatgttatatatgtatatataatatatatgaatatgttatatatgtatatataatatatatgaatatgttatatatgtatatataatatatatgaatatgttatatatgaatgtgttatatatgagtatctataatatatatgaatgtgttatatatgaatatatataatatatatgaatgtgttatatatgaatatatataatatatatgaatgtgttatatatgaatatatataatatatatgaatgtgttatatatgaatatatataatatatatgaatgtgttatatatgaatatatataatatatgaatgtgttatatatgaatatataatatatgaatgtgttatatatgaatatatatataatatatgaatgtgttatatatgaatatatatattatatatgaatgtgttatatatgaatatatatattatatatgaatgtgttatatatgaatatatatattatatatgaatgtgttatatatgaatatatatattatatatgaatgtgttatatatgaatatatatattatatatgaatgtgttatatgtgaatatatatattatatatgaatgtgttatatgtgaatatatataatatatatgaatgtgttatatgtgaatatatataatatatatgaatgtgttatatgtgaatatatataatatgaatgtgttatatgtgaatatatattatatatatgaatgtgttatatgtgaatatatattatatatatgaatgtgttatatgtgaatatattatatatatgaatgtgttatatatgaatatattatatgtgactatatattatatatataatatatatatgaatatatattcatatatatattatgtatgaatatatattcatatatatattatatatatgaatatatatgtgaatatataatatattatatatatatatatataaaatgccataagccatagagattcagaactaataaaaggcaagttgcttgctcattaaaagctaataaactagaaggaactacaaaaagttttaaggttaagggatgcaaaattgattagcaaaggcagatcagaaagagtttctgactcatgcttcattggtgagaacagcaaggaagaactgggaatgagaatcattgagttttggccgacttagaggcagagtgttttaaaactgctttttggggccgggtgcagtagttcatgagctgggggaaaaaaaattacttcattttcccacctcagtttcagtttcctcatctataaaatgagataacaacagcgtggagtctacacatgaattaatgactttatttatttatttatttatttatttatttagagaccgagtttcgctctcgttgcccaggctggagtgcaatgacatggtctcggttcactgcaacttctgcctcccgggtttgagtaattctcctgcctcagcctcccaagtagctgggattacaggcacctaccaccatgcctggctaatttttgtatttttagtagagatgggatttcaccatgttggccaggctggtctcgaactcctgacctcgggtgattcactcgcctcagcttcccaaagtgccaggattagaggtgcgagccaccgcgtctgactttgaaatattttttttttaagattacacagctaaatggaattctctaggaagcacatccagctgctgaacctgtgatatttttttcttatggaacgttgattgaacagcttccatgggtgacctggtttggatttccgtagggccttgcttataatgctgaatacactgttagtttttacttttgtgtcacaaaagtaaaggttcatagttagatctaagccccttgggggacaggaactgtgttctattcatactttgaattgctagtgtctggcatgtagtagtgattaatatattttttaaaatgaatgtcaagtattatgacaggcactggtacagaaagatcaagaagaaatgacctcttcccttgtgagaggctcactattgtgatagaccaacctctgaacagaggaattaccatctagggggctgttataacaggcatgtgctgttcgagttcaggggaaagatgcacttgctcaaagagggaagtttgggaggtgtacgggaaggaggaacccacctggatcttaaaggctgagctggctgctgaagaagagaggggcacttgggcctggtcaccagctgtgcaaaatcaacaagggcaaggaagtggctgatgaagcctgaaacagggagattcccaaatgtgatctgtgacctcaaaattgaaaattttagttagtgtaattttagtatattttatgtgcatgttccaaagttttttgaaaattggttttatatgtttagcatatggggcaattctaaattagtatatttgattaacgttgtatgctagtcctttgaaattctgcagttggattgtgtatatattgtgtataatgttacctcttttccgacttcatgaacctaacatttaaagtggaaacaaatgcacgcatgtgttagtgtttagtgcagcaagaaagcacggcccaccacttccaagaagtgagtcgttgcatagggtgccccgtcctcagaacattgctcattgttcattttttattcctcagctccttagttctactcaaagtctaatattagtttaactaccaaatggcagaaaccagagtacgttgtacatttttcttgaaggatacaactggaaaaaattttgcagaggctcatgtgatgctattttccttccgtggtgacacttagaattcgtttcacattgcctttgagagaaacgaggaggggggagaagcctgtatttgatagttttgtatgttcctctaaagaaagagagtgcttgaaaaaagaaaggcaggctttcagatgttgtctgaacaaagctacggaaatgtgagacgagagcagcatctggagattttcaaacactggaacatgggctgcacgtttcttttgctgttggaggagtgaaaagctgtttcctgtcatttcccatcttgtcacttccagaaccaacatcttgctacttcttgcaccagctgctgctgctgttgttttttttaccccctccacagacagatggtaaaagagctttgataatcctcgcccaacttccccagttctaaagaagtttgcggtgtggtacctttatacaatgatcacatgccctgatacctactgtagcctgttaatagagttgggaacagagcagaaggatgtgctgcagacttttaatgtctatggcattctttgtcatgtctcatgggaaatgctgtgcacaagccccatctctgtggatgcttcgatttagcttctgaggttatatttagaaaagaggaagttgtggggagtacctttgcttccataagaatttgagatttctgatcaagatttctctgtacattgaatccaggatgggagttgctcttgatattcttgttcgtatccctaggttttcgcaaagcagaattaggcatattggatataccatcttttcacagggctgtttatccttaattactttttttacacctatttcttccaatatttttcttgcattacctagtgcaaacaggaacttagaagttaatgcagaaaatgccgtatgcataggaaagatatttgatgcagacaaccttggttttgttttaagttttattacctttattattacaaactaaaaatgataacctcaatgagggagcttagcctttctgtccccccctaaatcatggttgctttcctaagtataaaagtaacatactcattgtagaaaactttgaaagtagaaaatctattacagaaaatacaaagtcatccataattccttaataaccactcttacatttggtatatttccttgtagcttttttttagagttatgtgtgcctgtatttctcttgtatacttataaacttacattaatattgtggccattttccagaatggatctggtggtagtagtagtggtgatgataatggcataacctaaaatttattgaacatttattatgtgatagtcactatggtacgtgctttacatatattacacatttcatttctcacatcagttctataaagtaaggattatttatttttattttagacatgagaaaagtgaggctgagaaacatcaagtaattttcccaaggtcacacagtgcgcaataggtgaagctgggatttgaacccagatagtctgtcttcaaagctcatgctgtttgtcatttgctcatctatgtttaaaaggtctgaatattttttaaattattgatacatatagcctaagattttctatttattcagacttttcagtcatgagagtacttactgcgctctcaccatcttcacatatcatcaaatatgttttacctttataggtgtttggggtgaatgattgctcagtttttacattggcctttcttgattactagattgattgggcattttccatgtgttattgatcatttttatttaatctataaattgtttatgttctgtgtggctgcttttgttcaacagttaatttttttgtatacaaaatcatcatgtgttaagtatattaactctatgttgtgtttgtttaaaacatgtctccttctgttaacttgcttccttatatttgaagaaaattgtatgaatgttttaaatatgtacatattcatattttttctttataattctctcccacaaatcagttatttagcctatgttttcctttattttatggtttttactatttataacaatttttaaaatcaaatctgaaatttattttaatatatagcatgctatgagactttgaatttattttattgatgggtaatactttttgtttttgttttgctacttcctttaaaaaatattatgcattatatattccactcttctgtggtggcattctttattatatatttgtttattttgtctaccagcgtctcttcaagcaatctttctgtgtcagtggcctgtgtatgggtatgcctacagacattttatggatagtaaatttgtaaaatgtgcaagaagttttttgtcttaaaagcacccagactcagcatcagaaggcccatatccaaacctcagtataacctcatgattgacttgtgacatgaccgcatgtaggcttaaatgctgtcaggaaaattaaaggaagtaaaacgtgaattgagaaatttggagatttctgaaaattttgaaaattgagattttgctgttaatatcacagccgtatcactaaaatttccacaatcctttgaatttgtgaaatctatataaacatgatttaaagtacttatgatattgtcctttttttcatattacccaaagtatggaatttgtggcaaataaataaccaggtatatatggcccatatagatatggtttttatcctgcacttcttttgagatagctgggggctttactagagagaagaaataaaacaagataactttggcaagtatagatgaagtttgagaggtgtcttatttcattttgtgttgctataaaagaatacctgagagtggctcatggttttggaggctggaaattataagagtatggtgctggcatctggtgggggcttttttgctgcttcattccatgggagaaggtggaaaagcaagagagcatgagagcaagaggaagcagaactcactttaataacaacccactctcgcaataaccaacccaactccagtgtgaatgacgttaattcactcatgaaggcagtgaccccacgatctaatcacctcctgtttggccctacttcccaatagtgttgcattggggattcagtttccaacacacaaactttggggacatggttaaaccatagtaagagggaagtttaacatttgtttaacgttggtatcgaaaggaactatttacgttgcagccccgaaaagactacaaataatattggttaaaatagaagtgggctgtattcttttgccattgcagcaagccttagtagtgacctagattcaaaatgttactttgattttatttaaagcactgaagtattgcatttttcctcgtggttttatgcacctactaagtgcagctaccaatgacaaagatcttctataataaaaatgatgtttccttatttttgggtcttttttcaatctgaaaaatgtttctttaatcggattctcataataaccctatgcagccatataatctatggtattattatctccactttgtatatcaggaaaatgagactcatgctaaaatacttgcccaaggtcatatgacttgaaatggtgggactagcctctggcttagctctagtgagacctaaaataatactcttttggtttggtgagttccatcctttctttttttaaagaatttgcatatctaccttatccacttttaaaatgtttaaagaatttatttcaggtgcctgtccagagtgacacatgtcaaaatgttttttaaacagataagtactattcaaatacaaggctttatctttcttactgcctggggtaagatacctgtcttccctgtcccaagttatatgatgcttatttaaaaagttacctgtgagccttgcttattaaagtatgcctcagctatgtcatgaggatatttttttttaattaattttttttgagacagggtctcattctgttgcccaaactggagtgcagtagtgtggtcacagctcactgcagccctgacctcctgggctcaagtgatcctcccacctcagcctcccaagtggctagtactacagtcgtgtgccaccacatccagataactttctatttttggtagagactggggtctcactcttttgtccaagttgatctcaaactcctggtcttaagcaatcctcctgcttcggcctcccaaagtgctgggattgtcagcataaggcactacgcctggctgaggacatttttaaaggtgtatacttcaccatattctcttttcctctacatgaagtttagcaatgttcaagatggtggccactccatcccccttgatgactgagtgactgtgatgagccgagcacctgctgactcacaacagccatagagacataagagtgtgaacaagaaataagcctttgttatttttagccatggagattttgcagttgatactacagcattatgtagcctatcctgaatgaggtaggatcataataatatgtttgttatgcatcacacaagtttttgggttgtttcaatctaaagatctgaaattatacccaaactagatattctccagtatcaccaaacaggatctatccattctacagtgctcaccagattgcttctgtcatacttcacctggacatctgtggattctggatattagaaattggaaggaaaagcttgtaaggggatctcagtgcccagggtcaaagcttcattgttgggcagccaaggaagagatttgcttgacttacttgagtaatttttgacacatacttgatttggtcatcaggcataaaggatggccagattactagtaacttattggagatacacttttaaaataggagttaaggctacttatgtgttgatctgaaattaagaaaagggcaagatttctccctgtggcctgattttcaaccatgactaaataaagcctgaggggagccactgaggatggaaaaggtcactcagtcttttttgctgatgaaaaaatcgagttgtctagctctggattgacatccagcactgacatgctttaggaaacaaatcttttgatggcaaaactctcactagcctcacctctcctctcctttcctctctcctctcctctcctctcctctcctctcctctcctctcctctcctctccctcatttttcccttttctactctcccacttctaccctcatttacttatttctcaatttagctcatcagggctttttgttacaaaaaaatggtgtgtaagttacttagctgtaacttggaaactgttttcccatgaatagatgacagaattactacatgccaaattatcccagaataggtggcttaaccaattgtataattaagttactttaataattaccaagagggtcctgagccccatggaaaccttcactgcttggaggatgtataaatggaaggtgggcagcatgagtcttttggactggtggccggaacaagcagttcttagctttttttaaaatcatctttcatatttcagagcaattctttgcataatccagattgcttctgtcatccttcacttgatcatctgtggattctgagcttcagggtggccatgcgacctttcagcccttgctgtggaaggtggagctcctaccatctctgcctgtgttggggctagacgaagtttccctctgactgcctcaatcttttcactgtcatgtgtcctgggagcctcctacacagtggagaggagggagtatgagtctcaggaaccattgagttttttcactgtgaggtgggacaggcctaaatttctccccttaggcctgccattcactgagggtgtgcagtcatcatgctaagttctctttcttgctccattttcatcttcactcaccccttactttctgcaaagcgttgatggtgttgggttctgacagttaccagttggggcatttgtgatctgtggagaaggcagagatagttaatgagtaggcacatttgctaacctccttggacaggaataagttcaaaggggtggacaagcaggattggctggaggaggcaggtctccacattgttctctcttgcccctgggccctggcgtccagggtaatttttgtctgcctttgtggttcatatttttagctctctgtaagaggcccccttggtaaatatgtcagttcattgttaaacctagacatgagtttgacatctattttgtgaaacaaaccatgtaaaaatatgggtctttatggtgttcagtgttccaaagtcaggaattttttagtttcttttgtcttcacttcttgttattctctcacttgctttacttcttccagccttttccttttccacctcatctcctgcttcttatttcctcatctctttttccttaccattttttcctcttccatttctcccttgatcttttcattatattcaattcatttcattcattgaatggtgttagaagaggctttgtctttgcagtcagaaggctcaggtgaagcttcatatttcaaagcacactatgctgacactaagaaaacatcttgcccgggcacttcagttgaagaaaactatatgatgtgatcagtatgtgatgatggcttttcagatcagatagctgggttgtatttataatttatttctcttatcagtgaaaaagataaatgataatgtagtaacaggattttctagagtttgggttgtagagaaataagtgctcatgaataggaccgcatatgtgtgcatgtatgtgtgttttgggggtatggagaaagaggaggaaaagaatattttatagagaaaatttccatatggttaccttttataggatctagcacatttcaatgaaaacacactttgctggaagaattcaattctctgtaaagtttggtgcagcaaggggtgaaaatgtggggacacagctggaaacttatttgtgctgcaggcttgcagctgtacctacctgtgatgcgatgaatactatttgattgttaatgtctttctgttactgaaagcttgcttcctttcctaaagctgatggtaacaatttactgactgtctaaaccttgaggactaacttgggctgggaaaaataaatcctgtctcctgaaatttacatcttattaaaactcaaagcagccagcagagatgagaaggatctccagcctgggagctggaggtgggaattctgctcaagtcaagatcgcttttagctttcctacattctcctgtgaagaaccattggattgaatgatggtggcaaaactggtgtgacttcattcagtttatctctatcccatttcccctctccacatttgactgtcagtctactaatgagacccagttatggtccttggaaggggaaatggaaggtggacatagctgtgggggatgaaatggaggagtttttaatatcttagcttgcaaatttactgtctgccatagctgaagaccatctagtaccctctttaacttttgccactttggagtttcctctctaccgttacttattcagcaggtttttgtttttgttttttgagacggagtctctctctgtcaccaggctggagtgcagtggcgcgaactcggctcactgcaacctccgcctcccgggttcaagcgattcccctgcctcagcctcccaagtagctgggactacaggcacgtatcaccacgcccggctaatgttttgtattttagtaatgatggattttcaccatgttggccaggatggtctcgatctcctgacctcgtgatccacccacctcggcctcccaaagtgctgggattacaggcgtgagccaccgcgcccggcctcatcagttattttttaattggctgtgttttctttccctgtaaacacacttgttcagaaggaaatataatatcactataatgagcagaaggcaagtatcacatgccataagaaagtaactataaaaatgagtgtaatacaattaaaatattatgaggctctagttagatactgttccctatggaagattccgaacttgaggcctgcactcacttctgtctcaagtagaaagggagcttaaagaggcatacactttacatctaaggaagcactaagtgaggcattgttcttaactaattagacagattaaaaaggaaaggccaaaccatgccattgtcttagctcttgttttctttgattttgaagatggaaaaagagataacacttaaaaataaagcttgcctactcagacataattaaggtattgtcattcttttttgtctgtcctggttctcattgcaatattttgttcactgctcaatgagtatttattaaattaatgaagatttcaatgttaatgtctagtttcatttgcccttcctctaaaggctgtattctttttttgctcttgctctctgtgattttttggtagttctcttttatgtgcttactcacacatgagtgctttctctaacacactggtcctgtgttttgcttctttgtgtgcattcacgtagacatgcacacctcttcaaatgacacatgcctgtaggcaggataacaggttgagttgtcttgttaattaggcattctttttctggggctggtacaggatgtttgagaatactgtcccccagaatactcatctggtacactggaactgccatggactagttttccagggcttatacatacaagtggcttccaaaaaagcattttcagacaagctgcttgttatgtgaatgtgtttttctttttagtcaaccacaatatatgcagcacaaagctgttgccattttcttggaatgagaaaattatgagcataatgtttcttttacatctctgaaaaacgctaatatccagctgttgtggtggttgcagttgtcagttgctttttgtaacccgacaacactgtctcaaggatgaagagaggaaatttggtgactagtctttcctgctcactctcctgaaagtcctattaatttgcttttttaaaaacaacagccaagtatctcagttggagaaggcaaagtcttattggtccttatattctgtgcttggattagtatccacagtaaaccacacacattttgttccttgcttaacgtgagccaggtgttatactttaaagacataatctcacttagtcctcacaaaaactcagtgaatacatactatcattagcaccatttttacagatgccaaaacaaaaaattgaggttaaataattgcacaaaatctggcagccattaaatgactgagctggaatttaaaagcagatgtgtctaaattctgagcttacatttgtaaccactgtatataatgtagtataataacttccccaataattgacagagtactttactcagaggctttacaaggacaataaaagaattagttgagataacacaacccatgttgtgagaagattgtctttttgattcacagttcatgcaaagaaataatatacagcagactgtgaataatacacaaacgaaatgaaatttcattcttgaatgaattatctgtatctccttttaagaaaaattggtaaagcatttaactggtcatggctcagggaaatgtctctattctgtttctgtctgaattttattctttaaatattcactttttttttttttttagcatccagtggccacctagttgttgttgttgttgttgttgttttttccccctgtgcttatgcttgtgccttgcagggctgcatttctgcttgctgtgaattctcagttcacagctgcagttgttcaaactttaaatttaaaattcagtctatgtttctagtaattgctgctgggaaactgaaacaggactacttggtttcagagtgaggctgttgcttcatattggaagaaaggtttcattagcttggaaagcaaatctcgggatatcaagaaaacaacaaaggctgtaaattaatgcagaactcaccctaaaaagggtcaatgatgaaagaagggagaaagaagagacaggagtttcagtggtcaagggaatattttcttcatgataacagtgacctgaattggacagaaagcagaagggagtgtgtcattttaagaaggtcagtttgacagaccgcaatattccaggtttctattattatatataattgacattgttagctaagggatggattttcactatttccttctgtagtacctcagtcccttttaagtaattttttttttcctgacttcaccaccaggatcgtgtgatggtttaggaggagatttgggggatagagaggtgattctgaagataaacccactttggctgcctctgtggtctaaagccagtttggagagcgcactacagaaacagggaattcacaggggatgagtcagagagagggactggagcagtttgtcttgtttcacttgctcttatcacacagttcactcctttctgctcatacattgtgtagtccaccatggagagaaagggagaaggttgcacaatgccttgacagatttttttttttttttttgaaacggagtcttactctgtttcctgggctggagtgcagtagctcgatctcagcttactgcaacctccacctccccagctcaagcagttctcctgtctcagcctccctagtagctgggattacaggcatgtgccaccacgcctggctaatttttgtatttttagtagagacagggtttcaccatgttggccaggctggtctcgaactcctgacctcaagtgatccacctgccttggccttccaaggtgctgggattacaggcgtgagccactgtgcctggcctccttgacagactttttaatgattgtagggatagagaatggtatacaagtaaatatactactactgtttttgaactggcacagtgatgaagactaagccagtaatgctatgaaacttcaagtattaaatttctaaatatttggcattaggcaccaatctaagttacagtttaatgcttttcatcacttgtaacattaccaaatcagaggaatgaaataatatttatccaaataaaagatgtgttaacttcgccaaagtgaatgcacatttttctttgatttccccataatacatctttctttttcggggaagacagaggttgggaatgggagggagggagattattgtgaatctcagattatattgatcagaaccaagtttagcttgttctggtatgtaaattagagatttgtagttaagtgaaattgattttgctgagactaaattaatcacagtccttaatcactgtaacctttaaacattgcagtcttggccacagctgcagggcagagcagtgctcctccgagctttatgctgtcatttcatgaaaggctgaatgcccgtgacttgtgcaaacaagaattcccatgtacaggcttcagagctggttccctgccctgcaggggatcagctggagcatctcccacagggccaagaggctgctgtggcctcttcaacccaagaagatgttctgctcagacacaaatattttcagtcttcctccagacatcatcaaactagccatcactgcgaaatgctcacaggaaagtagttgttagaattaaaatcagaaacaaccagttatattgtgatagttttttctttaattgtatatgtttatgtatatttataaatatatttatatttatagatttcttttatatatttatattatatttatatatatatgttttactgatcacattttgaactatttggaagggtgatgttgacaattttgaaagatagtgaggcatggagaggttaattgactcttcagaactaatcctgagagcctagaaggagggtcaagaatagaaactgggtttggtttggttttgatggtcatttcagttctttggtttccgtttcatgaagcatcccagaatcaaaccatcattaagcctgccatagaaatgcaaattactttcccactttagttggcatatttgaaaatagttttgtgtgattttttttagccccttttgtagtctattcatgaagtttatacatgtaggactcttttttttttaacgcctttaactaccaatcctccatttttcctttaacttttctatattcgctgacttttatgttcagttgaaggaattcatacacattcagtataataaagtgcagctggatcaatcatttaaaaaaatcagtgaacatctgtatttcacaaaatcacactttatcaggactgaagggtataccaggatctaacgatcaacttcaaccactcagttttgtaaatgaagaaaccaagagtagttaggtgaaatagctttctcaaggtaatttactatagccattctgaggctgcaccctagctaatttgattcctgtttaacactcttctctatgacattgactgttttctctgtaaaagagatcccggttatacaactatttcacaatccgattccttataaaaaagcaagtagtgctcaataaatttgacttaagttgtactttataagctaatgtaaaaggagatttaccataatctgccgtggtgagttgcttatagtaggagaaagaatatcttaaaacttactttacaaaaaataacagatgctggtgaggttgctgagaaaaaggaatgcttatacaatgttggtaggaatgtaaattaattcaaccattgtgaaagacagtatgtcaatttttcaaagacctaaaaacagaaataacagtcaactcagcagttccattactgggtatatacccaaaggaatataaattgttctatcataaagatacatgtctgtgtatgttcattgcagtactactcacagtatcaaaggcatggaatcaacctaaatgcccatcaatggtagactggataaataaaatgtcatacatatataccatggaatactctgcagccacaaaaaagaatgaggtcatgtcctttgcaggaacatggataggagctgtaggctattatccttagccaattaatgcaggaacagaaaaccaaatactgcatgttcccacttttaagtggaaactaaatgatgagaacacatggttacatagaggggaacaatacacactggggccttttggagggtggaaggtgggaggatgaagaggttctggaaaaataactaatgggtactaggcttaatacctgggtgatgaaataatctatacaacaaacccccatgacacaagtttacctatgtaagagacctccacatagacccctgaacttaaaagctaaattaaaaaacaaaaacaaaaaaccaaaatacttactttaaaaacaatttctgtggttgtccttctcttttttattgtatattggtttgtgtaggtccatttaatttgtttacttttcgtagtaggaatacaattgtcagtgacatctagtagattgaacataggctctgaagctgaagcctcaggtccatctttggccctgacactagccctgttacctttgtcattttacttaacagctctctgccctaaaccataacacctaccccatagagttgttgagacagttaaataagttaatgaaaagtcaggctcttagaatagtgctgggcatatatgaatgttcattggatattatctaatattgtggtcattatcagttgatttcttcttaatttaaaaaattttcgtatgtgatttcatgtggttttagggaatgataaatgtaatttagactttttattccattgggtctgttacagcttttttctcaatgaaactgatttggttacctcagttctaatgctggctttgcctctgctttttgatcacatttagaatacagcactcagttctgggtatgtccaagatagataggggagaaaggtaaaagagaatattaatgcaacttgattgtgcagctgttctttccacaaatatttattgaatgactgctgtttgtcacatgttgatgcatagggacacggtgcacacctgagattccattcctgtagacaggacatttgcctgcttcctggcacttatacctctccccaaattgacaccaagcattattttagaaaggcatttagtagaatgcaatatcagcaaatgaaaattgtagagttgtatcttgaagaaacttgaccccaccccccactctcacctgcatccccacatagagccaggacatctcttaagacccaccttcctgggtttgctcatagttggcacttaaaacattctattgcagttacctatttttgatggactctgcaagagagagactgtcagttcacaagggcactgatgtttggttcttcattttatttacagtatgctatacaaagggataggtttttgttgttttgaatatatcttgagtactcctttggaaggatagagtccaaaggcatcttacctgagccagaattcataggggtggttccctaccgtttcttctttcctgtacacactcaccaccctcaaatttccgctcagtagaggatgctttaggaccttttttcttctttctttctttcttccttttctttttttcctttttctttttgaggtagggcctcactctgttgcccatgtagtggcacaatcatagctcactgcagccttgatctcccaggctcaagtgattctcccaccttagcctcccaagtagctaggattactggctaattttttcagttttatttttggcagagacaaggtcttgccattctgcctaggctagtcttgaactcctgagctcaagtgattctcccaccttgatctcccaaagtgttgggattataggcatgagccaccatgcccagcctagaaacttttcttttcttttcttttctttttttttgagatagagttttgagcccaggctggagtgcaatggcgtgatctcagctcaccgcaacctccgcctcctggattcaagcgattctcctgcctcagcctcccgagtagctgggattacaggcatgcgccaccacacctggctaattttgtatttttagtagagacggggtttctgtatgttggtcaggctggtctcgaactcctgacctcaggtgatccgcccgccttggcctcccaaagtgctgggattacaggcgtgagccaccatgcctggtcagaaccttttcttgactccacttaagctcttccatttgaactttcttttaattatctggattttaactttatcagaattagtctgccggtaatcctgtttttagctagaaggttaggctttgagaagtgtgaagctggatgggagggaaggaggccagcaaagggaaagggactagctgggttgaagaggccccatctgctattccagatggggcatcctgaattcatcactcctaaaactttgctctatgtgttttctaggctgcagcatccagacagcagcacacccttcacatgttcactgtagtaaaataacgtggaaagggtagaggtatctggcagataagagaggttatttcgtaaggctgtgatgcccagcacataggtctgtacatcacctccttcctgctgctcctcaatctgcctttctttggtcactgccccctgctagtatttaattctgttgaatttgttcaaattgacttgtttaagaaggttacccaaatctgcatacagccttcagcattgctttgaatctcctttaggaaaggaaatgtagattcaaatacacaggtttatctctctgacctttagctaattattagattgagataaatgtgtgtaagtgacaaattgcctttaatgacatttaatctgcatcctgacattaatgtctggtttagtgtcccagttccatagaggcaaagagcatggacttttgtcttaatttgacctatttaaaaggtgtttgtggtgagagtcaacctgtgattaacttaatagcatgttttacatgaaaagcaatcaaatattgatgtaagaagaggctactagatgacatattttccagtctgtcataattggcaaaaacatcagagaaaggagagagttgttagtaactaaaactgaatgaaagcctcatagctgccccaaatccaatactggtgagcacattgatagtatctgaagaaaggaggctcttcttgttgtttattgtcacagaggccattcactgaactttggtgggtgttagactaatagatttttttttttttttgagacagagtcttgctctgttgcccaagctggagtgctgtggtgcgatcttgcctcactgcaacctgtccctcttgggttcaagccattctcctgccttagcccccaagtagctgggattaacaggtgcacaccaccatgccaggctaatttttgtatttttagtagagaaagggttttaccatgttggccaggctggtctcaaactcctggtttcaagcagtctgcccccattggccttccagagtgcagggattacagacatgagccactgcacctggcctaaactaatagattttcacacctttttgattcactaaaggacatcataggggcttattaaataagtgagctatttttagggagtgagaggtctgggaagtggcattcttggtggatttgttgtgtgctagtcaggtgctaggtgctttgctttttgcattctcatttaactcctaactacaaaaacatttgtacaggcaaccctctaactcgtgataccatctttttgaattaaattaatttttttttttaaataaggtcttgctttctcgcccaggccggagtgcagtggcatgatcacagctcactgtaacctcaaacttctggggtcaggcagtcttcttgctttagtctctagaatagctggaactacaggcacacgccaccatacctggctaaattttttgtagagacggggtcttgctgtgttgcctaggcttgtctcaaactcctggcctcaagtgatctttctgcctcagcctcccaaagtgttggaattacatgtgtgagccactgtgcccagcctctaattggtgacttctcaattaactttgacataagtgtgtgttttataagatcattatcaccgataataaatgcagcttaatttctaatcaattggccaaacagggaaatttgagttgagtgagatcattaacaactttctttagcgctttaagagctaagtgatagcttttccagttctttaaacattacaaactgccgttcctggtgaatgtcattttctcaaattcattttcagagactggaatgggtctgtgctactctatataattttgtgctgagcggatggtatattgatgggaggaagtaggagagtagtgatggaagggcacaggcattggagtctgtctcccaggtgactctgtaagtttttcaactttcctatgccttgatttcctcatctgtaaagtgaggataatgagttaatgaatgtaaagcacttagaagggtgcctgtagtaaggacttacaactgttttatttattgtttttggagtttggttggaggattcaaagcaacattcattaaactaaacactcactaaattcactaaaatggtttccaagtgaaataataaatatagcaaaggagtctctcctctgctatggagtagctgagttgagtgcatctgggtgtccattctgctgcaaatccaggccaagcaaatacagtttctgtgcaattaaatggttgttgactggcaaagaaaaaaaatgtaaaccatagtttttccttctaccctgtaatctgtggtgtctttatgcattaccttaagagcaacttcagtgacttgattagagggaggtttataaactgcttggaggcaaagcaccgaactcttgactggcacacagcaggtccacaaggaaagccacttcccagggtaagaaagcacacacaaattattcagggacaaatgtaatggttacaagggtgtcatagaaacagatcagaatacttttatactactgcctggcttcttgttcccccattccccattataattctggattcttaagtttattttaatgacaaacatttttgcctgtctttaagtaaaagaacagaaaagaagttacttaaaatgcagtcctaattatgtcctaatgcaattttgatgcagcaatatgctttcaaacaagcaggtactgggtggcagattgacacaagtatttagtgaattgagaacaacatgtgttacatgaaattataatcaaattacaaacaatggaatggattgttgcttttaaaatcctctgaatgttggttaacttcatagggcagtgctgtgactatttccattaattacggagtagttatactgggacttgaccaagctcttttaatagttccatctgatttatgtttttctcttctctatttttcttttctgtctctttatttctttttgtcactatttttgttgacctgtatgtgtgtttttttctctttctgtatcagttcaagttctccagagaaataaaaccaataggaggagtgtgtgtgtataaatctaaagagatttattttaaggaattggcttacttgattgtggggggctggcgagtctgaaatctgtagggcaagcagtaggttggaaatttggcaagagttattgcagtcttgaggcaaaatctcttctttgtgataccttatttttgctctgaaggccttcagttgaatggataagacccacccacattatagaggataacctcctttacttgaagttaactgattgtagaagttaaccacatctagaaaatacctttatggaaacatctaaattcatgtttgattaattaactggctgcctgctattgccttgccaagttgatgcataaaattaatcataacattgtctcattcctttttccctcactgtgtgtttctgtctctcatctcacatgcacacaaatgaggttatgggacagcattagtgttaatgaatttcaggtaacaggataatgatcattatagcatctaccagtaattggatacctattatgtgctgagtcttgtatttgatgctttgtatttctgatctcatgtaatcctcttgacaattccatggattggacagaattaattttattttatgggtgaggaaactgaggcttaaagagctgctagcttttatttagccatgtagagctcaaggttcaaactctaatctgcctttcctgcagatatactctcttctgtatctgcttgtttctctaatattcccccatcactgtcatcactggctatttttcagtgtttcacttggatgaaaaacatatctacatactttttttgtttccttttttttttttttttttaaagacaaggtctcgctctgtcaccaaggctggaacgcagtggctggatcttggctcactgcaacctctgcctcccaggttcaagtgattctcctgcctcagcctctcaagtagctgggattacaggcatgcactaccatgcctggctaagtttgttttgtatttttagtagggacagagtttcactttgttggacaggctggtcttgaactcctgatctctggtgatcagcccgccttggcctcccaaagtgctgggattacaggcgtgagctgccatgcctggcctgcatacttttttttactaagcttttttttttttttttttaataggatgctgaaggagctgaggcagtgctgaaggatgttaaaagcacacacagtggagagcttattgttgttccaaggcctaattggagatctaggttggcatttcctacagctttcaaagtgtacaactaaaagactatcctaagaagatgagatagtttctgaactaggcacgaaaagctgtaaggagtgtcacctcccagtgccctctggcctatttttctcactgatggattgctttgttatctgctgccagaccccttaatgtgctggctcagccttcacagggattagtcacagaagatgggcgctgcagctgcaggtctggctccagaggctttgggtggtacctactactacttacttagcccttagccagatattccctagaagggaaaacgctccttagtttcactgaggatctggcctcatgagcagacactagttctaataatactctttaccttctttgtagctcccagccattgtcttctaccttcccttgcctagctttagtcactgccagcagctatttctaggctgttggcactttgaagtggaattgggcagacagaggtgagagcaggctgtgagttccctctctggaggttggctccttacagcacacatgggaggcagtgctgaaggatgttaaaaagcacacacagaggaagagcttacttgttgttccaaggcctaattggagatctaggttggcatttcctatagcttggcatggaacgatttgaatgtttgtggatggtgcttgcctcataccttgccaactcaaattttgggcagatcagcttctgtgagttttgtctcgacaagttgggaaagtttcctaactttagatgactgtgtgaatctttgaggagcttgatagttagcaggtgagggctgctattttgaaggaaatagacattaatatattcttctttaatatatctgaatgggtatacatatgtgctcctttgtttcttgtaaatgggcagtacaggagggagaaactgaaggagaggacttggtcaggagataaacccccacagatgccaagatgttggcttgttgaagcttattcgtggttagttttactgtgatactatgtgcagatggttcctaagttataatggtttgacttatgattttttagttttatgatagttttggtgcaaaatcatttttttttttacgtttagtacagtatccaataaagtgtgacatattcagtactttattataaaataggctttatgttagattattttgcccatctgtaggctaatgtaagtgttctgagcccatttaaggtatgctcggctaaggtcaggtgtatcagatgcttttttgacttttgatattttcaactaacaatgggcttattgggatataaccccatgataagtctaggagcatctgtatttgtctgtgaattacttagggactcttttgatgtcttcgttttggaaactctctgttgttggtttttgttattttagccttgtcgggttttcctcatactggtctaactgctagtatcttttattggcccctctttcttggatatcctttacatgtttatatttgttagtgtttcttccttgacttgtctcacttctcgtgtttccttgggtttgcctccattactaagtcttcatccagcccctatgtcattggttctcaaagtgtggtccccagaccagcagcagcagcatcacctgggaacttgctggaaatgcctgaactaaacttaagacactatataaaacaggaaaaggcattttacattttgatacacattgtcaaaaacattgtactggtttcatggtatgcattataaggcataaagtagatcaagcctatgttcctaatgcatacatttctattgacctcagagagtgaactatcatataatagaaataggattatcattagtttaatgaatgagaaagactcttcatgtttgttctttacctaatctatgcagtttaaacctagatcgacctcagggaaatatgggaaattgtgttctcttctggcttgtttaagtacaaggaactcagacccactctaatttgctttaagtgtttttttttgtttgttttgaacagtaagaaactatttagggtggagaactttatttcagtaaggcctcatgtgaagtggaattaagacagtcataatgtccttttgtggcttgatcttgatgaggtgataggcttctgcacacattcatcaactgttcatattctttcccgctctgtccgccccccccaccctcatcttgcttgcacacacgtgcatacttttgcatgctctctgactctctctcttcttccctctccttcctgccaacacagctgtattcatcttcatttctttttcacctggcttcctccctctctgctctgtgtcttttcaggtccctcccaagtttagttcacgcattactcattctatgaacctcttaaacttcgtgcattctatcttttatccctattactatgtcaccctggcagtttcataatgcagatttctgagtaggagtcccagtgggacagaacctggccacttgatggcaggtccagtgtcctggtcgattcccttagaaagtgctgtgcagaggactgttactttttcttatagatcattctatgttttaagtattaaatgaagcctcagctccagcatagcgtttctgacaggctgactcacttcacatttaatgattgtatccagcatcttgtctctactctccagcaatgcagctccttcttctggtgtcgtcacttctatggacatatcctgtggatgttcccatccacctgagcccaaaacctctgtgcttgtttgttcctcctcctccttagccctcacatctcttcaatatttttctctctctttactattacttaatgctactgccatattgcttcttgactagattttaataatcttctgatttcaatctgttactttgtctcagtcagaataacctacttcccctttcacatgaaatacttatctaccctgaggaatatccctcaaggctctctattgcctgcgaattgagaatagactcctctgctgaagattcacggtcttcagcagtatgccccctacttggttcttttactccaaacactgtactctagctacataggactactgagtaatactcctcaaaggctccctctcttgggtacttgtaaagtgccctttagctgtgtagcagagaataggacaggagtgcacactctggggctagactgacgggctggaatctcagcccagcttgaaaactttgagcatttgttattttatctttctgtgcctcatttttctcaactgtaaaatggaaacagtgatagtatctgccttgtgggttgttttaagagttaaatatggagcactcagagcagtgccagacacacagcaaatcctcaggtctttccagggatacttttttttttttttttttttaatattctccattagacgtgatgtttctgtctctgcgatgtggtaattttttctgttttttatttttaagggtacctatcacagtctgcttcccccttttcagattatttgtggatttcagatgttcacctgtttttctttgagctccttgagtatggagatggtattttattgaaacttatattatgacatacggagctcaataaacatttgttgaattggattatatccaaaagatgcttctgctaaaatactgtagtaacttccatctgtcccatgaatgttcgtgttctgagacaataatgtaattcttaaaactaggttttaaaccttaaaagtgaaagaaagtgaatactttgcggttgtcatatagatgtactgctactcaagtatagtaagtatattggtgaaatatttagaaaaaaacaactagttgtgaatctgaatcagagatcagcaaactttttgctacagagggaaaaatattaaatatgttcaactttgctggtcatattatctgtgttggatctgtttaccacagcaatcgtaatatgaaaaatatgtaaatggttgagttccagtaaaactttatttacaaaaacaggtggactataatttaccaacctctggcctgtgtcattactgtgcaaaccacacatcattttagaagctgtttgttgcaaaagctccaggtgctgccacatccaaagatacacacctgcatgtcttctcattaggtataaggaaacctttccagaaaatctcagcagattactcacaagttcagtggcccaaagttgtatcacattctcacacttcaaaccagttactgatgatggaatgagactaccatgattggcccaaatacaccaggaatcacaggtgttgttgtggataaggcctccctatctgcatcacgtgaccatgttgatgagggcatttccttgtgaagtgaaaaccattgaattgtacaatgaatgtgatacagcatgggctgccacagtccagttgtcacctactcttctgttgttcttctgaacatcatcataatgtcacatttgacaggtgtgaggtttctttgttaaagctcagacttattttaaattaatattcttatcacatgaatagacccgtggtaatgatgtaatgaccttggaggggcaggccagttttccgctgtgaagcataaagtttcccatatgacatccttgggctactcattttggtattctcagatatgcaaaacagagaaaacaacaggcttcccacttcagaattcaccatatacccttctccttcttgaaagggagaaaccaattagacaaggactagccttctcttatacttaataaaggcaggtgagttgagcctcttagtatttgtcatacactatggattaaaccagtttatggcccatgtcattgtacccaaaactctggtgtataatagtaaaacgttcatagttttcaaattagacttagagcttcttggtctcactttagaatattttgacagccctttggctttcacagaaagacctagtccctcaggggtcttgaactgagctaattatcctagtcatatcctgtagaacgggatcccactatggcttgtctgagactgcattgttgtcttgggttgtatgggaccatgagacaaacggctgtactgtttttccacttggcttttctgtggtgtaaaactatcttttaggagccacaaaatgctattcttttacttgttgaaagattttaagaaagaaagaaagggagggagggaggactgtaagggaaaagagaccattaacatgacatgtttcctgtcgctctccaatctgagtctaaccccagatgactgtattcccattgttttattgtgagggcatttgtgagggccttccccttggttgtgtcttggtttacagtctatagaattggattagacaatgttaattcaattaatgactgtactgaaagtttgtcttagtgtgcagtgaaaacaggagagcagcctctaataatctatggatttaatgactgcaactttgaagagtgttaagctaaagtgaagttcagaatggcttgttaactgggtttattagctgttgaccttccctttcagcataatagtggcagtcagaccgaagagagcactaacgtcctgattagcatttatctaaagataggctgctgcctgttacacagtaaattagttcaatcagccataaagagcttgagaaacattttctgctttataaaaagaattagatgttagaacagttcatctggcatagctcagtgaagatggattgagcccctgaacgtgctcatttgaggaaggcgctttgaggatattgagtaattgaacagattttcctacaagattgatcaggggccctagatttcctgcacaattgagtgatgctctaatttttgccttctaataagagcagtacatctgctcctgtttctgtgtattcatcgagtgaaactgaaaatcaatttatttagcacctactatgcactctatgtcccttacgaaataaaagcaataggatctactgatcacagtctatttgattgaagagatgaaaactacactaaaacttgaaattcaccacttccactaccactgcttcttttcttctgaaaagaagaaactgtagaatgaaagctgctacttttggtatatttcttgagatcatcttatgaagtgaagcacattttcccacagaaacagtatagtagtcggggttaacgtttctgactaaagtcttggcaccaactaagttcttctcatagtgggtcataaaagcaaaaaggcaaaaattataaacctttctaaatcatttaaaaacttaaattatgatccaggtccttaaaaaaaggacataaatgtactgtacaattgaattttatgaggtgccccaatgtactataaagtatacatagagcatataaaattctaactccgctgtatcataaatttgacctcactgaaatgaataggctcactgtatggcaagcattaatgaaacgtttaattaacattcccttcacttgcatttttagaattttaaagggcttcctggggactatttcaatggctgaggtttttgcaaaacaaaagaacaaaaccttctcataaaaactgatctcttttgctcaataactcctccaatagagacatttaatttaattagactgatgaacctgaatttgaattttatacccaaacctatgatcatccttaaaaaaaataaaacaaaaaatatggtattgagacagttaagcacttgatgacttcatgaaggcttcctgtggaccctttaagccactgtgtatacacatatcatttatgtccttgcagttttcccaagctaaaagccacagggatatgagtactttgtgagggacagtggtgcagtgttagaatggatgagctgtagggctgtgggcttcagaccctttcatagctccctgtaaggtatcctcctcctctaaccttccctgtaattatgctatgttggtttactttattgcctggtcactccaggagaagtccccagggagtcatacttgaatgaacagatagaggcagagtaaaaaaaaaaaaagacattatgctaagtgaaagaaaagtcattcacaaatgactgcatatggtgtgactatatttgtattaaatatccagaataggcaaatctgtagagatggaaagttggaaagtagattagtagttgtctaggggtgaaacatgagagggatagggagtaactgctgataggtacagagtttctttctggggtggtaaaaatataaaattagattgtggtaatagttgcacaactatctgaatataataaaaaccattgagttgtgtattttaaatggttgagttgtatgtatgcaaattacatcttaataaagctattatttttttaaaaaggtattaagtttcctcaagttaaatgaaatgaccaaaaggggaaaggttttaagcagtgagcactccttgtaatgtatgtgtatagtgagtatgcatatgtttgtaaaagtataatgtgtgtgatccaactatgagccatatggtgctagtcatgatgtgtatacatgaattctagaaaaagaggaagaacctttaagtgagagaatgccatgcattgggaagcagtgtggggcaagatctgtgtggctctagggtggcaaatttagtttgagcttgtgaatccttgcagagattggcaaatatcagatactccttggcagagaaagcagtagagtcaaaattgagaagatttaaggaagcagagactaataaggagagaatgttgaaacctgttatttgtagttagaagtgtagatgtatacaaaatagaaaaaaacaaaaagaatcttctgcattatatcaggaggaacttattggtgttttaggaccattaagatggagaacacagctcactcatatgtgggagctacaaagttgagctcatagaagtagaatataactgtggttattcaaagttgggagacgtggaggggcggggaggatagggagaattggtaagggatacaaaattgcagctagataggaggaataagttctgttggtctgtagcatattagggtgaacaccgttaatcttttattgtatattttttaaaagctagaagagaggattttgaatattcccagcataaggaaatgataaatgttagaggtgatgggtatgctaattatcctgatttgatcattatacattatgtacatgtatcagaatatcatgccatagcccataaatatggttgctacatgtcaactaaaaagaaaatttttaaaagatggaagacaaaagtaaaagataaatgtagatattcttttaactgtttggtgcttacctggtgtcctctgaaaaatcagagtcgtgggagatgaataacatttccagagagcactagatgaggagttagaaaagctggtttatcattcctactctgtctcttcccatgttacattaaataagtaactctgtgatgctttcttcctcccttgagttgtccttcttaccctgagaggatggcacaaggatcaaatgagctgacatatacctattgcattgcacctactagaatgtaacaaatgtttgtcagactgagggaggaaggaaggaaggaaggaaggagtagagtgatatcacatgcaaggaattggatttactgacttattcctctggccaagtgtgtcaacattatgattgcaataagaacttttgcattaatactatttatacttatgggtattattgctgcatttggtaattctacggtaaatttggaggtgcttctagtatcactgtcttgttctaccaatagtcttgtatttattgacagtttggtggttgttacaaatgacaggattgcaaatagaaatcaagctccaaagatggatggattagcttccttgttatgaccgtgttaaggttaccactcagaacaaacattggtagttgagcacgtcttgagtgtgagtgtcatactcagaacaattctaattttttaaaaattacttttttagaggctgtctcactctatcatcaggctggagtgcagtggcataattacagctcagtacagcctggaatttttgggcccaagcgatcctctcaccttagctttccatgtagctgggactatagtcacgtgccattacgcctggctcaattctacttttgatgaagtttttgacatattgacattgggtttgacatgtcattccaatataatatgatactgtagcattcaacaattctcttcccagaggagactatagaaaacagaacatttgcatttcccattttgtactttatgccacccactaaagaattccaaagtcatgcagaatgcctttgatgatgtgagctgcatgtgaatttcttattgcttgacttttaaatcccctttgttatctaggtccattacttataagctgtgtcacattaggcaagtgacatgcctctctaagtttccacttcctaatctggaaaggggggaaataatgagattggccctgtggcatcaggattaggcaaagtacttggcataacaccagtctcacagaatgcagtttttcttgagctgttgggtcagtgatgcctgaaagaggaggagtggaggttctgaggcattgctgtttttatcacgtttgatttgttttctttttgtctagacttgccatattatagcttcatcaggattttaaagacgattgtgaattatattttcaaaagttgtatggactcttgtactttagtataagcagcacaaaattaggcttaagaaacttagattttaatgttagctatgagaccttaggtcactggtgcgtgttcctctcatgaaataagagaatggaaccagctggttctttattcttcccggttccaagatgatgtggtcatagagtcttcattgcataatttcttgttcctcctcatttcttcttaccacactcttgtctttaatctctgacacctttctacccatctccttcaatgctccttctattcatcctttcatacgtcctaaaaattgttatgtcaactatgaggcaagcagtatattaggagctagatatgtaatgttgaaaaatatagacatggttcctgcagtaacagaatttacagtttaatggaagaagtacagataacacaagtaatacttacaaaatgtggtaagtgctatgaaagagcaggacagactgctttgaatgggggaaggggggatccctggcagtttaaatgacttttctcaaagcaggctgccaaaaggtagcggcgccggccagaggtggtttgagaggcaaagcagcaccacagacaggggtccaaggcaagaaaacgctgagctgctctcaggtgctggaaagccagtgtggcttgaagcgtgctaagagtgagactggaaatgcatgccaagtttgaggccgagttcaggattttgtattccatgataagtgtaatgggaaatctatgagaacttttaagtaacaacaatatgggaatcatacttgacttggctagaacaattaaaagctgatctcttttagaaagtacagttttgttttacattaatcttaacacagaatagtgtattacacctaaagtgaatactcttttaggctgggtaggggctgtcccgtggtttaatattgtttctatcataggagaagccttggtttcctagtttcccaccttgtttctcctctctctgccccactgggattctagctgcttcttcactgcatttgctcacctcttcttctccacagtcctttggtccttgaaatgctgtaagagcagaaataacagctatccagagaccttcagatagcagatgtgccttgggcctgtgggtctgtggctctggagggctaggaattacagaagagttaaaagagaaggcctctgccagcaggaattccgaagacaccaaaactgatgtcactggctgtgcaggcactgagctaattcttttgccaatcagttaaatcacctaccaagagtgttcattgtaagtaacactttcttgccatttggtggggatgtagagggacaaaggatgcaaaaggcaacaggttctttccttgtaaaactgtaatctaattctgtaaacaagccatgtacctttggaaggtcattttgaactcagtcctggtaaatatttgacaggtgttttaaaaaaataattatatttatacaatctataatggaatattatgcagcttttcacaaggaggaactcctgccatctgccacaacgtgggtgagcctggaggacattatgctaagtaaaataagtcagacatgaaaaaaaaattgcatgatttcacatatgtagaatctaaaaaataggataaaaatacagagagagaataaaacagtggttactaggattgggtttggaggaaggaaatgtggagatttgagtcaatggatacaaagtagcagatatataggatgaagaagtctgaatatctgtacaacatgaggactatagtgaatcacaatgtactgtattcaggatttttgctgagtgagtaggttatagctgctcttgccacaggcaggaaaagtaagtaactgtgagatcatggatatgttcacttgttttcctatagtaaccttttactatatatatgtacctgataacaacatcatgttgtacaccttaaatatccacaataaaatgtattaataattttatttaaaaatattttaaaatgtggacaattaaaaattttttatataattttttggtagttataatgctctgttcttttacaaattgtgagctggatactcactactcttcttttagcccaaattgagaacatctggaggcatttttatgtgatgactaaaaatacggtaattgagttagactgtatgggtctgtaccctgctctgccacttcctggacatgtctcagttttctcatctgtgtaatgatgatagtagcgtccacttcttgttgttattataggattaaataatatattacatgtaaaatgttgagtataaaacctggcagatattaagcacctaataaatgttaggtattaaaaatatataaagtatgacttctgctttcgagaacttaacctataaatatcctttgataccccgccccccgccctttccaccttgatttcatttacacaagagccaagtgaaagagtagtgagagatgaaactaggaaagcaggaatgaggcagtgggtagagaaggatatgtcctgaccaatggcattgacagagtggttttgacaggtgagtgtggaaatggactgcggtgagggagagtggaggtagtgttgagaacccgtaggctctggcagcaatgtggagcttacttgcagcatagcctcccttcaacttggaaaccaagcatttcaaagtacctgggaactttcttcatcacatccttccagcatttacattgtttacaaatgaaggagggaatagagtatattttattttctgataactttctgggtttccaaagagagaactgtaaaactttgataaacacatccataagagttgctgcccacacggtttcaaaactggatctcttgagctgggcataactggtcataggcagagaaacgttgactggtgatttataccttataccctctcattaaacactcttacctaactacgcaaattaggcttttaaaaatagattatttttattgtttaaatgtagaagaatatatctcagagttataggaaatttgcatgggtacatgtttataataaaaatcctgccaccatttatcataaatggccttggtttaggagtttacacagtagagagctcaaaccactggctttgctatgaaatagacccaattcaagctccatctcttaaaaagccatgtgagtttgggaaagtggcatcactttcctgagccctgggtttctaattattattattattatttttgaaacggagtctcaccctgtcgcgctggagtgcgatctcagctcacggtaacctctgcctcccgggttcaaacaattctcctgtctcagcctcccaggtaactgggactacaggtgcccaccatcatgcccggctagtttttgtatttttagtagagacggagtttcactgtgttggtcaggctggtctcgagcttgtggcctcaggtgatccacctgccttggcctcccaaaatgctgggattacaggtgtgagtcaccacacctggccaggtttcttatttttcaagaggagttataagacccacaaaccttacaattattgtaaaaattggtaataatatatatgaaaagtccccagcacagtgactcctgcctggtaagcaacccacgaattttacctattgtcagcattgtttagatcacctttatttaacttagttataatggggcttaattacaaaggggatccatattctaaaagcaaatactgaaacaaatttttacaattcactaccggttcttcagattaaggtcttctgatcatggttcagtttgggtttttgttgttgttgttgttgttttttctccccaagatgcagtcttgctctgttgcccaggctcaagtgcagtggcgcgatcttggctcactgcaacctctgccccctgggttccagcagttctcctgcctcagcctccctagtagctgggattacaggcgcctgactaatttttgtatttttagtagagatggggttttgccatgttggccaggctggtctccaactcctgacctcaggtgatccctgccttggccttccaaattgctgggattacaggtgtgaatcattgcacccggcctgagctactgcgcttgggccatggttcttaatagtaaaattatttaacgagatttttcccagttcttactggtaaaaatgtcctgtggtttaaaaacgttcaaattaatttgttgtatatttcacatgacagtgatacgagggataattgattatttgaggtattgatttgacctaattcagcataataatttactgattttcattcagtgcatgctaagtactaaatccagtcttgctgggtacagagaaacatacattcattcaaacatcatctcttctctcaaggagctcacagtagaacctatttaaatttaggcagtggggagcatgaggctgcagagaaacaaacatccaactttatgaaaagacaaaattatggagacagaaaaaatgatcagtggttgctaggagttggggagagggaggaatggataggcagagtggagaggatttttagggcagtgactctgtattacagtgggtacatataattttacgtacgaccaaacccatagaatgtacagcaccaagagtaaaccctaatgtaaactatgaaagttgtgataatgatgtgtcagtctagactcatccattgtaactatgtaccagtcctgtggggaatgctgatagggagattgtccatgtgtagggacaggaagtacatgggaactctgtactttctgcccagtttttctatgaacctaaaactgctctgaaaaaagtattaattttaaaaagtggtcttactgctttggagcacaagtaaatcatactaagaagacgatgtttaaattaatatactacagatacagtttgctttactgaaatgcagtatatgatgttcaaaacatatatctttaagtaatagccattttacaaaggaattgcatgtttttacagggaggtttcactggcctattagggcatgttggcttggtggtacagctaagatctaattccttctgccaccaaggagctttgtgaccgtgggaccacccaggaacctctctggctgtattctctgcagaaagacttaggacaacaacatggcatgctgtgtggacatgatttgctttgttgggcaaactggtgggattggtggggtggatactctctaatggaggttaaaggtcctgaagccactgcaggttaccctggggcgccatttctgtgctctggattaattctttgctcagctgttaaatgtctgtgtctggaagtggagatacacaagatgggttggtccccatggctttttatacctcaacaattatttcatccagtagatatctatactaacttgattgtaaacattaagtttacatgggatttctttaacacatccattttctaagaaagtgatccatgtgtaagtatagagtgaccaatgagaaaatagggtaattcccacacacccttccaaactttacaaggagtgaaataatataaattagcttcctctagtgataaaactgcaagaattttcaggcaaaagaaaaacagtttagtagcaccatctacaggctactgaagaggaaaacttcctatgtggcttttaaatgcaaggagtttgtggaaaagggaatacaaaaacttcatactctcttaaaaaaatattatccataaaatatactaattttagtatttttgttcttctttaccatgcattcaattcattttacaatatgtctctagttatcctgaactagtggaatatagacttgattatgtgttttcattaggatccctgtttcatccccatgcttacaaatttctctccctctctgtactaatgataagaatgaactgtgaaattcacatgaattccagtagtttcattgatagtaattcacagtataagacttgaagcacaaagcctgccagcaagggatgtttcatcttagcttatctgtatactcaaaggatttattgcatcatttacttccattatgggaggaaaaataaaagcagacactcttgggtatgtatgtatatgtgtttgccttttttaaaacaatgaagttgatttattaccttctgggtttaaaatcttatctgagccttttctgcccctaagattctgtgattctataatcagaaatagcttggggaatggataattattttgtaaaggaatctagaaaacttgtctttgaatatgataacagtgaaggtaatattttcattcccagataccccagttttattatctttttttgctagttttattttgttttcttataaactattatcaattttggtaacctggaaaattttattggattctccaaataactggattataaagtatttatggaattatcagagttgtaattttctgttagaaatggcttattaaaattaacttaatggcctccttgtaagttgttggtggagttgctgtttcattcattcattcatttcattgtgtgtgttattggaaagtgggtaagagttactggaatgcctagataataagttttcagtaaagcattacacattgcaagaagccaatctgcacccccacccaccccccaaaaaaaaattgagcataaattataattattagaacaatcttacttgaacagcattatttcttggaggaaaagaggaatagaggagatacatattgaaatagtttgctaaactaaagaggaattcaaaggataaaaaaattgataatgagattttcaaggttcctgttgaaacagatgaggcagagcctatcaaaactggagccaggagtgataatggtttttaagtttgtgtagcttaattgctgatggtttaggttgatggaaaacttagtaatactgtttccaattttttcctcattattttaaatgtgtaaaaaaattgtgcattaaatactggaacctttctctgaaaaaaagtaaagcaagttctagtatgaatagaggtttaaagtaaggcactgcctcgtcgtcctatagctaatatttttccctgtttttcttgcaccagatggcactgtttagttctatttcacaatcttattctggaactttcttcgggagaatctgttttagcccagggtcaccagtgacacctctctattctgcatgaagtctttatgaatgcttgtaaaaggtcactgactcagacatgaagctgtttatttgaggtcttgtggttctttccagttgcacatttgctgtgaggtgagcctaataaaccagctgatagaaacctacatgcttcttatagagttcagccagtattttgcttggagacatattgcaacaatatgatttcagcattctcacggcccagtctaattatctgacacattttggaattattttatatgtaaaagtagagctataagcagaagggcacactcactaaaaaaaaaaaaaaaaccttgcagagcttaaaatgtttcatgacagtctgttgaactatagatttatcaaattaacttgcaaaaataaaatttaaagaacctttcctgactattcccaaggctgacttggaaggaaattatcaatgacctctgatgtcattatgcataaatggggcaggtccatagccaagctcgcctctttgctgcacataacaataaaacatccttttggaagatagaattagctttatttaataaaaatgccagggtcatattgtaagacttatctctgtgagctttgccctcccctcccctcctctcccttgaataatacagaaacgttggacataattatgacacagatttcataaggctgcttctccttttacaattatattttatgaagaacagacaatgttttctttgcaaattttgaagctccttcattttctgaatgcattggatttggtactaaatgctctctcccgtttgcatttccttctctccctccctccttgcctccttccctcccttccttccttccttccttccttccttccttccttccttccttccttccttccttccttttttttttttttttatttttggtcagtgtttcactcttgttgcccaggctggagtgcaatggcgcaatcttggcttaccacaacctccacctcctgagttcaagcaattctcctgcctcagcctcccgagtagctgggattacagacatgcgccaccacgtgcgtctaattttgtattttcagtagagacagggtttctctatgttggtcaggctgctctcggactcccgatctcaggtgatccgcccatctcagcctcccaaagtgctgggattacaggcgtgagccactgggcccggcctcccctttgcatttcactgctctatgtattctcttggtggtgatatgagttgaagggtgggagtaggggtggagagccctctctagactggagctatgagtgcataagtgaaatctcattatttccatctttaaaagaaggagtattggcgtgtggtgtttttagccagccctccctcctttcctctcatgcccatccacaggccattgactggaaggcacaacagctcccagcacagcccctcctcctgccgctggagaggtgttgggactggtgtgctggtttccaggtgcaggtcctccaggctgagccacagctctctgtagaagtaagcatgagacaggctgcttccataaatcaagccctgaattttattacagtgtttatgtaacctcagtttatgtgctataattctttgctgtgttgcctagagtaattcccaaagaggatgtttgttctttttccctggaaattttctagcataggccttttgttttgacattctccttccccccaccctctgccttttttgggatggcctggggatgggtatcactaacagtcaattgctttttactgagtaaataatataatccagcgtgtgttagattctgtttgtactagatgttattcctactcttaagtgggagaaaaaatctcaaattaatttttacattttcaagattatagggtggtagggttaatgtgtacttaattgatgagtaaatgaaatataagtgaaaacaaatgcctttgctatccatgggagacccgttccttttcatagcctccgccaccatcacagatctcatgttgatagagtcagattgaccgctgagagagaaaatacagactggaaattttgggtgatttagacttttaactgaagaaaatgtcagggtaagatgaccagattcaactgtattccatgtagacaactatgtcaagagagaaatgttttctggttggaaatgaagacaatttgacttaaccggagcatgtttttaaagaaacccatagcatgttttttttttttttaacttagctctttttttcgaaccttatgtttggccctacagagaaattaggtgatgagactggacctactgaaagtgttaccggacctattctgcttggacacgctagacttgtgaactgctgactggtatatttcagttagtacagttaatgttttatcatcactgccattagaaggtattacatagatgtgatctttttcattgtagtttaaagaagatagttaatcctggggcaaagtttatgaaggaagtgtgtgaacagagcaatctttttagatttactttaactacaaaactggatatttgttttaaagctgtgctgtttaggattgtagacactagccacatgcaactgttgcgcatttgaaatatgaccagttctaattgaggtgtgctgtaagtctagaatacacacttgattttggagcttgagtatgaaagcaagaatttataggtcctctttaatcatttaaattaattacacattgtaataattatattttagatacattgggttacataaactgtatcatcaaaattaattttatacctatttttaccttgcttttactttttaaaatgtgactcctagaaaaaccttaaaattgcaaatgtgactcacatttgcaactcacattattttattatattatattttattttattttatttattttcaagatggagtcttgctctgtcacccaggctagagtgcagtggtgcaatctcggctcactgcaacctctgcctcccaggttcaaacagttctcctgccccagcctcccgagtagctgggattacaggcgcatgccaccatgctcagctaattttctaccttttttttttttttttttttttaagtagagatagggtttcaccatgtttgccaggctggtatcaaactcctgacctcatgatccgcctgcctcggcctcccaaagagctggattacaggcatgagccactgcgcctggccttgcaactcacattattattggccagtgctgttttaaagttctgttgtccaatgaagggaataacagatgagtacactcagtaaaaccttcaaagttatacgtttaaaggaatattctatgcttcctgataaaatattaataaccaaaattagcaacaatatatagatgaaattattgcctcaagatttatgaggaaatattgactggaatactgtctattaaaatattcctctttacttgtcaagtctacctctcagtatcttaaaggaaagttctcatctaatagggtgtagaggttaagagcatgaactctaggttggaatcccagcttggttgtttactgtctgtataataggaagtaagttatttagcttccctgtgcatcagcttccctacatgtaaaatggatacaccttaatatcttcttcatattaaataaaacaaagtgtataaagcacatgctaggattcgcacatactacataagtactatgtaagtgctagctattatagtgatagatgttattgttcttatcttgttaaaatacgtacaactttttgatagattattcgaacctggactctattctcaagcaaatggaagctgttggctttcagtaattagtctgaattttgttgaaactcagaaacaactggcagtaattaaaaatgggaaagtaaatgagcaaagaagggagctcatttattggaacatatgatgagaacattccataaagtaaaacttgtagtaattgtcgattaaaccaattttctacctgatataaattcagtagtactatatttctttttatcatgtttctttgtcaccaggtatattggtctgcaattttgagtctttggaagttatttttgtgtttattatgctctgataaagagatgatgacctcttaatcttgtgtccaagagtggtggtgctatattgtcctagaattgtttgaattttagagcaatgtgtatgtgtgcatttaaacccaagtttaataagtcattccattgtgttcttaatagggctagataacctgagaaccagttggttttttattgtgccgaataaaatttgtaatctggtttagactctgtacagcactgtaggtataacaagtcttttatgcagttcgggggtgatctgtgatataagtttgttatggtggaattgatgtttgtgatgggatgtctagatgaaattaccccatggaatataatcttttttgagtagaggatggtatttaagaaatatgtcttcaaaactcttatacaggccagtactgcctctttagatgtaaaagtttataattttaattgcaggaccttcttttacttggcttttaaaagttattcacttagtcaaaatttattgaacacctatagtattccaggcagaatgctaaccctcacggagctcacaggggatacacactaagggatatatattgtagtacagcacagtgctgtattaaatagcaattgcagagacactttccctattttttatgtttttactgccactttgcctttataacatgaggtgattttagcatagagctgaaccaaatgttgggatattaaaaagctgaagcaaagttcataaagagcatgacttgggcttggactttgcattttacaaggtgtgcagtgtgagcttacagaggctttgacagcagggagtgagtggagcgttgggctttgttatttggagagatcactcttagtattggtattgggacatagatggtataataacaaggagagactgtaagaaactttgcagtatctaatcaagatatggggagaaacttacactaaagagtgtgtgctaggtgaagaagaggtaggattttaaggaaattctccaagttttaagtgcagaagtgtgggaggaaaaaatgtaagatgatgatggttctggcttgattttccagagtagagtagagtagccttcaagatttgatacaacgcttgacataggacatcttaaaggggagctcttagacttcaaggagaatatggtaaatattaagtacactattgggagcatgggtctgctgtatgggagagtgtcttggctagaggcttacttgaggtagtcatgatctaaaggtgatagctgaaggcatgggaggtagatggtataaaataataagcctctccactgtgcttctgggggatttccaaacaccttagcatgccttacaaggccctttagggtttttttctgtactttgttagtctcctttacaaaagttaatgctgttctctctcatgcaacatgcattcctcgtgtctccagctgtttgctgttctcctcacttcccgggctcttctgtatctccattacatcacacatgctgtttcctgtgtttgcaaggcatggctcctctttgtccccttaacaagctctggatttttctttaacacccagttcctgaacctccatggcccagctaatagctccatccttgaacccataagattttgtacatatttctattagtacttatatctcacttagagtaattatcacttgcctttcactcattctgtatagactgtgaactcctaaaggaaagagaagtaactttagtcatttttacatccccaacctcaaaatggcacttggcaaatagatgctcagagaatgtgttttgattgaattaattcatttgtgtgtgagctgcaggtgtcacattagtggcttttggatgtgtccagaagtatacctattatacgttgaaattttgcaaatcatcatatttgcaaaggttaaatgtaaacaggagaaaggtgagacctgaggtccttgtcaaaactgtttttcttactgtaatatcaatgtgtattgtttgtggaaaagttgattgataaataaaagaagaaaatttaaaatatccatagtctgaccacccagtgatatcttggcttaaattgtacgtacccaaaatagcaaaaataggatctatctgtgtatattgtccttgacttttttaaaaaacttactatctgtgcatcattaaatattagtaagtagtcatgttttgtggggttttcttttagtttgagatgaggctggtcttgaactcctgggttcaagcagtgttcctgtctcagcctccaggtagctgggactataggtacacaccaccaccatcctcagtagtcatttttgagtgggctagttaaatagacgacactcccatcatgcattatttaaccagttccttgctgttggacttataggctgacttataggctgtttcaaatttttaatttatatagtcacatttcaatgaacaatccagtagtgttgtcatattcatttttatttagaatacttcggtgaaaggaagtatatatcttactttttccaactctattagcaaatcatctcttggacatttttttttttggagacagaatctcactcttgcccaggctggagtgcagtggcatgatctcggctcactgcaacctccacttcccaggttcaagtgattctcctgcctcagcttcctaagtagctgagattacaggtacctgccaccacgcctggctaatttttgtgtttttagtagggacagagtttcactatgttggtcaggctggtctcaaactcctgacctgaagtgatcctcttgccttggcctcccaaagtgctgggattacaggcgcccagccagtctcttggaaaagtcttaacaatttttattatcaccaactgaattcttctcatcatatttttaggttttaaattgtctggaacttaaaaatatatgaagataggccagccacagtggttcatatctgtaatcccagcactttgagaggctgaggcaggaggatcacttgaagccaggaggttgagactagcctgggcagcatagcaagaccctgtgtctacaaaacccaacaaacgtgtgtgtttgtgtgtgtgtatgtgtgtaaaacatatatatgaagatatgatatatgaagatacattacgaagataattcaaatatatatatgaagatacataggaagataatttagcttgctgcaacagaaattccaaatttagggctaaagaaattatcaaactgaagcctttttgtaaatttaagtagttttgttgattttagaagtagacttttctggccaggcgcggtggctcatgcctctaatctcagcactttggaaggctgaggcaggcagatcacctaaggtcaggagttcaagaccatcctggccaacatggtgaaaccatgtctctactaaaaatacaaaaattagccaggagtggtggtgcgcacctgtagtcccagctactcaggaggctgaggcaggagaatcgcttgaatccatgaggtggaggttgcagtgagccgagatcgagccactgcaatccagcctggcgacagagcaagactctgtctcaaaaaaaaaaaaaaaaaaaaaaaattagacttttccaaataatggtcaaggtttttaagtatgagaaaggagtttcatggtcttggggatcagggtcctcttggcatggagtgggtggtgacgtgaaggtgagccctccagttccagctctgttattagccttcttgtgcctcttgtgtggctgtttcccagctccaacccaaagttttattaggataaagtcttggatttaggcatatggatattaaatatcagtagctgaatttggggtttgaaataattgctgcttacttctaacttccccatcccactccagattctttttgccatccctatctacattaaatagctaattgaagccaggcgcggtggctcatgcctgtaattccagcactttaggaggccaagacgaatggatcacctgaggccaggagtttgagaccagcctggccaatatggcgaaaccccacctctactaaaaatacaaaaattggctgggtgtggtggtgtgctcctgtagtcccagctacttgggaggctgagacaggagaatcacttgaacctgggaggcagaggtcgcagtgagctgagatcatgctactgcactccagcctgggcgacagagcgagactctgtctccatcaatcaatcaatcaattattattcataaaatgagaagaagctcctccgccttcccctgccaaggggatgagcaaatgtgtgttacagctcactttgaagagctgtccaggcttttgagtgaaatgcagaatttttacctcttgcttagtaatttgctcatttttcagactactttgcacagatttaatgattaaggaaacaggataggcaaaggtgccagcgtttgatattatcttaaggcctaaactgaccttacggtgatgaaatgaactttttgagtgcgtttgtctcctgaataaatctgtaacagttttcttaactgactccctctgtctctcagcatcagaaagaaatgagagaacattaagccacagaaagcaaataatggtcaaaataaagatactcttttgctggcaaacttaaaaattcacttgtggggctgagcgtgttggctcacacctgtaatccctgcagtttgggaggccgaggcaggtggatcacctgagttcaggagttccagaccaacctggccaacatgatgaaaccccttctctactaaaaataccaaaaaattacccaggcgtggtggtgggcacctgtaatcccagctactcaggaggctgaggcaggagaatcacttgaacccggaaggtgaaggttgcagtgagctgagatcacaccactgcacttcatcctgggcaacaagaacaaaactccatctaaaaaaaacagattcacttgtggaatctaatagctgtaggcaagggatatttattgaaaccaagatttaagtgtggtttatgatgtttatggagtagtttaatactacttttcttcaaaatgagtttttaatttaggaaaaagaattcagatatgttcccagagtagagatgactgaccatcatgggagtggttagggtttggggtttgtgtgggtaagattctgtttacccactacagccattgtgtggatttaaaagctttcctggatggaatttatggagtgaaatttgaaactagtgtcctgtgtactacaatatatggtcacaacaagcaatcaatttagaaagaaatggaacggagaagatacaggttaaatgatgagtattgtgcagtgcagcaagacatagagtgatcttaacagtaatgtggtatgtcaccatctgagttctgttataaagctcctaggcaatgactaaatcctagaaatcattgcctactttcagtggcagacagagtataatccattcatgatagggggttccaggtacattgatatagaagactggccaagggggaatgacaggggttacagctaacatttcctaggtaattggttctaatttccaggctccaagcaagatactgtatctcttttaccctgtttaatcctccccagcacccagtgaggtacagatggtattgtatccattttagaattgagatgactgaagcttagagagattttcccagtcatatatattcacggttcctggatacagctgtacaggttgttcactgcatgaaggtggctggctgaggtagcaggcaaaggatttgtttgctcagcagaggcagcattttctaatttgcactaaaacctgtgtaggccaactgtagccctactcataaagttggttaatgcctgaactgggagtagaggtgaggcagtgttgaagtggataggtagattctgagaagcttatactatacctactgaagtcctaatctgtaggctgtctgcaaactggtttgttttgctaccatcctatcccagcatttcctcaaagatcccacagtgacttctttattgtggatctgatggtctttggcagctatacagacattcttagagtcacagccaggattaaagtctaggatgcttgtcttcaagtcatgcatgctttctgtatgagataatatacaaaaagatggtcaagaaaagtgattttgagataaatagtggcctagaatagctagactgagattgttcaagcacagctattaatttgcttacttgctcagcactcaggctgtgctatttgcttcaagggatataaagattgctgctttctagaaaattataactcaattagggaaaccaaatcaatatatatttcataatataaaataagagaaattacagataacaataaataatagccaaaatacctttcttaactaggcatgtctatgtttctttaccttgctttagtgctcttagatgtcccattccagcctttgagttggagtggggaaggtgttccttattaaagaagcatctactacaaaaaatctaaaaccagatctgaggcccatactagacccttctattagtggtaattttaaaaaagaattttccatctaaatttaatagctttcttctgtagctaccctaccctatccctgggccaggcaccaaagtgaataataatgtgctataaaatccaaaccaaaatagtacatcttctttggcatttgaaatttcagtgttttttgcgtgtagctacaaatgtcttccattgtggcaaccactgttttgggtggttttttttttttggagacaggatctcactctgtttcccaggctggagtgaagtgatgagatcatggctcactgaagccttgccctccagggctaaagtaatccttccacctcatcctcttgaacaacttggactacaggcatgcaccaccacagtcagctagtttattatttttatttttgtaaagacagggtctctactatgttgcccaggctggtctcgaactgggctcaagaggtcctcctgtcttggcctcccaaagtgctgtgggattactggtgtgagtgaaccaccacagtcagttttggggttcttttgaataatcagaagctgaaatcagaagccaaaaatagcaaaatgggaattctgtgtgcttttgtgatatgattatatttgtgttcccagcctccaaagaaagcaaatgtaatttatatggtactcaataaactatggcagtcaagaaaaccaaaagaaaaacctttttccacttggcactgtccaatagagctttctgtgctgatgaaaatgtcttctatgtgcactattcaattcggtagctactagccacatatgcatttgatatgtggctagtgtgatcctaaggaactgaattttgagttttactttcataaatttaaatttgcatagccatgtgtagccagtggctaccatactgggtagcacaggcatgccacatgctgtttctctcttaagttggcacctttaatttctgttttaaaattcatgtctcctttacttgtccccttctatcttctctttctcactcactcccttcctttttctctttgctttttatttctccttgcttctttgctttcctgttttttctcaaccttctgtgatactactaggctgaccgtaaccccattaattataattatttattatggtctttcacctagttagacttgcctgcctgtgttctccttctgtccccaaagatgggggcattcgcggatatgcagtgtttaccaaaagctcctgatatactggttacttaataaaaacaaacaaaaaaataaatgggatttttctgacaagatggttttggtgaacctatgctgattcctgagatcacggcttctttttctaaatacacaaaaaaactgctttggtaaatcattctagaattttgcacagaatgaatcaaaatcagtggtattacataatcctaggctccatagttctgatttccagaactattgactaatagtaatcaaaacactggaatacttcactggaagacttctctgtccttacttttcagtagggggtttaatctaactcctctccagtctttcttctagaggaactctgtaattccaatctcactattttggtcttcccttctcctcctccttatctcttccccctttctgcttttccttctcctccttctcctgatataacttacttcctttctgagaatgccacttgtctctttctaactttaggtacttttgcctacttctttccttctactttaattcacatagaagtaccgtgagactatgtaaacacatctactttaagttaaacatttcctctattcagagtcatgcctttttatatttaaaaaaaaattctaggctgggcacggtggctcacttctgtaatgccagcactttgggaggccgaggcgggtggatcacctgaggttgggagtgcaacaccagcctgacaaacatggagaaacctcatctctactaaaaatacaaaattagctggacgtggtggcacatgcctgtaatcccagctacgtgggaggctgaggcaggagaagcgcttgaacccaggaggcggaggttgtggtgagccaagattgtgtcattgcattccagcctggacaacaagagcaaaactccatctcaaaaaaaaaaattctatatttgatttcaagcctcaaataacttaagtaataatgactacccatctgtaagagtccttgctttgtgatactgttacactctgttgtattgagaatgctctaagtcatatgttaccaacatgctgtggacctttagcttttcccagtttccagacagaagcagtggtcagtcacttaactgcactagacagaaaagcagtttttcccttctgaaggttaaacaggtttttacaccactggagatttttaaggtgggtatgggtattaaggtgggtattgttagtcttttccctctaagtttccccaatgtccaaagaattaacaaaattttaagggttctgatttatatggtaacacagtctgttagtcagatgtaccaagtttcttcctatctaattttttttatttttattttttttgaaatggagtcttgctcttggtcaggcaggtctcgaactcctgacctcgtgatccacccacctcagcctgccaaactgctgagattataggcgtgagccaccatgcccggccttttttattgttatttttttcagagacagtgtcttgctctgtcgcccaggctggagtgcagtggcgtcatcttggctcactgcaacctccacctcccgggttctagcgattctcctgcctcagcctcccgagtagctgggattacaggcgtgcaccaccgtgcccggctaatttttgtatttttagtagagacggggtttcatgttagccaggctggtctcgaactccggacctcaggcaatccatcctcctcatcttcccaaagtgctcaggatacaggcgcccagctcttgccatcttagagtctttgcaatttttacttttatagcctaaagtggcgctttgcatgcctagatgtatcttcagcctttatactttaatcattctgaggggggttttctgtgtccctccttcatcaccttcaccctgtttactccctccatatcattcattcctcaatacttatttccatgtttccctgtctccaccactgggatgtaaggatttcttatcacttgttctgtgcagttaatctcagtgctcgggctcacagctgggagctgataagtgctcaatgaattcaagtgtttagaagaatgttagtgcagagtagagattgggcaggcagtgttagtaggttagtaattattactagaaccaggtagagtttctacaacctgcattgaggccctgagcatgaagaatggagtgttaaaatgagcctttcaaaggcaggattggcaactgtgtgaggtgacaccactagagacatggtttggacagcgcttccgaagatggaataccagataaagatcagtgtggatggtggagtccttaactgattcagtttaagatatttgattttgatgcatttgggaatagggtgctcttgctgagaataggggttagggctcaatttacaaacctttctgttcctacattctaggttcctatgattataatgattcttgctgataatattttctcccagcattatttcttatatataatacgtgactataaaggctcgttcctgtttcaaatgcctttgcacatgcatgatttggatttttttccagccaggtctcaggggccatgtttttaaagtctgctgctctttgggctgatattgtggcttcttgaatcgcatacaaagcaggtttcttgaaatctgctcatctaccatagtttaccagttatctgtatccttgcggctctgcttgaactgaagcttaatcttgttctttgtagggcccagctatttttgcttgtcattctatcacatgccgtttaccaggaaacattcaaataatgattaatgatgccaaaactttaaacatggaggaagctggtaataccagctccgctgtggagattttcaggagcatcaatgccggctgaccggactggtatttgagtctcggataatggagtagtaggtctcaaaaagttacacttttctgggtaattgtcagcttcccagagtactgttaaattctgtccctcaaaaatgatgaaattgcaaaggaatggtcactgttacaggtattctatcttcattatctgatttaatcctcaaaaaaataattgatgtggaataagttttttcattcccattttaatgctagaaaattgaagcacaaaatctacccaccaaattgtggactgtgttttctgtatctcttatcaaagctctccagggtccctagaccctctgttgtccctctgttctagcctttcagattggcttctttcacttagttattatacataaaatgccatgttataaaatgcctcagtcaggataatggggaaagtgttcttgggagacagtgcacataaagaccttacagtgctgggtgctcaaaatgttaccatcacttttattgttagcctcttccctcttaagtttccccagtgtttaggaaattagcaaaactttaagggttctcatggtaagacagtgatacgactattatgtatatggtaagggggtgatatatctatcatggtaagtaacaggacattgaaaagacagtcatgggaataaagctaagtaaacacatgtttcattggaatagcttctattagtgacaatacctcctatattttggactaattcccagatgaaagattttgctgaaactaggcattaatgaaactaagccattcagtacagtgtgattttctttttttatcttgtgatttgagaagtatattctaaaaacccagtaattcagccaggctggacattcagttaaatatcagtggagccagctgtgtaaggacttattggctttgtcctatacatgtggtatgtctggagttttggaaacaattcatggcctccttttatcggttgagtagcattgaggcctcataaaaaatagtaacttgattctaaggtaaatttccctggaaagtatgaaatgggaaagttaggtttccatgtacccccccgctacgcatagcattatttcaattccaagaggcatttgtagtcaatttctatgatgattggaaaggagcttaaaaaattcttacaatctctttaaaaacttttgaagcagaggagaaaaaattggtaatttgtttttcaggaagaaacatacctggatttatctattgctacatgtaggttttttttttttttaactaactagaatcacagcatctttttctttttaaactaacttgaatcacaaaatcttatgtcatacttcatgtctttccttattaaggataattagtttatggaggattcagttatgatggtgatattattagagacttatctgaatgaaatcagaaaagtgtatcccgttttatgtagaagatttttacataaaatatttacacacacacatacacttcattttttagagcagttttaggtttaacagcaaaactgagcaaaaagtgcagaatcctccctacccccaccatacccctcaccctagcatccctgactataagcttcaagactgcaccagtatggtacagttgctacagttgattaactggtattggcaaaacataatcacccatcttacatagtttacattagagttaacttttggatttgtacattctgtgagctttcacaaatataaaacggcatgtactcaccattatggtatcacacaaaatagtttcattgccctaaaaatcctttgtgctctacctattcatccccctaccaaaaccctgatctttttactttttccatagtttcgccttcgcaagaatgtcatacagttggaatcatactatatatatgtagcctttcagattggcttctttcacttagttattatacatttaaggtcctccgtgtcttttaatggcttaatagctcatttcttcttagcactgagtagtacattgcctggatgttccacagtttatttttccattcacctaatcttggttgcttccaagttttgtcaattatgggaaaaagctactgtaaacatttatgcgcagatttctgtgtggagatcttaacattcacattggttactttttttaaatttcagatttatcaatattacagagctattgcaagagtcatatgagaatcgaggatctggaaattctgtatgaaagaggtgccatctgagtagggccttaaaggatgcgctgatttggacacatagattggaggaggtacatcgtactgtggctggcacagtatgtgattttctgtttgattggagttcatggtaaatgtaggaacacggtgttatgttttcgatgccttcgatgctaggctaaagaagataggcttccttagtgaggccataggaacccatggcagatttttgaggtaggaagtgataagtaatgtcactcatttatttaagcagctagtcaagctcgcttagttccaaatagctgcttgaccttgcctagttccaaataattgacttaaaattaacaagttgacatttattaaacagtactttttacagtttaattgttcaccactttagactaaattttttctacaggtggtgcaagttaattagattttcttataatgagaaagaaaagcatttcagtacagtgtcttctgttctgatattcaaggtcatttcctatataaaagtaaaattctacacagcataaaaccatcctttttgacatttagggaccataggttttaataacattgaacaaagggttaaattttttaaaaagtttttgtacactctttctttggtatgcttcatctctttcatttgagctgaacagctttaaatttcacttaaagaaatgctagataaagagaagaacattgtataagggcaactaagtgaacaggaagctgtgcttctcagaatggggagattttaaaatagaggagaaagctgtcaaagcaaaagtatagcagcctcagctttacttgggaatttattagaaatgcagattgttagactctaccccagaagtcctgtgggcggggctggcaatctgtgttgtaagcgagaaagactaatctaaaccactgatcaagggagggggatgttaagacttactgcagaaaagaggtgagaaattgtactaacagttactgttaattcaacacttactttgtaatgcacattttacagatacagcttatgtaatcttttatgtcaaccctaggaagtataatattacaatatcttactatatagatgagcagaaaagaatggtttaagaagtagcattgcaaaacttccggcatggaaggtgtctttgactctatactctgacctctttaaatcgtgctaggccatgcaggtatgttgtttgtctcccagaaggcagcggtggggctaaggcagcacccacctctctgctccctctgctgcattccccagcctccctgactgaggtaggtatttcttccttcctgcatccaggtggagcctgcctggtccagtgaaggaagcagaacaggaatggcaggaaaccagctttttctgtttctctggagttctcttaacaaaccctgtgaccctaggcctgtctcttggtatctctatgccttatttattttcagcggtaaaatgaggactgggataaatctgtaggttctttctgaattttatctggctctagcacttaattagagacagatggtcaaactaggtgacctctcaagggttcattctggttcgtgttgagaggagtttgatattggaaataatagattcttgtttatgtgcgaaatggagacagtactttctggaaatggtgtgatgcaaagtgaaatcatgtctgtgaagtccctagtagcctgcctggcatacatggaaggtgctcagtaaatggtagttcctcagtccccaagaggaaaacagccgcattcctgattctggtgttttctttccttaagttttaacaggttagtattttaattttcctctcaaggagggaataagaggtgctaggtttgtattaaaatattaagttaattaaagcttcctattaaaattttaagagagaggaagagaatggggcaacatgaccacaataaataaagcaaataggtcattatgtttccaaatggcattatcccttgactgttggtagctttcctaataataataggttgaaaaaatgttactgtaacataaataataaaagatacttatggtagtactctgctaagtactatatagacatgagatacttaataacttttaatatcatggtttggcaaaagaaacttcacaatggattaactatttatttggtgaacttaacttggggcaggcttgtgggtggaatttaagggttatttcttcttttttttttttttgctcccccggagacggagtttcactcttgttgcccaggctggactgcaatggcgtgatctcaggtcactggaacctctgcctcccgggttcaagcaattctcccacctcagcctcccgagtagctgagattacaggctcccgccaccatgcccagctaatttttcttattttagtagagatgggattttgccatgttagccaggctggtctcaaactcctgacctcaggtgatccacccacctcggcctcccaaagcgctgggattacaggcgtgagccactgtgcccagccgagttgtttcttccctaatttctctcacaaaccttccttttatatagagaaaacatttttacttttcatttgaaatattcttattgttgtttttttctgatcattactgatgtaccttctatagaaataagacacatatttggcagggcacagtggctcatgcctgtaatcccagcactttgggaggccaaggagggcggatcacgaggtcaagagatcaagaacatcctggccaaccaacgtgatgaaaccctgtctctactaaaaatacaaaaattatctggacatcgtggcacacgcctgtagtcccagctactcaggaggctgaggcaggagaatcgcttgaacccaggaggcagaggttgcagtgagccaagatcacgccactgcactccagcccaggtgacagagcgagactccgtctcaaaaaaaaaaaaaaaggaagaaataagacacatatttatcccaacgtacattgtttttcacaagttgcaatttgatatccttagctagtttcatcattctaccgtgacatttatccccattatgacatttctaaattatagtgcttctctctcatgttacgcatgtttctaagctcttggttggaatctgtaaaatagctagttgttaacatttaataaaatttagacttacctcaccttactctgttagcaaagagttacatgaactctgttgttttgaattaagaggtcagttgtggcagtaaacctgggtagaatttggaaaggaactaggctacttcctttttgattcttccttattaggtcatttgtcaagtggatacattatcttctttccctgagggcaggagaccatcttagttcccttctgttaaagagatctatgattcattacttccagtgtgaaggccaggtgcttttgcatgagttgtaaactgctaagcgagcccttttgtgccttgtttgtgtatgagagtctttctcttcagagtgtagggcaacctgtccccaaccagtcccctttcccaacatccccacccacagtgtgatggatgctggcagtcataccacattcaacatttccaagtgggacttgtttttattggatatgatcaccaaaaaaatttgaatttagatgagaaacaaatcaaggggtggttattcacattgccgatgggttttgggttttgtttttttttttttccttcaaaatggttcagcctaggggttctttaaatagcaagttgctctgctagatttaaatgggatttgatatataaaaatccatttacacatttaacaggatgttatgttggtataccagaatgatgaagagcaaaattctggagtcttaaacccaagcaagtttagaatcccagctttctcgtatcctggcttgtgtgatcatgggcgagttatttaacttctctcagcctcggttttctcactggtaaaccagagatcatagcacctcatagatagcacttctggagtgttttgaatggcagaaacagaaagtgtcgtgtaagacaacacatgcattgtgtaaggaaagtcttagatgtctaacacagcagtggcagtgttcattttcagggccattttgcctgagtttttgttaggcccttctctcttttcttctttgaatgtatttgtaaacttgaaaagaacaccgcgaaaagagctcaggatcctgctcagccacacttcacctgctctccagcttggcatgattgattgtcaggaaggcataaagaactcaaaccatgaattaccctactcggggtaatcacaatggtttggatggcatctccttaatttttgctttgacttttctttcctccgggcaagagagagtagaaggagtggcaagagtatgccttttagttactgagttctaaattcttggaatgagcatagtctgttttctcaggatcagactagaaggcgtcattctattacagaagagccaagacttgtcccaaatggatgtgggtttcagcaaagcatctttagcttaaggagcgaaggatttggactgtgttcagcatctgtgcttcgcaggccactctttatccttttagtgagtcccgcttgtctgtcctctgtcaagggctcgtgtacaccatgctgatttagtgctaactggggagattacaaatgccttgcctggcactgtcagctaaacctgaatcattgtctgtgtactgtgacccgactagtcagaggtttaccctttgctttgctgctcactcttataggcagaaaagcccagctcaccccagcttttataacggggtcagctccagaaatagcacctttaactgggaatagaagcaacacaaatccagcaagtagatagtatacaatggctgctttttggccttggaacaaacaaaagtggtttatgtttactacataccacttccaaaactgctgtctgtcatttactagagagtttatcattcctgagggccaaggtctaggttttcttcacacaaatgccctccaagtgggagctgcttggtgttggtcattgtttgcacccagatttataatttggggttaattagacataaagacttaaaggcaaatgtggtacctgatggaccatgggtagataagacacctcccaaaatggatggtgaaattctttttaagagtcatagtatggagaaagtccccttgtgaagctttgtgttggagcctagaattgtaatgtatggcactattagacttccaaaaccaatgtgaacttcagtcgtttgtatcatgatttgctttatcctatgttcctatctttcccggtagtaggtattactttgtctgtgggttacatgtctttctcctctaagatttaacctggggattattacatgcatatttatatgcccagagacaatagtaggcgctcatcaattgttgaataaatgaatgaatgaatgaccaaatgattgaacaaacaaaggagcaagtgaacaaacagagatgtgaagtggtggggggcatttctatatgattgtgtgtaaagagcaccctaacacagcatctgaacaaatcactcttggaaatctgttcaatcccaccaccttcactagctattcctgtgaaccccaaccctcccctagatacattttggtgatatattagattattttttctttgcctccctcctaccatgataaaaaggatattgaatggccaaaccagtgcattacagtaacatgaaagaaatgtttatctttcatctaccagaattcaaggaaaaaaaccacaaaactttgtcagctagatactttcctgaattgttttttaaaattgtttaaaaaattattattattgccaggcacggtggctaacacctgtaatcccagcactttgggaggctgaggcaggtggatcacctgaggtcaggagttcaagaccagcccgagtaacatggtgaaaccccatccctactgaaaatacaaaaaatttagctgggtgtggtggcaccatgcctgtaataccagctactcaggaggctgaggcaggagaattgcttgaacccgagaggcggaggttatggtgagccgagatggtgccactgcactccagtctgagcaaccagagtgaaactccatctcaaaaaaatatatatatattattatttttaatagggtcccaccctgtcacccagtctagaatgcagtggcacaattatagcctacagcagcctgaaattcttggtctcagggaatcctcccacctcagcctcttgggtagctaggactgcaggtgtatgctaccatgcacagctatttaataacagttttttttagagagggagcgttgctttgttgttcagactggtctcaaattcccggcttcatgcgattcccctgcctcagcctccttctcaggtagctggtattgtatgaattgtgttttgaataagaagaaattaaggcttataagatcagttgtgtgttagcagcgatgttgctgactgatctttgcaatctgtaggactatttggtgctacaataataagaaattaatcagtttgataattttgccatcatttttaaaaaattttgtaaaataattgaaaatcatatgtgcaatatcttataaatttttattttcaaagcacattcctatatggcaattgaagtacagtttgaacttacttttgactaccttcttaatagtgattgatcataaattataaaattttcacttaccaaattatgtttaaaaagctaaatttaacattttctttttaattttggagttgaatggtcctttattccagtctttgtttttgtttttttccaagggaagacaaatatttaagttcaaagtcatgtttaatagaggaaatgaatgaaaagtggatgtctgttatctgtttgcaacaatcatctttatgtcctagtaaaagtttaattttaaaatctaactttacagatctatacccagtaaatttttttttttttttttttcaaacagagtcttgctctgtcacccaggctggagtgcaatggcgctgtgtcggctcactgcactccgtctcccgggttcaagcgattcttctgcttcagccctcctgaatagctggtactacaggtgcatgccaccacacccagctaatttttgtatttttagtagagacagggtttcactatgttggccaggctggtcttgaactcctgacctcaggtgatctgcctacctcagcctcccaaagtgctggggttacaggcatgagccgccactcctggcccccagtaaataattttaagaatcttaaagttactcatttttacttagactttatgagattaagctattttcaaactcacttctatttgtcctcccctgagagctatttacaaatttgtatagcactctggagtgtgataatatcgaagtcaatgcacagtcaggaggcttgttaacttatgtgatgatgtcagttttgataaacatctttctcatttaggcatttaatgataatcatttcttcaagaaaaagttcttagtggggaaaaagaggcgaaaagtacagtgtgattaacttatgatgcattttggattacagccttttaaccaaaagagaatcatcattaaaacaataattcctcagaaggcttgaggcatttaacttctcttaattaaattagctcagtttactgccagtcaataaagtctggtttggaatgatgatagaaattaaatatctaagaatgcagtatacataatagttaaagaaatgcaattaaaagtaataaggaggtactacttttcacttaggaaattaataatgatttatagaagtgagactactaacttctgggaaaaatatagtgagactgtcacttttatacaccactagaaagcccttttataatgtttgtcaagattcttcaaaatactaatagcttttgatccattaattctttgtctaggacatgctgagttggtgatcagatgtgaagaaaacttcaggccaggcttggtggctcacgcctgtaatcccagcactttggtagttcaaggtgggagcatcgcttgagcaaaggagttcaagaccagtctgggcaacatagagagatcccatctctacaaataatttaagaaatgaaattagctgggagtggtggcacatgcctgtggtcccagcttacttgcaggactaaggcaggaggatcacctgagcctgggagattgaggctaaagtgagcccgtgatcacaccactgctccccagcccaggtgacagagtgagcacctgtctaaaaaaaaaaaaaacctggaaaaagaaaaacttcatacagccaaaatacccaacatcatgcaaatgcatggttgatttatgttattttctattttggaatattatgcagaggttaaataataagtgcacataatatttactacaaggcagaatatttgctatatcttaattttactaaaaagtgtaacatataataatatttgaattatgtatggaaaaagagagtgagaacaagaatgaattgaaaacagaaagaaaatgcacccagatgtttacagtcagtgattatgttctgactggcaaaacataagtagattttttttttcttttttttttttttgagagagatggagtcttgcttgtggcccaggctggagtgcagtggcgccatctcagctgactgcaagctccccatcccaggttcacaccattctcctgcctcagcctcctgagtagctgagactacaggcacctgccaccccacccggctaatttttttttttttgtatttttagtggaaacggagtttaaccgtgttagccaggatggtcttgatctcctgacttcgtgatctgcccgccttggcctcccaaagtgctgagattacaggcgtgagccactgtgcccggccataagtagatttattttctaaaataagtgcatattacacttatgataaaaattatcatcatgaaagattttatgttcaaggatttcatatagctgctttgtatttcttctggcacattacagtcatagtggcagtgacttgtagggacattgtcctgatacttcgagtgcaattgatgatatttgtttaatagtgaatgtagcttaagaaaagaaaagcaatcaaacaacaaggtgattaatgtagccacttcaactcctcagatctttggctgacatgttttcctagcaaagcagaggtacttaactaaccacagagaaatgctcacacatgtcagaaggaaatccaagtgatcacttgttttgccttgggcatctgcactttttatataagtatgactttcagtctgtgagacctttcgataagtagtgataatccagaaggattgatgtagtgattctggacttgagatttcttttcaccactaagacatttgactgtcacttgcatcttaatgcgtccatataattttctaaagcattgggggactgactaggtaaagtcactgtggccttttaagtatgtggccagctgatctcatggcctaccagggcttccaagtgattagtggggattggcaagaattgacctctttggagcctggggaggcagaagtacctcagtaatagggttcagggagaccatacatggagcatagctctctctgactttcaagtggatagagctagtaggcctctactcattgtggtgtttgtgatcagacaacccttgctttggaatcactcttcgttgagagatactgagtccaggatgtgccaagcaagattgtagatactctcacagatgaattcacccattcatttattgagcacttgattttttaggagtacaacttcatcattaatttcctagctgtgtcatacaggatcagttaggttagattctccctttgtaattaatcctaattgctgggactttcatgtttctaataaatgtctattcccataatcctgtcctacattagctttcttcatgttgttctgtgagatctatagtaagcagatgacactgcttattatagattagctacttcctgtgtaataaatcaattattcctctcaatagggacaatcttgaattaaaatcacatttttttcttagagaattctctgtcaaattctatcaaaggccatggttttttttgtttttttttttttcctgtccagagacaccttattaatgacttgattttatccttatttcaaattctaattcatgaatatcagggtataaaatattaaatatgctggttcagctaccagcttttcaagcatcattggggaacatcctgttatataataggaaaacatttggtatggcttttgggatgtagatcatttttataattattatagggagtaaaaaatgcagaataaaaaataatttaaatataattagaagtgagagcaggtcagtatgaccaagaatataaatcataaatctctctatttttgtgttcctttatttcatgcagagaaataccaaacctttgtttctaaaagggcaccaggtctttcagaaagctgtggttctcagcagcaattttagttaggtttcgtttcatgttttctggtattctgggcctcccaatagccatttgtgcctaaaagagagagaggatgaggagatttgggttgcttgtactgccagcctggtggcactctggggatattagatgtgttctgaggatatatgtgtttatttaaatttaaacagaaagtatttcaatggatgctgggcgcagtggcctgtagtcccagcactttgggaggctgagttgggtagatgacctgaggtcaagagtttgagaccaacctggccaacatggcaaaaccccgtctcttaaaaaaaaaaaaaaaaaaaaattagccaggtgtggtggtgcatgcctgtaattccagctgctctggaggctgaggcaggagaatcgcttgaacccgggaggcggagtttgcagtgagcagagattgcgccactgcacttcagcctgggcgataagcaagactgtgtctcaaaagaggctaggcgcagtggcttacgcctataatcccagcactttgggaggctgaggagggtggatcatgaggtcaagagatcgagaccatccatggctaacacggtgaaaccccgtctctactaaaaatacaaaaaattagccgagcatggttgtggtggcacacacctgtagtcccagctactcgggaggctgaggcaggagaatcgcttgaacctgggaggtggaggttgcggtgagccgcgatcaagatcatgccactgcgctctagcccgggcgacacagggagactccatctgaaaaaaaaaaaaaaaagaaagggagagagggagggagggaggatttcaatgggacagaaattcaccaggtacattagaaagccttaacacttgagaatgtgaagtcttaaaaaaaatttttttaatagtttgggttacttaaaatgaaatactgtactgaagcagatagaaggactcttaggacctttctgtgtttcttctgtacctaatggcatataataaattcactgttttgtttaaatgatcagttgacttgagctttctgtcatctgctcagaaacactactttaggaatcttattccatttgggaattctgactagaagctctcccagggtcatcatatgaatgagtaacttacttcgcagctctcctcttcctcagtagctgcttctctgtagggctggagggaaagagagtcttccatgcagtctcatcagccaagaggaaggagatgctggtacctggtctgcatcccaacagacagcacaccctcatgccttccccttgaatgtacctttttggctcttcctcattcctggggaaatgtaatagttcttgattgttcacagtgttgactgctccctacaatgtgaggttccccctctcctctcccacagatggcacagagaaagtgcttatcatcgacacagtagtggggaaaaaaatggattctcattttagcaggtgacttgagggtggttggttgtcagtgtgctttttttcatattggcttgttgctacagggtctgatgctggcagattacaactttgtagctagtcattttcgatttatttgaacctatttctccagtctactgagctttcactggctagcatcaattcagacacattgcaattcttcagaatctctatccccatcagatggttcgatctatgagaaatttagctagaggcgtttagacaaaaaagaaatattgtggctggggaagcatttaagttagaggaggcagccagggctgttttattacttagtcctgtgtcacctgtgatgacccatgagagtggagaatattgatcgcttgtcactcaaggcattcagcagattgcattgacaaagcttggcaggtctctaatagcagggttactggccttgctgcggcccaagggaaaactctgcaggccctattacttggcggcctttaactcttatagaattgggagagaacactgacaaaagcgaggacatgattttacggttacaaatgatttttcttgcttgctttcttctcaccctttttaatttttcttttcttcttttcctgtctatcttaccttccctccgtgatccctgccagcccctcctttcttattatagctgatcatggcagtattgtttttttctgggtaaaaatcagagtggattagagaaagcttagcaggcctagcatgaggcctgagttattctctccttttaggacagcttgtgcctgaccacattgtttggaatgtgcctgtggatatatatacagtacttgaacttgatgtgtaggccattcacagctgttgtcctctagtagaataagaactgccacttcatgacagatgggtttctctcgttttccatttcctggtagccaggcttggttcaagcctttgaccttacatagtcccgaggttcagctgaaagtaatgtgctgacatcagagagataatggcactagtgcaaaacaggaatgattctaaaaaaacagtagagaggattctatctttcctagacactgcctgatttatgcacaggttcgaatcaccaccattaatgacattttcattcctaacataggttggcctcctgttggacactgttgtgtaatgagcgtttctgcatggctgtcatttgctttatgaagcattctttttatttctattttctgtgtacctttcatttaaaaaaatatcgtgtttgttatctccattgtctctttgaggatgagaaagacaaatatcattacccccatttcaaagaagagtaagttctaatcacaagtgatttaaatgttagagtttcattcaatattttcactaaaatttctagtcctctagtaaatcagatataagcaaagatcatatgtctatttcagcctctaggtaggctggccagctttcttgctttctccctctcccctcccctcccctcccttcccctcccctctcctcccctcccttcccctcccctctcctcccctcctttctcctctccttttttttttctgtagtcttgtactggtcaccccttcacttcctcttcctttgcaatgctttaggctgcccaaaaggttctagccagatgaacagaaacagaggagaggagagcttcttaagaggctggtaggccaggtgcaatggctcatgcctgtaatcccagcactttgggaagccgaggtgggcagatcacctgaggtcaggagttcgagaccagcctgaccaacatggtgaaaccccgtctctactaaaaatacaggaattagctgggcatgatggcgcacacctgtaatcccagctactcggggggctgtggcaggagaattacttgaacccaggaggtggaggctgcagtgagctgagatcacaccactgcactccagcctgggtgacaaagtgagacctcatctcaaaaaaaaaaaaaaaaaaatgggatgggtcagccttgagtagtggacatggcctttgcatttatattccaacattttgccacagatgagttatgtattattggcagattacttaatctctctgagcctttgtttctccatttatcgaatggaaggtaatattgtttaccaaaaaaagtgaattatgtggtatatggattatttctcaataaaaaatatgagttgtgtaaagtttctaacatagaaatgccctcctttgcttccttcctccttatacaactaagggcccacaaaggcagaatgagaattaccatctaggccaatactggggaaatatgtgctactactggagacagaaatgtggaagtattgcaaacgaatgtggacctattaatattctatagcactttgagccactttgaattaaaatacttatctgtgaaaggttttataatttatatgacctgaaataatttacacctaattagattttgtcaactgaataattctgtctcatgttgcttccacagaataatttaagcaactgcattttattctcaaaatagctgtaaatgtcaaattaattttgttgacatgatcaacatgtagaagagctacttggcagaattgtttgtcaactgaatgtattatgcatctttacaaaatatgtagattgattatggtttagctgacttttgcagtttgttggtctcctggaaagaagtaacgggtggtggttacaaaaaccgttatggcatttctgttcatctggctagaaacttttcgatatctgtaagttttccttcacttttcattatatagaccatgtctttcccttgggtgttatcttttttgtctgggtgagactggatcccacgtaactgctttggtgtttgttatactcctcattaattttatggggctcttagttgacactggccacataaaaatgattgttgagtctcactctttttattttggaccatttctttcatgtgggagcctctttatccctctccttaaaaaccctgtttaaggattagtgtccttgcagtttagttgtagcttactcaagttatcccatttattccaaaatcccttttccactccattataccctgtctagtccggtcttctagctactaagattgaagtcctgtcatcttcaggtttggttgaatccagtgcttcccaaccctgtctcatcatggcacatgtagaaaatgatattattgtacagcacacggaagtaaatcaagaccttttgctgtggaggtacctggctcagaggccatgacctgccttaagtaggagggaatacatgcatactatcctgtatgttttggtgtaaccaatccccaaatttgaaccaatcttggcaggtattagaaatttgcttatttggtgacatctggaatttacctcctcttttgagctcagtatttcatgtactttaaggtcattactgagctttctaccaaatcattcccatttgtgtctagtcattagataattcagatttctaccttggatgccttgaagtgatgacaccttacccttgctcatctctctcccaagggaataaacctgtattttgctttcagcttctgcttagaggagctggctccatccagaacaattcccctcccactggacatcaaaagattgcatttccattggcaacaagtctcaacatagctcagaaactactgttgactacttgtctcccctataacaatattggatccattggagagtgaatcagtgtctccctcaagttcagcccactcatttagatttttcattttagactccgtgggaaggatgtcccagtgcagagttggcctctgtacccctgattatgtttcagctttctctaatttctctgctaacctgctgttgatgcccctaaaggcactcaatattgagtgtgctttataaatacatgaactacatgtattttatgaaaacataaactacaaatacgttaaaatatactgtagattcattactaaaaggcattatctattcagtatccttaatgtacaaataataaaagagatatgaaaccctgtgtctagagctaaaaatataccttgacagtacaaatacacatggctaaaaggcattatctttttagtatcttcaatgtacaaataatcaaaaggtctgaatacttctgattttcataatggagaaggggaattgtagaaactgtagaccaattagcttgatgtcagctcagaaaagattctagaaaatattattaatgaatgctttctgagagtttaataaaagaagtagtcatcactgggaacctgtggaggttcacttaaaatgttatgccatctatattccttcttctgcagcagagattgccaaactttttctatacatagccagatagtaaatattttaggttttttgggccatacagtctctggtacagctactcaactctgccactgtagcaggaaagcagccacataggcagtatgtaaacagatggatgtggatgtgttctaataaaataacttaatttataaaaacaggcagcaggctgatttggccaattggccatcgtttaccaacccctgctttagaagaatatcttagataatgtgtacctgatatattctattcttctttctgatgggaaatactttctctttttttggcgtaaagacgttttattttctttgctaataaagagttggcataaaaaaaagcatcgcattaaaatcttcataaaggacatggaaaaggctcaagttaataatagtttacagtaagttctcacttaatgttgtcagtcatttcttggacactgctaccttaagcaaaatgatatataatgaaactaatctttttttctcaccaacattgtagtgaaaagatgttgaacaaaaagacgttatccaaggatgtaaatcatttaatttaaagttgcagtttccaagaacctattgactgtgctaagtgaggacttactgtagttaggtagaattataacaggtttaataattatgaaacatgaagagtggtctgtggttgcaggccacaggctgtgtgctcttgattcaattatgtcaatatttttattagtgacttgactgaggttggaattgacttgtggatcaaatgtgtggatagcctgatgaagagagagatcacttacactttgggtgataggagtaagatcccaaaaggccttaggatagcagctgaaatctttcaggcttaaatgttgaaaacagataaatgggaaaccctgtgtctggagctaagaatgtatcttgacagtacaaatacaaattgtgaaaacatagttgaatagcagcctgtttgaacaaagctaagagagtatttcaattagagtgcttgcagagaaagttatccaggtggttgaagggactcagaatcatgtcctattagaaatggttgaaagaagtgtagatatatagcctagggggatatatgataactgtcttcaattatttaaagggctgtcatgtagaagaggaattagacttattctggggggtcctggaggacacaggggagagcagtgggtagaagatacaggtagattcaatatgtaaataggaactttctaacaatttgagctgtccattagagggatgggcattatttagagggtttaagtcactggcaatattgtagacatctgttgctgaccttgtggggatgttgtgagagaatattagctttgactcattattggatgggatggttcttatggtcactaacaattctgagagtgcgtaaaaggtaggccgagggataatgtgctgcgccctacgtcccagtagttggcaaagtccaaacccagatgttttgagtctcctgccttgtttatatggttgaaatgctgactttacacagtgttccatatatgtatctgtacctgtcatctttatgtgattggctagagaccctgtcacgttcacttttgtaatctcacaaagcttgacaaatgccctgtacataggaggagcaaagtgtttgttgacctaaagtgaattacagaacagctgagacacatctaaatattgttcttttactgatcctggttccataatgaaaacatttggaagttgaccagaaattatacctggggattcctagtagaatggtgatgtagatggaacggctctctgcctttgtttctgtctgtggtacaccacacacaaatgccaacacttcaccaagagtggaagccatcaggctgcactctctgaccaggattgttttaccccttctggatggcaatacatcgctccctttctttttcactgcctcctgtgcatacctccgtgctaaattaaactccagaccctgggatgtctggaatatattttccagtcttctgaattctaccaccctgaagtagtcatttgctgtcatcataattctggaagatttaatattcagattgacagtggatatgccggtctcattctttgatgtttggtacatgggcaagtggtcaggtatcctggcctatttatcaccatattctccatggcctgtactcagggtcaggcatatggtaggtagtcagtgaatgtttgtttttgttagtaggactctggtttagtccttacagtagtcccttttatccatgttggtatgttccaagacacccagtggatacctgaaactgtggacagtaccaaaccctttccatactgtttttttttaatatgataaccaagacagctactaagtgactaacaggcaggtagcatatacaccatgctggacaaagagatgattctcatcctgggtggacagatcaggacaacgtgagaatttcatcttgcaactcaaaatactgcctaatttaaaatgtattgacgaattgtttatttctggagttttccatgtaatatttttggactgtggttgctcatgggtgactgaaaccacagataaggggtactactgtacttctgtttcatcctaatgaagtaaagtttctttgttcatcaaggcagtattttctttctcttttgtacctaccatgctctacctacctcatgtcttcattttctgtgccactttcttgctgtgttttattaggataatgttttaatagaataaaagaagggcaaaggtatagtaattgaatgtccttcactatcaatccccccaacccctgaagggagaaaggaaggagaatgtgggggagaggggaaggaagaaaggaaatggtggagaaagtagagaatgagagaagcatcctgtttcatactgagaagactttggtattgaagaattttgactttgttagtgccatataacttgtgtgttgctttgtttaaattctcgtctgctctcatgttttcattgcattctgtggatagcagctaagagagctttcagacacatctgtattagaagtaaaataactgttaatgtcaagactatatctttgcttttttctccctcagcttcttttctcgattggtagaaaacatggaataatggtgccagggttagctttgcctggagaagagttctgtttgccagccctgctgcagattgataaccatcaagggaaggatagcccagtcataagtgaccttgtggactgcgtatctttatgtaccccttacacactagtaggaagaacccaaataccatctgccaatgacagtgaggcaggaacctcacttttgtgacaaaaggattgtactttgctctgctggaactggctcgttaacaattcataagaaccaattaagttttcaagaattttgtgagctggttttttagtaaaacctttattagaagttaagttatattaaaaaaaataattagatgggtatggtggcaggctcctgtaatcccaactgcttgggaggctgagacaggagaattacttaaacccaggagatggaggttacagtgagctgagatggcaccactgcactccagtctgggcaacagacagaaactccatctcaaaaaataaaaaaaagttatgtaaacttacctgtgcttttaatataatttacttaattgtaatcagtattcaaaattcatcacttccttattagctgctacattttactaatatccatgaccttgaggttatttacatctagtatatggtagaaatactacaaaatgatgtgttattgagcctcttttcctaactctgtattcaatgacatcactttagtagccatggtggaagtatttacaccacagaaattggtaaacaggatgtcttattctgttttgttctgctgtaacagaacaccgcaaactgagtaatttataagcaatagaagtttatttggcagatggttctggagactgggaagttcaagatcaaggggccatatctggtgaggaccttcttgctgtatcacagtgtggcagaagacatcacatggtgagagaacatgctcaagagagtttgaagctcttttataatcagcattaatccattcatgagggtagagccctcatgacctaaacatttcccattatgttccatctcccaacactgttgcacttggggttaagtttgcaacacatgcttttggggggacacattcaaaccatagcactgtacaaatccaaatttggtcatttgttttgttgattgtctacacttaaaagaatgatggaggaaatgttattaatacagattaaatttaaaagtatgttgtatttgcatccattacattgtggatagcaaaacaattaagagaatatcttcttgtattttgaaactgtttccaactcaacaaagaagttattcatgtcctcgaggaaggaaactgtttatatcattcatgtcttaggtgttccactttaattttactggttcaaaaacatcaaccaggttttacaaaactacactcattcttcaggtacaaccataggttggctgtagatataagaattgcacatattttaacagaagcattctgtgaatgttaattttcccatttggttggaattcacagtaaagtttagcatgtactttgttattatttgtaaattgcttgctatacatgatttatatcagtaaattttataataaataggtgtacatctatacatacatacttcttttcccaaggagctggttgttaagtattaccaacacactactgtttacaatccaaatgagaatgtagctctgtgtcttaaggtagtgatgatcttgtgtaaatggtgagatttttgccttcatcatagcaaaaggctcaaatgcactataggaaggaaacctttctgattatggaatatgaagtcaggattttaaatgccaccaactgtcgaacacttaaaggacaaagtgtttgaaatcttaaagcctgcctactctatttaaaagaacattagagggcgttggaaagaggtgataaatatcattaggacctcagcaaggctttggaacccaacacattgaaagataattgagtgaagaggatctctggacacaaagcaggcaatttagttatccaaagcatttatgtcaagcagctaatgcgtgaggatttatttatttgtgtttttctctcagagcttaatccatgaggagtacagagtggtggtagggtggaggctagcctttattttgcattgctctgagaagtgttgcgataatgggagaaatttggtgtcctagaaacgttattattataaatgaaaaatcttgaaatacgaggaaagtgaattttttaaaactgggattagaaactcagaacaaaatgagctggacgcgctggtcatgcctgtaatcccagcactttgggagtccaggaagggcggattacttgaggtcaggagtttgagaccagcctagccaacatggcgaaaccccgtctctataaaaaaaaaaaaaaaaaaaaaaaatcagctggatatggtggtgggtgcctgtaatcccagctgctcaggaggctgagtcaggagaatcgcttgaacccgggagatggaggttgtagtgagccaagatcatgccagtatactccagtctgggcaacagagcaagactccatctcaaaaaagaaagaaggaaaaaaaagaaactgagaacaaaatggtcttttgcctctttctacttaaataagatggctcatgcaaaactatatttttgtgtgagatttttggttaacaagaagttgtatttccgttcatcagttagactcagtgtggaggaatgttttgtttaacctactttaactagaaacaaaatgtatttgcagaagtttataggtagaattataaggtgatctaataaacttgaaggttactttcagcatatggaaatcagaattttgttagtggaatggcaaatgtgaagaatgaaaaatccagttgatgccagttaacattaacttttaggaaagaaaaaacggtagatttttctgtgaagagtgtgtgtgtgtgtgtgtgtgtgtgtgtgtgcgcgcgcctgtgtgtgtgtttaaattagatttttctgtgaagagtgtgtgtgcctgtgtgtgtgtttaaaatttagctcatctggttctgtgttgtgtgttttctctgtgtgtgtttgaaaggggacatattatgaacgttatggttccctacctctaagatccattcctaaaatagttttactaatccgaagaatgactaagaatgtaactatggaaataaaatgacttttcaatcctgtgttgactacgtgcctaaaatgttgatttgctaaaacctggtacttccaaattaaatttcatggtatatggatgatttattgtaatctcttgtgaggaaattcatcttaaaaactttttcgaaatcatcctaagtttgggagaggagagcatttctaattcaaagcaggagtcaggctaagatcacatgtctccctagaggaaagaggggaggttttacttgtgcatatgttttttaaatatttatagatacagctggacttttagtactttagttctggttttaatgatggaattcccaaaggactaaaattgttccaaatgtctgaaccgtgtctgaagttcaagaacagtatatggttggtctgaagactttaatcctagttggaaactttgaatgagaaacctggccttttagtcttgtatttcttgaactttctgttaacagaatatctcctcgccttttatgtagcccttaactagctgcagactgacttggtcttctctagtaaagcattttctatgtaaggtcaccagtaaatttctttttgtcaacagagtaccttcttgcctcctattcagccgttaactgttttgtactgacttggtcttctctactaaagcattttgtatataaggtcaccagtaaatttctaagtcataaaattaagtgatttttcttatttcccatctatccagtcaacagtcattttattcagtacctactgtgtgacttggtgctagggattcattagtaaacaaagcaggaatattcttttacaatgtggagctttcaattttctgaccctgttgaccttccttcttcaaatttcataaactcgcttacttctggttagtgaaatcaatgatgattattttaataatgattcctcccctcatgattgtgctcagggccctctctttccctgatgattgtttttcttgatactttgtggatgattttatatggctaagacttccaggttgtcatctgcccatacacagaggaagtcctgagggaacccacgagtttcctctcactgcttccgtgctgtgtaggcaccttctcctgttagaaaaccatcaataggagcttccatgatcatggtggaggcggcaaatagtgtgtattttgcagggataaggcagcgaggacaagttgcctctatctactttagccagaagattagtactaatttctaaaactttcaaatttgtctttaaaaaattgcacccatatagcatatacatttagttgtatgcacacacacactaaaataaacttctttgtatacagtgatttggtataatcttaggacgattgtattttccttttgtttgtaacaactttattgagatataattggcatataatgaactgatcatatttaaactatacaacttgataagttttgacatgcatacacctatagaaccaacacaatcaaggtaatgaacaggctaggtgtgatggcttacacctgtaatcccagcattttggaaggctgaggaagcagaatcacttgagcccagaagttcaagatgagcctgggcaacactggaaaactctctcactacaaaaaaattaaaaattagctgggtatgttggttcgtatctgtagtcccagctactcaggaggctgaggtgggaggattgcttgagcccaagaggtcaagactgcagtaagccttgatcatgacactgtattttagcttgggtgatagagcgagattccatctcaaagaaaaaaaaatgaatatatccatcacccccaaaagtttcctcctttctctttgtaattcctttctcccccacctcccttccatctccaccccagcttattccctggcaaaaaaacaaaacaaacaaacaaaaaaaacaaaaaacaaaaacaaattaactgttttttgtcactataaagttgtatacatttttctagaattgcatataaatggcattacatagcacatactgtttgtccttttttttggaggagggggggttctggcttctttcactcatattatgcttatccacattgtgctgtatataatgtttcacaatattactcaatttatggatataccatagtgtgtgtttatacattggactgttttcagtttttgttattatgtataatgcagctatgaacatttatgtaagagtacaatgtacattctcttggacaaataagagtggaatggctggataatgtactaggtatatgctaaatgttctaagaaactgccaaacaataatcaaagtggttgtaccattttatatgctcaccagcagtgtgtaagagtcccattgtttccatatccttgccaatacttgttatgggcagtcttttccattttgccatcctaataggtatatagtgctatctcattgtggtcttgaattgcatttccctaatgaataatcatgttgagcaccttttcatgtgtgatttttcatctgtatatcttttttggtgaattctgtttatatcttttgccaatttttaaaaattacatttttttcttgagtgtcgagttctttattctgtatacaagacctttatcggatatatggtatacaaatatttgcttccagtgtgttgtttgtctttttattctcttaacagcgtcttacaagataagaggtttcaaggttgttttttaatttttatttaatttttagagataggatcttgctctgtcacccaggctggagtgcagtggcatggttatagctcaccgtaaccttgaactcctgggcttcagccatcatcccaccttggcctcctgactacctaggattacaggcacgaactaccctacccagctaattttttaaaaacttttttgtagagatagggtttcaccgtgttgccgtggctgttctcgaacttctgagctcaatcaatcctcctgcctcagtctcccaaagcaaaggtttcaaattgtggtgaatataatctatcaacttctttttatgggtcatccttttggtgtcatatctaagaaattatttacataccaaggatacagggttttcccttatgccttgctctggaagggttacagttttaacttttacatttatgtctgtgatccattttgagttaatttttgtatatgaaatgagacatatagtgaattcatttatttttgcatacttttttttttttttgagatggagtctcgctctgttgcgcaggctggagtgcagtggcacgatcttggctcactgcaacctccgcctctgtgttcaagcaattatccctgcctcagcctcctgagtagctggaattacaggtgcccgccaccacacccagctaatttttgtattttttagtagagacagggtttcaccatgttggccaggctgatcttgaactcctgacctcaggtgatccacctgcctcgccctcccaaagagctgggattacaggcatgagccaacatgcctagcctatttttacatacttctatacagttgttccagcatcatttcttaaaatgactgtcctttcttcagtgaattacctttgcatccttgtcaaaaatcagttgtttatttacatgtaggcctaattttcttcctttttactaatcaatttgtctgtcttgaggttgccaacccaaggcccatgggccaagaaaagctcacagcctgtctttgtatcatctgttagataagaatgcttttttctatttcttaagggttgtataaaaaaaaaaattaaaggaaatgtgacagaaaacatgtgtactgcaaagcctaaaatatttactgtctgaatcttctcagaaaaagaaaatttctaaacttgacctatcttgacaccaataccacgtcttgattattgtagttttataatctattaaaatcaggtaatgttagtcttccaacttactttttccttttcaaagttgttttggctattcttggccctttgcatttgtgtatgaattttagaatcactttgtaaatgtaaatttcttcaaaaagacctgctgggatttttattcatattgtattgaatctatagaccaatttcaaaaaattgatatcttagcagtattgagtcttttaactcataaacaaggtgtgtttctttatttctttagattttctttaacttctctcagaaaagttctgcagtggccgggcacaatggctcacgcctgtaatcctagcactttgggaggctgaggcaggtggatcacctgaggtcaggagttcaagaccagcctggccaacatgctgaaacccagcctctactaaaatacaaaaattagctggctataatggcgggtgcctgtaatcccagctacttgggaggctgagacgggagaattgcttgaacctgggaaacgatggttgcagtgagctgagatcgcgccactggactccagcctgggcagctgagtgagactccatctcaaaaaaaaaaaaaaaaaaaagttttgtagttttcaggttacaaatatttcacaacctttgtcagatttatcattatgtatttttgaagctgttgtaaatggcattgttttataaattttaatttctaattattccttgctgcaatgtaaatgtacagttaacttttgtatatttatcatatattctgtaatattggtaaactcacttattagtgttaatggctctttttaaaatttatttgtattgtatatatagttgataatgtcaaagaagagtaaatataattttccttttttttttttaatctggatgctttcatttcttttcttatattattgcactggctgcaatctctagtataatgttgaatggaagtggtgagagtgtacatgcgttttcattttaactcatattatggggaagcatttggtgatcttccattatttatgatgttagctgtaggttttctgcacatacctttatcagtttaaagaagtccctttctatttcacatttgctgaaagttttaatcaggaatggatgttggttttgtatcaaatgctatttattaatccattgaaatactcatttttttattttttagtttaatatggcaaatttaactgattttcaaattttttttataaaaacatgatatatttttataaaagtatattaaaaattattcgtatatatatagttgaacttaattagcctgtcattttctttttcttttttttttttttgagacagagtctcactcttgtagcccagtctggagtgcaatggcgtgatctcggctcactgcaacctccacctcccaggttcaaacaattctcctgccttagcctcctgagtagctgggattacaggtgcccaccaccacgcctggctaattttttgtgtttttagtagagatggggttttaccatgttagccaggatgctctcgatctcctgatcttgtgatctacccacctcggcctcccaaagtgctgggcttacaggtgtgagtccctgcgcacagcctattctgtcattttctttcattgtctttggtttctatatcaggataattctgacattatagaatatattgggaagtattcccttctctccaattttctgaagcagtttgtatagaatttatattattgtttccttaaatgtttggtaggatttatcagcgaagcccttgggcctggagttttctttataggaaattttaaactccaaattcaatttgtttaattgacaaagggcttttcaggttttctattttttcttaagtaacatttggtagtttgtatcttttctgagatttattatttctttaatattttgaaaatctgtgctgttgtaacctttcttattcttgatagtgacaattcatgtcttttttttttttttccaggtcagtgtggctagaggtctgtaagttttatcggtcttctcaaagaactaacttttggtttcattcatatttttgtttgtttgtttttgagatggagtcttgctctgtcgcccaggctggagtgcagtggcgtgatctcagatcactgcaagttccacctcctgggttcacaccattctcctgcctcagcctcccaagtagctgggactccaggcacccaccaccacgcctggctaaatttgtttttgtatttttagtagagatggggtttcaccatgttagccaggatcgtctcgatttcctgacctcgtgatcttcccgcctcagcctcccaaagtgctgggattacaggcatgagccaccgtgcctggccacaggtttcattcatattctttattgcctttcagttttctattttatttggtttctactcttatcgttgttatttcctgtattctacttacttttgctctctttttttttttttttagtttcttatgatggaagctgaaggcattgatctgagacccaccttgtttgtttgtttgtttgtttgttttgttttgttttgttttaaagacaaagtcttgctcttgtcccccaggctggcgtgcaatggcgcgatctcggctgactgcaacctccgcctcccaggttcaagcgattctcctgcctcagcctcccaagtagctgagattacaggcgcttaccaccatgcccagctaattttttgtatttttagtagagacggggtttcacaatgttggccaggtgtgagccaccgcgcctgtccgagacccatcttgctttctaatacagtttaatgctatttctccttcaagtattatactattttaggttcatcccacacattttgatatgctgtgttctcatttttatccatatcaaaatactttctaatttttctttaagtttactgagacttgctttgtgactcagactatggtctgtctttgtaaatattccatgtgtgcttgaaaacaatgtatattctgctgtcgttgggctgaatgttctataaatgtcaattatgcataatagtattttttaagtcttatatccttctcgattgtctatttatttgttctttcaattattaagaaaggggcattgaagtctccagctaatatttgttctatcaattattaacaatggagcattgaaatctccaactatagttatagattttttttatttctcctttgagttctatcagtttttgcttcacttattttgaagcttttttattaggacatttaagattgttgtattcttttcatgaattgactactttattattataaaatattctttgttctgaaatatattttgtctgctattgatatagctattgcagctcacttttgatagtgtcttttttcattcctttgcatttaacctatttgtgtccttatatttagagtccattttttttaagagaacttgttttggggtatttaggtctttataattctttttattgtgtctgacaatcttttgcctttttaattgtggatatttagactgtttatatactttcttgatatggttatgtttatatattttatcttattttttcctatgttcctctgtattctttacttacttttccacattttgtgccttttaaaaatcagttgagtatttttaaaggccgggagcagtgtctcacgcctgtaatcccagcactttgggaggccgaggcaggtggatcacttgaggtcaggagttcaaggccaccctgtccaacatggcgaaaccccgtctactaaaaatacaaaaattagctggatgtggtggtaggcgcctgtagtcccagctgcttgggaggctgaggcaggtgaattgcttgagcccaggaggtggaggttgcagtgagccaggatcgtgccattgcactccaagctgggaaagacagagagactgtttcaaaacaaataaataaataaataaataaataaataaataaatttaaaaataataataaaataaaatagaaatcaattatttttaatgattccattttatctcctttcttggcttattagctgtaggtctttgttttttggttttaattgttggttttggggttataccatatcttcaacttataccttcaagtgatatactacccattcatgtataccataagaatcttacaagtgtatacttttgtttcaactctcttgttgtcacacaattctacttttatatatgttctaaagtctatactatattgttattgatatttaattagttaattgttctttgaagaaacttacataatataaattttttttttttcttgagacgaagtcttgctctgtcacccaggctggagtgcagtggcacaatctcagctcactgcaatcttcacctcctgggttcaagcgatacttctgcttcagcctcccgactggctgggactacaggtgcgcaccaccatgcccagctaaattttgtatttttagtagagatgggatttcaccatattggccaggctgctagctgtgctacaatttctggtgctcttcattcttctttacatagatgcatttctatgtaataccatttgccctcttcctaaaggttatcctttaagatttctgtctttttttttttttttgaggcggagtctcggtcacccagactggagtgtagtggcatgatctcagctcactgccgccttcgcctcttgggttcaagcaattcttctgcctcagcctcctgagcagctgggactacagatgtgcaccaccatgcccggctaatttttgtatttttagtagagatggggtttcaccatgttggccaggctggtctggaactcctgacctcaagtaatctgcccacctctgcctcccaaagtgctggggattacaggcatgaactgccacacctggcctaacgtttcttgaagtacaggcctactggtgattaattctttcagcttttgtatatctgaaaacatcttcattttactttaatttttaaaagacatgttagttgtgcatagaactagcggttgatactttcttttcccttctcccagtactgtaaaaatgtttcacagtctttgcaattgcattttttaagtaagaaaattaggtatcattctaatctttaacctctgtatataacctgtcatttttcccctggatgctcttaagaatttcttttatcactagtattgagcaatttttttatgatctgcattggtgtacttttctttatgtttcttgtgcttagggttctttgagcctttagatttgtggttttatagctttcatcaaatttagaaaatgttttatcctcataggactattctgattctcctcagctagtaatttctttacctaatggacccatttacaaaatacactccaggtcctataaattttttttaataggtcatataaaagttactaccaggaatctgatgtttatagtgacagaatcaagtctcgacacttggaaaagaacattgtctgttttctcttgtaaactctgggattgctgaggttttcaaggaagccaggtactaaaccactctgctgttacagtcactgttcttctttttggctttcctacctcctgagattcttggcagatgaaggataagtgcttcataagcctgaaatggtggcccttctgggtcctgtggtaatcatctgagcacgtacttttcatttctgagttagtacggagattcctgaagttctgtctacatctttccaatgttggatttatacccaacatgtaggaatataaaatttagtgctaagatgataggtgttcactttgttccaatcctgtaatttgctgtggtgacatacaagggaaagagaagagccttaaatatttgcctgctagctatcaagtaggggggattatactcttaatctcatttacattttcttgtagctatagcaaagtttgacaggcaatcgtcatatcccccaaattatattagtgtgccagttacaggtctgtgactcctaagtattatttttaatacttaggagtattttaatactcctaagattatatttaaaaaacataatctcaccagtacatttttattccttcctttttaataaaccagctttgacagatgaaaaggaatctgtgctgtagctcagatttctcatgttaggcatattttagccgtaaacttaattatcgcaggaattttcaaatgactccaactttttctgcacttggtatcagaggataccaagtcctgtttttgagctgataaaatcctccttctgaaagcatttgtttattatattactgcttcacatgagctgagctctatcctgaccccgtgttaagtgtctgtggtagatttcattacatccatatactggaagtcctgccaatacactggcagcaaaatcctagtggaaaataaatggcaataaaaaagagaaatgatagcctgtgtgagtggtgaggagcacagctttattgagactggacaaccccagagtagtgacttggcatgcagacatgagcttaagagagtgtgagtgaaagctgatattggaataacgactctgtggcacagacatgggaataatttaattaattgcactgaaatttctttgatgaatagttatgtggtgataagcatgaggtcgaacagcagaatgagtctcagctttttaatgggccagcacagctgcggttttggatgccttcccactttatttctgcctgcagctctccaccgctttattcatccacatctcagctaggagcaccactcgcggggccccctctccatgtcggcagagctgaggggcaagtacatttggccatgggaagcaggctggtgactgctttgaaatgaaaaccagatcaaacgaaaattgtaggatggtgtccttatgatgcctgcacctcccctcctccccaaatctctaggatgcttttacagagtctttgctgctacgttgtataaagattttaataaaaatttcttgtccctggagaaacaggcatgtctttgttgtcagagagctagagggaaatgagcaatgcagcccagctggagtaccagcattaatcccatgattcgtagcccgtattttcagacagatcaattacttatggctgtaaccaatctctcatcgttttcttgctgtgcagggctccatttccagactcggcagctgacataaccttccaacttgataggacttcagctgcaaatctcttcaggtctgctgcctccattcatcgtggttatacaaatgagttgttaaataaaaatcaaaagtaaaaaattatgggtggtaatctctgcctggctcagtaatacccatgggcctaggcaacattttcagttggatttttaaaaaacaagatggatgattcacttgtctgacttccttcacttttatggacaggctttgcatgagagaaaagccatctctagagggaagaaattatccacagtggatacatttcttatcaatttataagttgaaagattaacttagaagtggagagaaaggagattatgaggagacacgaaggacatgtacaggtgagctgtgtctaatgcatttcacactgagtgagtcaccccttttcagctgctaggctgcctgggcttaaggccaggagattctgtatcaaaaagaaatgacccttgctaacacagaggtgtcatggaacatgtaagctgtttatagagtatgtcactgtgtgaatgtagaacttgtgtgaaggatctaaacccaataacctttgaagaatttacccagaatttatttagtgttttcaagttataactactccttgtgtgtattgaacccttcacagctatgtcaggccagctaagccttcctggaagaggtacttaggggccagataaagcaaattggagaatctctttgtgatttgactcactttagatgcacagatgctcatctgttaggaaagcatgtattgactctctttgtgcccttttctttcattgtcactccatcatttccatctcttcaatgaatagtcctttgaggactttcccattttccctataataaccaactacgaaaatttgcaggaagcaaaaaggaaaatgtggacatctagagaatataaatggttttatgtttaatctagggggaattatgtatgtatttatatatatttgtgtatgcgccctgcatgcttgttgcattttgctgtatgctttagaaacctttgcctacatggaacccattagtagtgtcctgggacaggtattcatgaactctgttaacaattaaggaagtaagttcctgctgctacaggctgacagccacagtttccccttgggcttgtatggctttggattgattctaaagaagcaaaggaaacatacagaacatacttgtttgatttgaaagttaaaaaccggtctgtgtctgttttcttctcccttttcactctagcccttcttaggcatcccaatgcgagtagtaaaacataaatcatgcaatatcataagatactgctacagctcttgccctgccctggatttgtttttttgtgcatctgaattttattatgatccataaagcagtatggaaatggctcattggtagggttgcatggcagtaccccatcctcagaccctgccaacaattgaaagtctgagaggtaataagaaataaaagggagatgagatttatagttcgtgagttcaagttgcttttttttctccgtggaatgttgcctgtcttattaggagttctttagtgaaacaaaatgcagtggtagcttagagaaattatggatactttccaggggtgtgggagaagcttaggagtctgtaagccttctcccctggttgcagttaggaagccagttgacagtataataggcttttggaagtgggtgcaatggtttgtgtgttctgtttgatgttgcaaataccaagcccgcagggagatctgcaaagaggatattctgttcttaaagaaaggaaaagattaacctgaaacgtgaactgaaaaactcctgaattctagaggacttaggtgcagccaaggaaggatctcatttacttacgtggaaacatcatttggcaagctgcctgctccagacaagcagatattttttaatgatttcaattaatgaaaagcaatcactaataaacttgagaggattggatcacatattaagagtgtgtgtgtgtgtgtgcgtgcgtgcgctcacgtgtgcgtgtgcagtatttgcatggttaaggtttggaaatacgtgcattctcatacacgcatagaagtcttacaactacgtgtactacttggagcctgcctgatggtccttttcttcacattcagaatcatgcttctgacccattaggagaggctaactcttgttattttggagacattttcaggagtggtaatgaatgggcattaaggcacttctgttattcatgaatatgtacattcacttaacatatttattgagtacctactgtatgccaggtattatgctaggtgctgaggttatagcagtaaaaaaataaaaagatacatagtctctgctctactttagtttataggttattggagagacagacaagaacaaataataatacagttatacacttaaaatttttatattgcctttgtattcaataaaaatttgttgagggcttctagatgctgtagactctgtgatagagtctaaagaaaagcgtcttgcctaatttctgttaaaatcagtggtttgccatttacgaggaataaactggccatgtttagttatggtattgaagaaagggtttgatccatacaggaactatacttcacctctatgtattaatttagtacacagttttaagaacagcaaggtagcattcaagaagagcattctgttatatacttgtatataaaccctattgtatctactaaggatattgttataacttcctcttcactggtatctcctcaactctgagttcaagacctacccttctctccagctgtgggaaatgggatttgtcaacctctctgagacaaagtttcacatcagcaaaatgggaatagttgtactagttcacacggggttgtaaagagtgaatggaattgtgtatttgaaaacacttcattaaagggatggatatttcaagtacactgatttaatttttacaaataatatgaatgtattagatcatcacatgtaccctgaaactatgcatatcaattatgcatgaataaaaaaattgttgaaaaagccggtcgcagtggctcacgtctgtaatcccagcactttgggaggctgaggtgggtggagcgcctaaggtcaggagttggagaccagcctcgccaacatagtgaaaccccatctctactaaaaatacaaaaaattagctgggcatggtggcgggcgcctgtaatcccagctaactagggaggctgaggtaggagaatcgcttgaacctgggaagtggagtttgtggtgagccgagatcgcgccattgcactccagcctgggcaacaagagtgaaactccatcttaaaaaaaaaaaaaaaaagaaaaaaaaagaaaaagaaaatactgtgtaaaggactatactcatttgagtttgtataattttcattattattacatcagatttacagagagaataaaatttattgaagccaactgtgttgtcttaaacctccgaaaattcagaaggaggataatgctgagttcaagtacgatatagaaatcatcatatcttttctctagcaagtgttccaagagaattagaatataatgccaaaattaaggtagaaattaagttattctagaagtgggatagccagtgtcagcatgcatgcatgatccttgaaaagtgatattgggcagcatttacaccaagctttgctatcttacgttctctttttgcttcttctacctggtgttatttgtgccttccctaaagggctgaaattgaaaagaattagtacgaatgcattttcaatgacaccttggccaagaggttcatgcatttcagctttggacaaggtgctatggttcaaatactcatgaatatgatataagaacagtcattatttaaatgatgaacctttatatgagattacactgggtgttactaatctgcaagttgtattttctgtggggaaaaatcagtatgaatgaatcaagaactcagtgtgcatcctgcagtgcatgttgtatttgcatgaacggagatgtaatctcttcaccttttgaatcattttgtttaaaggccctatatagatcattctgctcttactggtgggtgacattttcttaaggttctctccctagatagactaatttgaaaaaaatgcatccctcttgatgtctgcatgtgcatgtgtgtatgcatatgtataaaatatagaggtgatcacaaagcatactgggccacttagcacttccactaattccacattatcagagattgtttggagagcatatttcattctccctactttgtcacttatttctaacactgagtatatctgtacagttcttaatagtaaatggcataatatcttattctctgtattctatacattgtcaaccccattcctagctgataatcagtagtcaaaaatgggtgaataatttgaatggtacttgtctttaattgtgattcatgtctgaatggcttgctggtaactaggagctaaatttaatgttaatccaaggtcacactctagtccacatactggaagctcagcctcttgacatgcatgcttcatgcaattatcaggctgctcccttgtaggataaagtgcggcagtctagaaagcatggcactcaaatgggaagaactgttggtgagtctgtacagaacagatgaggttgcagatatttgaaagcatttgctaatggaaactctgggtaaggcagcatcttaaataatacgtagaatcagcatgctgtctccaaaacacatttgcagcatttattagctgggtgtgagctaaaggtaagctcccattaaaagaaaaaaaaatcttcgtaatgattagcaggggcccagtataatttaaggtattctttggagtttataaatatggcctcataaaaagcctgaatataagagaactgtgactttaagtcattagaagcccagtggtttgataaaataacaggaaacagacaatttattatgagcagtctcagtagctctggattatctataaaacttttacggccttccccaagtggcaagaagccataaaacttgcctgaatgagggacttgttaatttacttgttaaagcaaattaaaaatttataagtgcttttaggtaaatgagatcttctctcattgctgcccttgcggggctgggagtcctaggaggggagagtggatatgcttagacaccactgcagaacaataaaagctattaaatttttccagtttattacagcagagccatgcagctgttgccatggctagctgtggggtaccggtggttgacagcctggagtctcactcaaagggggaaaaaataaaaagccaaggaaagggatgattttttacttttataattctccaattgttgatgttgtagaccatgtctttttatttttccttgaccttgtaaatccagaagttttaaacttttttcttttctttttttttttttgagacagagttttgctcttgttgcccaggctggagtgcaatgtcacaatctcggctcactgcaacctccgcctcttgggttcaagcaattctcctgcctcagcctcccgagtagctgggattacaagcgtgcgccatcacgcccagctaattttttatttttagtagagatggggtttctccatgttggtcaggctggtctcaaactcccaacctcaggtgatccgcccacctcgacctcccaaagtgctgggattataggcgtgagccactgtgcctggccttatactgttttttcttatccccagaagtgtttctgtttattttgtcatacattgttggtccttgaaaattcctgcccgtcatgattccttttagtcatttagtccatggacaaaggccaggtcttaggctgtttttgttaacctcaacatttcttgaaaaaaacctctttctctctcttttcctttcccatatctagccacaaaactaggagaaggaagaaagggaatctggtacatgttcttgtgtatttaactccaaaaactgttagaatcaatattttttgtggaagccaaagtttataggtaaaggcagattttcttgcactctcccttggatgaaatgtcagcgtaggttaaaattcttggatcttagcatcttccttaacttagggctgttctctacgtgttgaatttcttctgtaataataggtttctgaatggtgactttggctggtgggggtcatttttttggctttaagccctgtgactcaggggattttttttttttttggctcccttaaatacaattcacaatgagcagttttctccctgccctagtgacagtaaggtttctgggacataggaaatagcttattcttccactcagatcagaagttttgattgagctctgtggcatttttaaggcagaaaaagacacgttatgcctcaactacctaccctatttaatgttaaattaaaatgatggttatttttaaagtgtgtttacatttaaaaattcctccagaaaagtcaagttctgcaaacattttcttgtagtatttccagtcactgcacaagaaaggtacattttattagttttaagaacagaaatagtagaaagacataattggtacaagtgtttgttcttctacagtatttactcttcagtttttacatatatatccatacctctgatttgtagtttgtttggaattatgtttagaaaagcatattgttggcaagtaaagcatcacaaaattaagggtagagaacagcagtaaaaaaaaaatgacaaatatgtatttttagactgtattccagttttaggaggtatcagcttttagagattccttaacgttaaaatttgtttcagtaagtaactcttgttgtggtcgctgtcttcagtattccagaaataatgctgtatctcttattcaacttcatgaacctctttactggcttccatattaatgtcatttgcatttagagtgtgtcatcttcatttagaatctcagcaaaaattctggtttataaccatctttgcacaaattatctctgtgctttaggacacttttctgggcctggtcttgcattttttatgaatacaactttaagagtggaacttaaatatgtccccttttattggattatccccatagacctgaccacaaagtctgtggaagtagaaagctataacggttgtaccatttttttttttttaaatactttaagttctagagtacatgtgcacaacatgcaagtttgttacataggtatacctgtgtcatgttggtttgttgcacccatcacctcatcatttacattaggtatttctcctaacgctatccctcccccagccccccaccccacaataggccctggtgtgtgatgttcccctccctgtgtccatgcgttctcattggttgtaccattcttttgttcaagagtatcaagttgaatttcatgtactgaaaaagtagatagatttaaaaacatttaaatttaggtagcaaatgacattgggccaaaggtccattgctaaggagacccaggaaagaatttattacaataggaatatgaggtgtggaacccaaggacagctgtcatgaaggataggtaatcacagtaaagtagtgatgcttcatatacatttgtttttgtttttgtttttttgagacagagtctccttctatcccccaggctggagtgcagtggcatgatctcggctcactgcaacctccgcctcctgggttcaagcgattctcctgcctctgcctcccgagtagctgggactataggcgcacaccaccacacctggctaatttttgtatttttagtagagacggggtttcaccatgttggccaggctggtctcgaactcctgacgccaggtgatctgccagcctcggcctcccaaagtgctgggattacaggcgtgagccacttcgcctggcatatatttggttttaagagttcaagctagaattttagagtagatgttcactcattagtaatattgatatatgttgtataatgattgcttaattgctaattttcttatgctaattgatgtttttctataaaaccaaattcttcagctctttacatttattgaatgctatctggcttatgaattttcataagaactgccaaaaaaaaaaagaaaaaaaggggcaggtcccctccttccttctaaaaagagtggttcatgcctgtaatcccagcattttgggaggctgaggtgggcagatcacttgagatcaggagttaaagaccagcctgaacaaaacagtgaaacaccgtctttactaaaaatacaaaaattagccgggcatggtggtgcatgcttgtaatcccagctacttgggaggctgaggcacaagaattgcttgaacctgggaggcagaggttgcagtgagctgaggttgtgctactgcactccagcctgggtgacagagtgagacctatctcaaaaaacaaaaaacaaaaattaaagaaataaaaataaaaaggtagagagtatgtctataatgactttttaatgtgtcagggagtttttaataggaaaaaaaaatcattccactaaaaatatgtcctctgtctcccaactagaatttcttccccatgtcactgccagccattgctgtgacaatatagtctcttactcttttatcaaatattctccatattattgctgtaagtactggacagatatcataagtaaaatatgtccacctggttgctaagaaaaatcccacatttattttatatattttgtaatagctttacgtattcgttcaaccgtaacattttggtttaaagacttcattaagctttcattgtccaatagcaaagaagtatgaagtagataccccttactttgcagtgtttactttttttttttttttttttttgagacagagtctcgcactttcgcccaggctggagtgcagtggcgtgatctcggctcaccgcaagctctggctcccgggttcacaccattctcctgcctcagcctcccgagtagctgggactacaggcgcctgccaccacgcccagctaattttttgtatttttagtagagacggggtttcaccgtgttagccaggatattcttgatctcctgacctcgtgatctgcttgcctcagcctcccaaagagctgggattacaggtgtgagccaccacacccagcctgcagtgtttactttttatttattttttattttttggtgatttccttttaccattagctaccagctgtcaggtattttcatatagttttggcattatagtttctttggttagatcacacacacacacacacacgtacgtatatgtattgtaggtataagcactggaatttagcagagctttttaaataaatgggctagtctacatgcctttctattcttttccttctaataatcttatactaataagattatagttacaagtcagacagcaatttcatggcacctgtagattttgagtaagaaataaaactaacttcagttgattatagttttttttccatcattaatttaatccaaatttctttaagatggctaaggtaaatgaaattatattctcaattgcttgtctggtctaatatgaccaaaaaaaactgttagagactgctttaattatttgaagtgtttgaagaaatttgagagagtattgtagaatttattcttatattaatgcaattaatatattaagattcaaccacatcaaattatgtattagtcatccagaattgagagacatggttgtaaaaatatcattaaggtgtgtggtatttacttaaaatttattcctttagagataccagaataattatttatatctgtttgctaattgcttactctaaatgtttggtcagtaaatcagaaaaatattagagctatccaaaggaacaaacacactgcaatgtgttataacatgcctccattgcccataaattattaatacaatgttactctggaggggtagcataatgttttggaaataatgcacactccagaataaaaaggcctgaatgtgaattctaggcccatctcttcctttctgtttaatcccaggttaacctgagcctccacttacttaactctaaattagtaataattatatctgcctcacaggttctgagaggaacctgtagctcagtacagcaaatagtaggcactacctcaagggcagtaaatagaatattcagtcagggatccacgttctaggctcagcttaccacccaatccctgggtgtcttggtggagttgttcatctctctatattttagtttctttgtaaaggggatacattaaaatttacttttctcactttaaatatttacgtgaggattaaatcatttatgtacaattattagaaaattgtataacagtaggctgggtgcagtggctcacgcctgtaatcccagaactttgggaggctgaggtgggtagatcacgaggtcaggagttctagaccagcctggccaacatggtgaaacccctatctctactaaagatacaaaaaaaaattagccgggcatggtggcgtgcacctgtaagccaagctagttgggaggctgaggcaggagaatcgcttgaacctgggaggtggaggttgcagtgagccaagatcatgccattgcactccagcctgggcaacagagtgagactccatctcaaaaaaaaaaaataaatgaaaataaaaataaaatagtgtaagagtagacaaatgtgtacaacattattatcacaaaaatgaaagcagcttaatggtaattgatcatcctgtttttaagctactagatcagagaatgtgatgtgcccacttgtcctttactgtccttatgatagttgtctttccatgttggcacaatggtagaagctgctgtccaggctattttgggcaatttgagtcaaaaattagcagttattcaatatatacaccttttttttttttttaccagcagctcaatgagggtttctattatatatcaaggggctaatgtggcataagttgttttttcttttttttttgggaaaaatcctaactagaaaattgggtctgttcttaaattgtaaatgtgtgtacatcaaagccattgtaaggataaatttaagtctgatagtgtacatgtgtacatagtttcagtacacattggcgaaatatcctgctgattgctgattgaaaacagttgttaattctctacttcactaaattcagagtggaaaactttccttaatgaagaacagattgaggagatccaagaccttactgtgtgggaattaatggcagatgcatatactggtagttaaaatgtttcattagatgttaatgtcttgctgtgtttttaattgttcaggaattagcctctagaatattaaaaccatctgtttgttatgatgaaacagaatgcttaaatagttattaatttgtgtttcttgtctttttttgagggataatctgtaaaactttgatctgtttggagtttagggaatttggaatgtggaagtgaaaaataattttaaagcacaccagtgtcctgaatagctgaagtatgtctttttttttctccttacccactgcatatattttgtgttctttctctcttttttcttaaaggagggtgagttgactttttttattccatggtgtgatgagaatctattaaacagagctggtttaatagttgatttaaactttaagattatcttcgtgcatgtggattattttacattcaacatcaaaacagaatttagacatttagaggaatgaaggacagcttacgtttttaactctaaggatgtacttttactactatattccactagctctgcataactgttgatggctatacagactactgctggcatgggttctagtcttgactctgctgtttcatgccttgtgatctggcacagattagtctttctcagctttagtttatttgtctgtaaattgggaagtacaatttaatttatagcattttttttaatgcttagaagtaatacatgaagactgcatatttgtcttttgttttgtttttatagagatggggtcttactctgtcacccaggctggagtgcagtggccaatcatagctcactgcagcctcgaactcctgggctcgggcaatcctcgtgcctcagtctcctgagtaactgggactacaggcatatgccacaatgcctggcagtatttaaattttttttagtgattgagtcttgctatgtttcccacgctgatcttgaacttgtccctcaagtgatcttccagcttcagcgtcccaaagtgctgagattacaggcataagcacatacccggacccacatttgttttatgtagtgggcatattaattgctgtctttcttgattacatggagccagtgagatactttggatgccactgagaatatacattagcactgtagctgcaagagccagaaataaactcttcatttactggcctctcccctgtgttgatagccaaacagtggtgcatttaagttcttacccccaaaatgaaaatctcagctaatgtcatcttggctctagttaattgccaggtgtgtagagctacagtggagagaacaaatctacctgtgcatgagatcccaatttatgtctctgggggccctagtatttgtctttttgtctgtgagtttggctaagaaaaattttcagcttctcataaatttatattaatcagtaaaatcatgccaagaattagaagttttatatagttgaatctttctgcatcttggagaaattccatgtgtttagaccaaaaatgaatgatagttgggaaattcatggttctctttacgtttcctttacctcacttgcccctcaatcaaaactgaattatctcatttcctaagtctgttttgcgcaggttaaaaatgggagggtctttatacatcttctggagctgagtgaaagtcacttgctacatgaaagtgaagtttgttgtaaaccttgagtctctaattcaggttcctcagaggccaggctcataatgtgaataagtgacacaggacaatgtagggtgtggggtcgtccttgtcatggtgctccattgaccctttataactatagcattagtgcagttagtgctcttgtttccaggggcacacccccttgctaactggactatgctggcactggacgtcatatgaatgattcattcagtattaaaagaagaatcaggccaggtgtggtggtgcaagcctgtaatcccagcattttgggaggcccaggtggaaggatcatttgagcccaggaattcgagaccagccttggtaacgtggcaaaatcttgtctctcaaaaaaatgtagaaattagccgggcatggtagtatacacttgtagtcccagctactggggagactgaggtgggaggatcactttagcccaggagttcaaggctgcagtggggtgtgatcgtaccactgcactccaggctgagcaataaagtaagaccctgtcttataccatctccatagaaagcaccatcttaaaaatttacccaggatttcttttataaaggttgttgttgttatttttattattaagaaatcagtgattgttagtacacattttaaaagctttctgtcattgcaggatatgtcagaaaaaagtttttgctgtagtgatctttaacaacataagaaaaggagtggttttttttttatacttgttaggtaaaataaataggatttttaaatgcttcatattatccaaattacataaaagtggcaatctcgtcagtaagtatgtataatactaagagagctattaacttttcttggtagtggtttttgaccttttgctgaacaagtactttaaaaattttcaaatgccaggatgaagacttcttaaactaactgtaattatgcaactttttctttataatccgatacctcactatctaaaatatctgaaattacatatgatcactgtttcaagaacaaaatcagtgatagcacattttgaagactatggaatctaaaggctgattttgtatgctcactagcacacatgatacttttcatgttaccattcagcttttgagctctccttactggccaatcccagatgagaagctttttttttttttttttttttttctttgagactgagtctagctctttcgccaggctggagttcagtagcgtgatctcggttcactgcaacctccgtctcccaggttcaggcaattctcctgcctcagcctcccgagtagctgggattacaggcacgccccaccatgcccagctaatttttgtatttttagtagagatggggtttcaccttattggccaggatggtctcaatctcctgacctcgtgatccgcccatctcggcctcccaaagtgctgggattacaggcgtgagccaccatgcctggcctcacaattaagtttataacagggatatgttatgaacttaatatgcttggctattaatatttggatatgttctcaaatattctagaacataggccagatgtggtggctcatgcctgtaatcccagcactttgggaggccgaggcaggcagatcacgaggtcaggagatagagaccatcctggccaacaaggtgaaaccccgtctctactaaaaatacaaaaattcgctgggcatggtgggcgtgcctgtaatcccagctaccccggaggctgaggcaggagaatggcgtgaacccagtaggcggagcttgcagtgagctgagattatgccactgcactccagcctgggcgacagagcgagactctgtctcaaaaaaaaaaaaaaagtttaactctagtgtgtggtataccagttcagttctgtcctcatggaagtaatatggcctttcatgggatagtcactaatgataagtttagtgacatatagtttattaagatagctatggacagtgtaggggcttagtcttgatgagattttaatttttggctgcacttgaaatgaactgggatcaaaatagtggcaagttggatagagatttgctgtcagaattaatattcaagaagttctgatagcttgcaaccaaagtattttatattataacaaattctagatgctcataattattcaattaaaatggataaacagtaaatatatgggttagagaagaacaatgctttttccagaaacaaagttttaaaaacttgttaatatggcaattttaaaacatacatgaaagtaaagataacggtataatgaacccaacatcatctaacttcaacaattaagacatggctaatcttacttcctctatatccctacacttcccccttcccaataggtattgctccccctatcccctggattattttataaaataaaactcagactcaagttatctcacccattaatgttttactgtgtatctgtaaaggactctgcttttttactgtaactacaacaaaatgtaaataataattccaggccgggagctgtggctcatgcctgtaatcacagcactttgggaggctgaggtgggtggatcacttgaggtcaggagttccagaccagcctggccaacatggcaaaaaaaaaaaaaaaaaaaaaaaaaaaaaaatagccgaggatggtactcaggaggctgaggcatgaaaatcacttgaacctgcctcggcttccgaaagtgctgggattgtgagccaccatgcccggcccaaattgttccatttttggtcagtgggaaccccttcagtttggctcccaagcccctttgtcagggtcttgctaggatgacaaggtgttccagactcatcttacatatttcctttctcagaccttcagttggacacttttagttttttcgtgttagaatgggaaaaacaaaagatagaagacattttctatttgagagtggtggctattttaatgaatgacaggccatttaaaaagttattgaaacatgttttttaaaaacagaaaatcataaaaagtaagttttgtgtgtttattttttatattcatccttgaaaaccaaataatattgtctctaaattactttttaataatcaaaatcttattttaagaaagctgaaaactgtactaaagcaatcaaatattccttcaacacattattttttacattgtgtatgtgtattgtgtgtgaatttctgagcctatttgaaaacagatttatcatttagtccatggttatactcaaggaatgccaaatgcaatctgttcattctggcctttctctttaattcttgtacatcttttgtacatttctattcttgtacatctttttttctctattgtttagactttttggtcaaaaatttaaaaattttctgattggcagttggttgaaagagataatttattatctaaagatctggaatcaatagacaggaatgtctggcttactacgataaagggttatggagaccaacgttttatcatgcagataaagcctccaggtatcaggcttcagagagaataaattgtaaatgtttctcatcagacttagagagtctgctctattagtaattctgaaagggaggaggttattatggggcatgtccggtccctgtcccccatcatggcttgaatccgtccctcaggttagccttagaatgcccttgctgagaggaagagtccattcagatggtgagggggccttagaattacattttacagcataattaaacctaggaatagtatccaagttgtagatagatatgtgagttatacatcaaacactgccttttacacttccattttcttgccttcacattattaaattatgaagaaatagtatcgtaatatcctcttggcctaatcatagagagtagagttaacaattctcttgataagcagtagaacattgttaagttctgctgtctggattgagcgtgtctatagtaatgatgtcaaagtcggtcagttcgctcttgattttcttaactgcttcttatttatgtttgagactatatagttagattgatcttggcttattttcctttttaaattttattagggctgggcgcagtggctcacgccagtaatcccaacactttgggaggccgatgtggctggataatctgagatcaggagtttgagaccagcctggccaacatggtgaaaccctgtctttactaaaaatacagaaatcagccaggcgtggtggtgggcacctgtaatctcagctactcgggaggccaaggcaggagaatcgcttgaacccgggaggcagaggttgcagtgagccgagatcgcgccattggactccagcttgggcaccaagagtgaaactccatctcaaaaaataaataaataaacaaataaataaataaattattaacttagtttttctactgctatgaagtccactgaacccctttaaataatgtgcatgtttggcagctggaagcacttcagtcgtttttattttctaagctaatagcacaattttaagtcatttcctgtctaataatgcctaaagtgtttattgggatcatcattaacacaggtaaataactttccaaagtccaaacatatccaaaaatcctgtttcttactttgcattaatgaaacttgtctaattgcattagagtgactttacgatacatgaatttcaagggaatacctaactttctttctttctttttttttttttttttttttttttgagagtctcgctctgtcgccccagtcgcccaggctggagcgcagtggcgcgatctcagctcactgcaagctccgcctcccgggttcaggccattctcctgcctcagccccacctcgagtagctgggactacaggtgcccaccaccatgcccagcaattttttttttttgtatttttagtagagacggggtttcaccgtgttagccaggatggtcttgatctcctgacctcatgatccgcccgcctcggcctcccaaagtactgggattataggcatgagccaccgcgcccagccctaactttcttatttaaaatccaccatggtaagcagagttccaagatgaccctaaaagtacttgtcccttatttactcccatgttttcttatatagcacagttgactttatgaaaggaagttcttctgtaagcctgacctaatcaagtgaactattaacaggatgctgactttctggagtaagaaattaaactgatgggatctttcctttctataataaactgcttttttagaatataagttagataccataaaattcactcattgtaagggtacaagctaattaattttagtaaacttaaagagttatgcaatcatcaccatacaacattgccatcacctcagaaatttcccttgtgaccatttgcaaattggtagaatcttaaattcttgtgaaaaatcctgttagaacttggtgggctatactttaatatattattaaatttaatttgctgtgtttcttcagatttttgcagctttttaaattaggaaggtcatcctgtagtttcattttttgttttgtcaccagattttggcacaagttagctttccatattttttcatgttctggaacaaatgttgttaaatcttcttaaaaactttagactgcttaattatggttttgaaagtatcactgtagaatgtttacttctgtatttagaaatttatctgttttttattttgcttgccatctcttttatacttaaatgtgttagaggtgtatctcatatctttatgggttccccccagattatactatagtttactaactgtacaatattttaatttctaatgatgttcttctcatttttagaattctcttcctctgattttacctatacttgcctttttgtcttatttcttttttgttcatttcaatctttataattaggccatttatttctattctttcacatttaatagaaaatacattaagtccatgagttaacttctagcaaagattttacaacataagttttaaaatttatatatttataattttcattttcttaatttttaaatgttgtatgtgtgattttgtcttttacccagttgttaattgtagacagactttaaaaaaattctttaggtgatatggatattcaacataaaatactgttattactttttatcatagagaagtctgttcatataatttttacattttgaaatttattcttatattctttgttaccctggtacattttcagttggtggtaatgtcccatagatcctctaggtgtgtctctttaagttacccaatttactgtatattaactaagtcaaacttcattttttaacctctgcgtcctttttcattgttttgttttcttgttccttgattagtagaatgctaaaggctcccaccttcttttgctttcttttattatttagaatattttttactttgtatagttttgtataatggtttataacttagaagggtataaaaggtaaagactgtacctttcatcactataaaatgactttgacaggtgatttttttacctatttatttctaaccttttgtctttttccctctctctttttttaaatttaggagttctttgtaactaataaataatgggacatcaatctgttgattgatctgtatatctatccatctctctgtcttacccaacacaaaccagatttttatttttaaatgggagcttaatgtatttatattattatcagaacactttgttttacactttgctttcttgccacttttcttattttctttccctttctctattatgatttgagtcattttatatttggtaattatttggaaggcaaatatttttaacgtttaaattttactaatggttagcttcaagattatcaaattgttatttaaaacactttctctagctgttgtagatgataacaaaagaacctttgattctgtgatcccagaaaaattccttgccctgcccttgtgtccaaaatttgttaaaataattttagcttttattcacaacttggcactgtacacttaaagatacaatatagttttcttttttaaaaaatagtttttctatccaactttataattttacttattgtagttattttgtgtttgcttatttcgattcatcagcatttttcattaagttttttagtttggttcatgtacctgtcatctgaaatacgctttaaaacttaaagaataaaatagtacaaattctatccaatccatgatactttcccaatttggggacaattttatcttgaaaaataaaaatagtatttttcaagattaaatacttggctgctttgatggtagtgtagtctatgggtatattaaaattttcttgaaaaaggagaatcttttgagcttactgaaacattccccaaattttgcatagagttcatttacattcctacagaaaaactcagcagtctgaaaaaggatatgtgctactttgaggaatcaaatttgtggaaggagattccatttggacagtcttctacattgcctgcataattcgcatcattcctctcaaattccaggcatagatatattctccacataatttatccttctgtaaattttgtttgatggattaatgacacctactgggcaagtagcatctttttgaaactctccatatccaagctgaaaagaatgggatagcccagctcacaaatgccaagcagatgtgcacagaattgctataccttcatgcagtctagggtgatgggacttcgttacatgttcattagcagtgacataactgtggatcgttattttcctaattagccattaataacagttaacactgtaatgggatcacaatttcagaatttggagcatatattgttgacagtgaaatctaatgaaaaacaaactagcttcttatattttataaaagatgttaatctcattgatagaattactgccactcatgccagataccagctggctttcattttgcatattttgttctcattctggtgcccaaactattgaatatataatactctaatgggaagaagcttctcacaacagagagtgggttatagtaatttttaaataaacaaggtcctgaagtatgtaaaggctgatggtaagaaatcttactgtatcagttataggaaaagctttcttgtaatagctgccatggatgctcatacaaatcaatgcaagcagatcaatttttcttagctctttaaatgtttaagccagcatctggcctttgtgatgtttcttggttgtaggtaatagctgggaatttcaggtgaaggattacaacttctgagttagttatgctaccccaaacgatccattggatgtggctaaaatgctagtttgaaactatattcagctgggcgtggtgactcacacctgtaatcccagcactttgggaggccgaggtgggcagatcacctgaggttgggggtttgaaaccaacctgaccaacatggagaaaccccatctgtactaaaaatacaaaatcagctgggcgtggtggcacatgcctgtcatgcctgtaatcccagctactcaggaggctgaggcaggagaatcgcttgaaccggggaggcggaggttgcggtgagcagagatggcaccattgcactccagcctgggcaacaagagcaaaactccgtctcagaaaaaaaaaaaagaaagaaaatatattcatgggattggaaatgaatacttctttgcctgaaatcttgtggtttagctttagtacttactgtagtcagttcatttctttgaaatattgagctgtctgacagcttaaaatcctaagtttcctttaaacttgagcctggctttggaggagaagggggtggtgtaggggtggattttatgtaaggctctctgaagagaattcactgaagtgttttttgctggcagggcactgggaaggctagcaggctgcttcctctcagtccttcttgggttttgcccttagcctagatcaacatttagtcagataatttacgtcaggtccactgaagtctgtttttgtgccttggtaaagtcatcattttccttccgtgaagaagcatggaaaaggcccaggtgcaatgtccaggttttgttaagccagttggatattaggaaaagccttgacactctttatagtcttagttcccagctggatatgtatctctcatctaagttgggaactgagtttttattattagttttttaaatagagacggggtcttgttatgttttctgggctggtctcgaactcctgggctcaggtgatccccccgcttcagcctcccacagtgctgggattataggcatgagccactgtgctcagccataaaggtgttgatcaaatatcacctaacaagattattttctttgtgaacgtactatagtcaggtaccacatacaaatttagaacatattatgtggagagtactaatatgctgcagaatcattacttcatgtcaaatgtaaacatctaactgtgcactgagaattagttttttcatccataccttggaggtagttctacctgcccttacttaactcagaatcagtgggataagagtttgatactgcttatgaattggagggcccatgccacatgcaaactttattatcagtataactatgttataacaataggctttttgagcttgaaaaatgtgtcataatttaaaaaataaataatagaaagaaagagctcttcaaagaccataacagaggaggtaagatctgagctttaaaaaacatcttgacatcagaagcacagagaaggtaagggtgaacattccagagggaatatggtgtgaaaaaaatgcagagcaggaatggacaagaaacgttcagggaatggagacaaggcgatgttcattgtagattaaatctctcctttattatcaatataaaagtgaaaaatcgaagagaatgacaatattctgagcttttattccatagtaataacaaaagcctcatacaacttgcatctgaattaacttagaatgaggagctttagcgttgactgaggagaaaactaagtacttaagagctcaggaaggatacaaagtaaaattagcatcaattttctgggctcctttgcagaaggcttcccggagaaagggattttagaagaaagtgataaaggtgaatttctggaaaggatgatagcaaaaaagaatgccttgttttggagacttggggaaagctgactctgtgaatggtataaccaaaagtgaggtctgaactgtagtctttaaagactacaaggaatgttgattcagcctcactctattcatcttggtttcatcttcccctaggcaccatagccacttgaaatcctgcaggcaaaaatttcctacttattgcctcttctattctttgaagtttcctcctgtctagaaaaatggagcttatgtttagtttgagattttccacgttttcattcatgcacccagctctaatgtttcttattgtctccccaaaggaactctgtttcaaatgaaactgctgatcatttcccagcatgttgctttttctgtctttgctttctgcttttctcctcaatggagtatctttcactgtcctctcagccatatgagtttaatctacttttaaaatccaaggcttcagaaatcacttctctgaacctccctggctactttttggtttcattgaacatgtatttccttgtggtgttgtatttgcttatcttttactgcctttttcttgttatattggaaacattgtcaaggggctgtgacttgtaaccagtactacattgcttggtgtttctgaaaatgtgtttggtgatgatattgtagactagtactccatatatttatgacttagtcttatgtagactgatggttttcaattttatgtatttgttcatttttaatggaaaaccagagcttgttaaatgtgtggaaaccactagaacgtaaacttcatgagatgacttttgttttttttttttgtttttttttgtttttttttgtttttttttttggtgtagtaccatatcttcagcacttagttctagcccatatgtggcacttaatacattatttgttgaataagtgctgatttaatttacttaatctgtaggtcttcattggttcttttaaatatgtagtaagaaacctccaggatgttatctcaattaacaagatcattaggtgccatcccagtgtttgaaggataacatcacagcatctcatcattttttcctaggagaagaaaactttattttattttgctctgatttgtttctttttttgagacaagacagaagaaaaaaggtaagaaatcatagttggtgtaatctcactttagtttattcaacatttttggtcttttcattattgaaaaaaaattgcagtggaacagaagaaaaaatttgatggaaagactgctttctaatttatggaccttgaggtttggctttttaggtgtttatttaaggcttgcccactctgttctctacattgacatttcatggtgaatattttgcttattctaccctctgtattttttctatggcagcttgcctggcagtattcagaaactgagaagaatattaaagatcagaaccttaaattgttcactcttttttttttttttgtgagacggagtcttaacgctgtcgcccagtctggagtgcactggtgcaatctcagctcgctgcaacctccgcctcccaggttcaagcgattctcctgcctcagcctcctgagtagctgggattacaggcacatgccaccatgcccagctaatttttgcatttttagtagagacggggtttccacctcgttggtcaggctggtctcaaactcctaacctcgtgatcctcctacctctgcctccgaaagtgctgggattacaggcgtgagccaccgtgcctggctgttcactcttgacaaggatcaaaaacaggaactaagaagcagaccactaactttttccttttttctcttttcttttgcctttagctcaagccaggacagaacagctgcagggacagtgacagtgaaagtgccagtggagaatccaagggcttccaccggagcagctctcgggaaaggctcagtgatgtaagtttaagtaaaaaaaaaaaaaaaaaaaaaattaacgaaaaccactaggccacacacacaccattggttcaagtctgaattacataactttccctcatctttagaactttttgtctacccaagcattgcggttcacattatctttgtatacttatttgagcattgtagttatggtgtcattctaaaatgtcgtttgagcaaaaatgtattttgacaaatcattaggtaggaggaactatttgttaccttagaaacaacaaggccgggcacggtggctcacgcctgtaatcccagcactttgggaggctaaagcaggtggatcacctgaggttggaagtttgagaccagcctgaccagcatggagaaaccctatctctactaaaaatacaaaattagctgggcgtggcagtgcatgcctgtaatcccagctactcgggaagctgagacagaagaatctctgaacccagaaggcagaggttgtggtgagccgatattgtgccactgtactcagcctgggtgacagagcaagaccccatctcaaaataaataaataaattcccgttggatttctggaaggaaaaccttgtgagaatgcgtcatacctcttgagatatctgtttgccctctagatgtgattttcattgttctctagtctgcccaccaacagggcaggttccccctctattacttctgagaaccacctacccctctttggactctcttaccttctttactcatatgtcatatatcagcattttttttttttttttttgagatggagtctcactctgtcgccaggctggaatgcagtggcacgatctcggctcactgcaacctctgcctcccaggttcaagctattctcctgcctcatccttctgagtaggtgggactacgggtgcacgccaccatgcccagctaatttttgtgtttttagtagagacagggtttcaccgtgttggccaggattgtcttgatctctttacctcgtgatctgccttcttcggccttccaaagtgctgggattgtaggtgtgagccaccacgcccagccatatatcagcattcttaactcatctgtacctcaagagcaacacttggaaattcttttgtgaaatggatcaagtaaagagattttttttttttttttgagactgagtcttgctctgtcaccagactggagtgcagtggcctgatctcagctcactgcaaccttcgcctcccgagttcaagcgattctcctgcctcagcctcctgagtagcctggattacaggcgcgtgccaccccgcccagctaatttttgtattttcaatagagatggggtttcaccatattggccaggctggtcttgaactcctgacttcgtgatctgccacctcaacctcccaaagtgctgggattagagctgtgagccacctcgcctggcttaatttttgtatttttagtagagatggggtttctccatgttgaccaggatggtctagcattaacagaataagtgagagagtagcaccatgaaaaaaaagagatagcacttcagagtgtctgagtattaagaataaataaaggatatgtaataagaagcaaaatcttttattttctccattttatttttaaaaaacaccatactctaaagcagtgtgctgttcattatagagtgcaagatgattcattgagttccagaaagaaaatactagtactttttttcttaaaaaaagaaattaaactttactagtattcagtttaacgagcggggaataattgatgtctataatttttaaatacgtggatttaaggagtgtatactcaaaacttttttttactgagagatgtctactaacataaacggttggagaccactctagcacactgagcagttctctatgataataccacatccatctctccatcagccaaggtagacaattccgagatacaatcacatttctgcacctctcatgaaagtttgtgaggtttatgatgagatgttgtatgagatactgtattcttacaggaattaaatggaataaagtataattatttttatgttattttaatatattagttatagataataacctccccttcttctgtgatataatatcaaagttatataaataaagagtactaacagtattttactgtgtgtgtgtttctgtgtgtaagaatatgttttattgtgtgtccatgtgtctgattaattttgtgatggagctatacaaccataaaaccatgacaacttttcttatctaagttgttagcaataataattaatgtttaaatagctgtttttctgagatttttgttatacttttaatgtaagatctcattgactctagaaattattccagggttagtaggtcatatttttttcatagtgtagagaaatgaacgccatgttagtttaggggactagagctgccattggatcttttggcttgtttcctctaactcactttctgttagataaaaagaaattgacaaaagacattccatattcatgaatagaaagacagtattattaagatgtcagtactaccctaagctatttatagattcagtgcaatgtctatcataattccaacaatctttttttgcaaaaatggaaaagcagattctcaaatacatatgaaatggcataaggccttaataaccaacacagtctggaaaaagagcaaagttagaggactcacacttaccaacctcaaaactcactgcaaagctacagttaatcaaaacagtatggtgctggcctaatattagacatacagaccaatggagtagaatggagagcccagaagggagcccatacttatatgcctaaatgagttttaacaagagtgccaagacacttcaatggggaaagaattttctctttaacagatggtgttgagagaactggatttctatgtgcaaaagaatgaaattggactcctacatcgcactatgtacaaaaataaactcaaaatgaatcaatgaccaaaatataaatgtgaacaccataaaactcttagaagaaaatatacaggtaaatcttcatgaccttcaatttggcagtggcttattagatatgacaccaaaagcatgtacaatgaaagagaaaataaattggacttcatcaaaattaaaaacttctcacaccaaagagcattatcaagaaagtaaaaagacagcctacaaaatggggaaaagatttgcaaatcatataagtggtgtttactctacagaatgtgtaaagaactacaactcaataataaaaagataacctaaagcaaaaatgggcaaagaatttgagaaatatttctacaaagaagtacaaagaagaggtacttgaaaaatgctgaaaatcattaggtattagagaaatgcaaattaaaactgtaacgagattatcattttatacctagtaggatggttatgcttttaaaaagagaatgaaaaataagaagtgttggcaaggatgtggaaaagttggaatattcatacattactggtgggaatgtaaaatgacgcagccactgtagaaaacagcttggcagtcctcaaaaagctgaaacatataattaccatatgacccagcaatttcacttttaggtatataccccaaagaatggaaaacatgaacttaaacagagacttgtaagccagtgttcactgcagcattatttatggtagtcaaaaagtagaaacaacccatgtgtttctcaacaaatgaattgataaacaaaatgtgacagcttggctgataggcacacaatggaatatactcagccataaaaaagattggcattgtaatatatactacaatatggatgaactttaaaaatatgctaaataaaagcaagacaaagaaggacaaatattgtatgattccacttataagaggtatctagaataggcaaattcatagagacataaagtagaatagaacttaccaggaatttgggggatggagagtgggagggaggaaagctattgcttgttggttacagagtttctttttggggatgataacaatgttttggaaatagatagtcatgacagttgctcaatgttttgaatgtaattaatgccactgaattacacaattaaaaaatgatctgttaaaaaatgtaaaaataattagggctgtaataatgcttattctgctttcacttcattgaaaatatggaaaatagttataacttttaccagccttgtctactaattgtgtcacctgtgccatttctggtcctgtttctattggttgttttttctcttcattatgggtcatattttcctgcttctttgtatgcctggcagtttttcattggatgccagacattataaaatcctgtcagtcttatgtcaagccagtcaatgaaacacttccgattcatattgtttattatattttaaaattatgaaaaaaatttgtgggcatatagtaggcgtattgttcattaattattaaaattcacactttttgcaacattactgaaaaggaaagaaagaaaaatgacccaaaacgtggacatttactgaaatgttttgagatccctagtcacatttccctcactcatgtgcaggtctgaggttgcagagtcctgtgtcaagcactatggcaatctgaaatctgctgagatgaaagctttttttttttttttttttttttccgtgacacggagtttcgctcttgttgctcagcctggagtgcagcagcacaatcttggctcactgcagcctccacctcctgggttcaagcgattctcctgcctcagcctcctgagtagctgggattacaggcgcttgccaccacgcccagctaatttttcatatttttagtagagatgggcttcaccatgttggccaggctggtctcaaactcctgacctcaggtgatccatccaccttggccttccaaagcgctgggattacaggcgtgagccaccatgttcggccgagatgaaagcttttaacaaaccaacccacagaatggatcttttggataccaaagcaacacctacctgcacaatattttagagaataaagatgccccattttttcttgaaagagaattaacaattaatttatttttttacttttattttagttttgggggtacatgtgaaggtttgtaatataggtaaactcatgtcacagaggtttgttgtgacatgagtttcatcacccagtagtacccaatagttattatttcatcacccagaattatttcatcacccagtagtacccaatagttatcttttctactcctctccctcttaccacctttcaccctcaagcagaccctagtgtctgttgtttccctctctgtgttcataagttcttattatttagctcccacttataagtaaaaacatgcagtatttggttttctgttcctacattagtttgctgaagatagtagcctccagcactatctatgttcctgcaaaagacatgatcttgttgatttttatggcaatgtagtatttcgtggtttacatataccaaattttctttatccaatctgtcattgatgggcatttaggtgtagcccgtgtatttgctattgtgagtagtgctgcagtgaacatttgcatgcatgtgttgttatggtagaatgatttatattcttctgggtttatatccagtaatgggattgctgggtcaaatggtagttatgcttttagcttttgaggaatcatcatattgctttccagaatagttgaactaatgtacactcccaccgatagtttataattgttcccttttctctgccaccttgccagcatctgttgttttttgacattttaatattaataatagccatttgactggtgagatgatatctcattgtggtttttgatttgcatttctctgatgatcagtgatattgagctttttttgtataggcttgttggctgcatatatgtcttcttttgaaaagtatctcttcatgttctttgcccactttttaatggagttgtttggttttgtcttgtaaatttgtttagctccttatagatgctcgatattagacctttgtcagatgcatagtttgcaaatatttttctcccattctgtaggttgcctgtttactctgttgatagtttcttttgctgtgcagaagtgcttaagtttaattagatcccagttgtccattgttccctttgttgtgattgcttttgatgactttgtcatgaaatctttgccctttcctatgtgcagcatagtactgcctaggttgtcttccagggtttttatagttctgggttttacacttgtctttaatccatcttgagttggtttttgtatatggtgtaaggaaggggtccagcttcaatctttttttttttttcttttctgagatggtgtctcgctccgtcaccaggttggaatgcagtggcatgatcttggctcactgcaacctccgactccctggttcaagtgattcttctgcctcagtcccccgagtagctgggattacaggcatgtgccaccatgcccagctaattttcgtatttttagtagagacgatgttttaccatgttggccaggatggtctcaaactcctgacctcgtgatccgcccgccttggcctcccaaagtgctaggattgcaggcgtgagccaccgcgcccagcccagcttcagtcttctttaatgcctatcagagagtgaaaaggtagagtcaaagatgactactggtttttgtttttgttttttctttaaaaattccatattagttcttattatgcttattcttctttcacttcattgaacatatggaaaatagttattacagcttttactgtccttgtgtactaattttgtcacctgtgccatttctggacctgtttctattggttgttttttctcctcactatgggtcatattttcctgcttctttgtatgcctggcaattttttattgaatgccagacattataaaattttccttgttgggtactgggtatttctggtttctataaacattactcattttgggatacaattttgttatttggagatgtgtgtgtgtgtgtgtgtgtgtgtgtgtgtgtgtgtgtgtttttaatgtttgcttttgtactttcttggacaagaccagaacaacctttagtctaaagataatttttcccccattctgactgagtactttgcctaatgcctaacgtcttacaaggtttttccactgtagattgtgggaaaacaaactattccctgccttgtgtgggctttgtaagttcttcctcctccttcccagtggtggttttcctcgccttgggtattttctctcacagatgtgctgactagtcatcaggtagaaactagaggggaaccttctgcagctttcatgattctcgctttctgtgatgctgtctcctccttatcctctgccttggagttccagctgtctttgcctccccttattctcaactgtgtcttcaagactcagggattccacctgggtcacctcctacccggcaatcatgtggcatgaaaactctccaggcagtaaggtgggaaaattttaagggtcaccctacttttttctcttctctcaaatattattgtcctttactctgtcttacccaatttctaaaaactcctgtttcataccttttgtccagttttttagttgcttgaggtgggagaatacattcagtccctattagtccatcatgcccctgactcgtttttcagctaagatgaaaatttctgtcagcctttcacccattttagtgatatttttaggagctttggcagttgagacttactctcaagtgaggctaatcaaaatagtatattattctagctttgtttttttgaattggttaggccaaaagaataagaataaagaattccagtgtagctgtataatttgactcatgcgtaaagcttaaaaacaccaaatatgtggccaggcatggtggctcacgcctgcaatcccagcacttttggaggccgaggcaggcagatcacttgaggtcaggagttggagatcagcctggccaacatggtgaaaccccgtctctactaaaactacaaataaattagctggacgtggtggagcacaggtactcgggaggctgaggcaggagaatagcttgaacttgggaggcagaggttgcagtgagccgagattgtgccactgcactccagcctgggtgacagagtgagactctgtcttaaaaaaaagaagaaaaacccaaatatgctttgcttttctaaattatatattcccagaccatgttgcctggggggaataattggccacaaggactttcagattgtccacatcaaggagacatagtaacttgtttagattagtcactagggaagagttaaggggaataattgaatatatagttaataaatgtttatgatgagttattcacagggaaaatattgcttccaacttaaacagaattttgtaactgaggaaatttgtcaaaagttaggagcaaaacttacttaaaaacttttaataaacaagcctcaaattatgaaatgttaatgggcatttattataaacaggccaagatttaatagaagttctgctatttattgtgtgtgaccttaggcaaagaatgtgacctttcttccccgccaagatggagtcttgctgtgtcgcccaggctggagtggaatggagtggagtgcaatggtgcgatctcggctcactgcaacctccacctcctgggttcaagcaattctcctgcctcagcctcccaagtagctgagattacaggcatacaccaccacgcctggctaatttttgaatttttagtagagatggggttttaccatgttggccaggctgctctcgaactcctgacctcaggcaatccaccctcctcggacttccaaagtgctggattacaggcataagacactgcgcctggccttgttcgcactttcaaatcttcctacctttgcttattctttttatttatttaaaatgaattgcagtggcatgatcacagctcactgcaaccttgacctcctgggttcaaacttttcttgtgccccggcctcctgagtagctgggattatacacaagtgctaccatgcttggctaatttttgtatttttagtagaaatggggtttcgccatgttggccaggctggtctcgagctcctggcctcaggtaatccaccctcctcagccccctcccaaagccctgggattatacacatgagcctccacgcttggcctattttatttctgttcttttttctttctttgtttttcttttccttatgtcagcttcaacctcacttctaccaaacacttcccaacacactgtggaagtaaacttctttaatgctttatttaatgactatatgaatatgactcttttcacctttctctctgaaagaattttgggttgggttgttagttatgagaagacagaaaaatatttaacacctttcaagggttcagatcgttcaaggaattgaaacatctcagaaaataatgaaaatggatcaaagtcttatgagtctaatgctacacagttgtctactcttattattctggtagctatttacagttgagacattttttctgcttccttttgagataccccttctcctacttcaaatcttccctggtctttgggtttttattgatttgtctatcccacagtgccactgttcatccacccatgccagcatctgtcctattctttctttcttcctcccttccttctctccctccctccctccctctcttgaaatctttattgaggttttattccatgccaggttgtttgaccagctactgttaaggaggaaacagacttgagccactaccatgaatgagcttcccacattgttataattagattaggaaatctaatctcgacctgacaaggattcttggtgttttattcctctctttttaaaaaaatctgtgccacattttccttttccttaacagtttgcttatgcctttttccattcctgtcccatacatttatgaattctcctggatatgtcagtatttcagttgccaagaaatgtcaatcaaatttcttttattcatcaggtatagtctgggcatttgaggttgagtggagaacaagatgaaacctctgccctcatgaagtttccattctagtgggagagacaaatctattaagaaatagctacaattttttctaatagaatgttttctgacataaacaatatgaagggcgggagtttgttgctactttaactagtgtgattagataaggcctttctgtgtaggtgacattaaaactgaggcctaagtaaagaaaagaaggtagacaggtgaaggtctatgggaagaacattctgggcaacaggaacaacaagcttagaggccctatcagaagcatgttgtgttcgagggaaagaaaaatggcttgtgtggctacagtagagtgaagtagcacagtggctgaacacgtaacttctagcccatgctaaggaggctgggtgttgtattaatttcctgggctgctttaatgaatgaccacaaactgtatggctggaaacaacagaaatctattatctcacagttctggaggctagaaatttaacatcagtgtgtcttcagggctatgtaccctctgcaggctctagggaagaatcctttttttctcctggcctctggtgcctcccagtgatccttggtgttcctggcttatagatgcatcattccagtctcttctttagttttcacatggtttctacagcagccattggatttacagcccatcctaaatctgtatgaccttaattaggtacatctaaaaagaccgtatatccaaattatgtcattgtattagacttctccacagaaacagaaccacagcagaagataacagaaccagcagaacatgatttattatgagaaattggctcagttttggaggctgacaagtcccaagatctacaatcagcaagctagagacccaagagaacctatagtataactctagtctcaaggctggcaggtttgaaactcttgaagagctgatgtttttattgtgtctgaaagcacaataaagaactgatgtcccaggtcaaagccaggcaaaaggaattctctcttctctgggagagagtcagccttttgttcttttcagaccttcaactgattggataagtctcacccattttagggaggacaatccagtttactcagcatatcaatataaatgttcaactcatctaaaaacatcatcacagaaacacccagaatcatgtttgaccaaatatctgggcaccccgtggcccagtgaagttgcaacataaaattgaccaccacaatcacactctggggttcctggtagacataaacagggggacattgctcaatccatgacaggttattatcttaaaagccactggactatgttaaaaggattggagttgtagttcttactttaaaatgtttattttgcctttgatatgaggaactgtccatgaagacaagagcaagaatgaaatcagaggtagaagccagaaggctgagatgagagttggtgacaacctgacgtgggcataacagaaggttgaataattggtgttggaagtgacgtagcatttttcccacctgatgcttttatcaagttgttgctccatttttacttgatttcttccaacaactatatgcttatttctcaatcaaatatatatatatatattgtgtgtgtgtgtgtgtgtgtgtgtgtgtttggtcggctattagtaatcttatctccaaggtacgtttctttggattaagatttcaggtttttaaaacactactggaagatctgtgaatgagcttgttttgtgacctttgcaagaaatttacttgttcatgtgattcctggcatggtccttctcctttttactcccaagagagaaaagcataacatgaaggtgggtagccaggaatgttgaacacaattagcgatttggaagaatttaaaaatattcaatttaaattagccctagggtcagaacacacattctcacctaggggtggagtacacatgtgtcctgtctgtactcagggagctgtaacagtagccatggcctctctgtgtggatttataatgaatggagcacatctattttagatggataatcaattttgaaatcccttattgtaagtatgctgttaaaacagaaatgttaacttcatgagtttaatgagtagcttcgatgatagcttagtgaagagatggaaggaaaggcaagtggggggaaatgagaaaaggagaacaagtgtttaatgaatatctacttgcagacttgaatgtcagcagcaacattctccctcctggaaaatgtctttcaactgtgcatcccattatgttcctgcagcccgtggtagcatgaagattgagacaaagagagtgtttctaagaaagctctcctttacaatataatgagatggaggtgggtagtttgcagagattgctggagcagtggtcaaatatgaaaaaaaaaaatccagcagaatgaaaagaccatgttaaccaggagatggcttataatgagcccagaaattgcatatcagatagccagctggctagcatttcctcatatccctgtgttctcatgcaaactgctaaaatgttctcctactctattttctcagcctcttaatagttctcatttctacctactgcattgaaaatatgaatgaaatggcaactctaccacttgaagaaataagaatgaagcccttttcagcaaaagtatttgcctaaacatggatggatattatttcaaatgcttttgaaaccaaggaaacttctgtttctttccttaaaaaaacatcttaactttcaagtctcagtttgactcacagccttttcagtattctgtggcctcttttgctatatagtttggacagactttgcttgaagtctccaagcaaaaaaatggaagtcctcccttcttattggaaattgataggggaggcttggcacggcgcctcatgcctgtaatcccaacacttgggaagccgacacaagaggatcacttgaagccaggagtttgagaccagcctgggcaacatagtgagatgctatctctaggaaaaaaaaaatagctgggcacagtatcgcatgcctgtagtccagctactcaggaggctgaggcaggaggatcacttgagcccaggagcttgaggttgcagtgagtcatgatcttgatcattaaggaagagtcttgtgaaattgttcaatagttagggtattatcacctgtctactttcatggttctttaccttttggtgactgtctcttctttggtgactgtgtcttctaaaatgagaaagcagtaccaatccctaaatatacatctgtcaataacttacagcacatttgaaacaatattactgctgtttctaaacattccttttttttgtttttagcatgatctgttgttgcctgtgttcatataatttctgtcttggaaaattattgaagctaccaaatatttgcagctgtatttagatatagactttagattataaatatatgacagagactctttactgggccttttggatgcgagacctcagggatatatgatacgtgttgtgagcctcagctaaagtctgacttccctgtggctggtaacttctgttaccaatactttaatggtggggtcctgttggtgaccaggcgtaatatctcactgaatacaaggccgtagtcagaatcttggggttgtaggactagacaagcagaagtctctttatttaatagatgtcactcctgttaaaattctccagctatgactgaagggagttggcaagtagccaagaaaaatgtggtgaaaagggtttaagaggggaggaaatgtcaatgccatggacatttggcaaagtcgatcacaagagggtttttctacacatgtgttttctgctgatcctgaaatcaaaactgaataccatgcatcttttcccttaaaaaaaaaaaaaaaaaaaaaaaagagtacagtaggttggcacatgtgaatggctcctgatacgagactctgtatgctttctagcaaatgctgaaacaaattccagtggacctttaatgtatatggggatcttgtgtctgtgttccctcgtgtgtctgtgtttgtgtgtgcccgtgtctaggggaggggagttataaggcagggtgcttaaatgctttgttacattatgttaattcctcggcagtgcaatcaaattcatgtcgtaattaaagctgtcagttggaaggcaagccaatcgccatgaaaacacagcataacaaatgaagtgaaatgattctgcgtgtagctatacaatgcttcgccaggcatgaaattaaataagtaatttgatgttgacatcagaaattgaaatgatacccactgttccctcattcagtcagacctgcataaacaatagccagaacaaatatgcacaacaaagccctcttctccacccagctccctgagtaatgtacaatatatatgcaaaacgagcataacagagctttccgagacctgaaggatgtaattttctttggtatacgataagatgatatgtatgtgggggtagggaagtgggtttggtgggagtacttctctttctgggataaaatacatttgcaggaagggaaagaaatgaaataaacaaatcccatggtctctctgagtaattcatcctaaaatgagttcacttcccaggggcatgactccaagctggtggagacctaacttggcttttgctttcttctgctgctgcatggagggctgtgggtgctggaaacaggtgatgctgtcatatggctagtcactggtatgagaagttgtctccatgactactgtggatctccctccataccatttatgggattaagaatgcagcaggattttaaaaaactgagtgcagtgagcaggatcacacatctatggtgcttcattcccctgagcttgtgtgaaacgctgagatgaggaaagttttgctttgggagctgcatttaggaatgccttgaagcatactgttcttgtttgatgtagatatagttacagtaccatgtttcctcctcaaagagcttagcatcaagaagagtcaccatctgctgtatttttatagatgtcaaattctcctgagccatttttcttacacataatccatccattcatttatttatacattcattcaataagtccttattaaatgcatcctgtgtgcaagtcattgtgtgaagctctaagaagcaatgatgaaaaagccagctggttactgctgtctgaagtttccagagtagggggcaggacatgtaggcagaagagctagcagtgaacagagtaactgttgcatcagggcagaggtcattttgcttctgggaaagtataatacccaacccaagctcatcagggaagaagcctggctggtgcagggatgcttagctgagacctgcagacctattcagcatttgcttcaccttcatttcaagcttaatcacaaagaggaagaggatgctaaaaattaaataatttataaagagaggttttaggagaaaaaaagaaacaaaaatcagaatctcaggcaagtttaaaatacattttttgggggggcttcttttcccaaacaagtgatgccctgcattcctttcagaattaacatttttaaattccctgtgtgtcagaactatgacagcctaaactggtaattcttgtgacttaaacccttcagaaaaatggtgcttttcactgctcctcttggcccacacattctctgcattttagtctactaattacgtttacaaaatgtctcatttttgaaaagccctgtgtgtgtactaactgatgcctttagggaataaactggcaagtaggtcatacactggaaaagtcatccaaacccactgggctttttattttcaagtcaatctgggctttttcctcttgcctgcccctttgcggccacaaaactgagtagcttgagaccagggcattgaatgtcagcaagtcagggaggcaagctgatgcgtgtctgtttagtctcagtgcagggcgaaatgccatcattaattcattacccagctgcctgtcaaataaattggcaattacatccaccgcagaagcttggaattcagtaaatagcacgttagcatctctgagttgttgagagatgtaaaggggaaaattaagcaacacggtgtttgtatcagtagcagatgacaaggggcagcatacactggtgatgtgatgtggtgatgaaaagcctgcaaagggctggtaatgagctgtgtggattggaacgtgttaaaaaccattgctgattttccacttttgtctttatgctttattgcagagttcagctccttccagcttgggaacaggctacttcgtaagtctatctcaacttccacatatgtgccttgcattggcattgatttccttctataatgaatgctcattgggatatgaaaaaaaatctgagaatttctctctcagtcctaaagagcagactgatttccattctttattaggaattgttttatttttagaagacatagcctgctgggccctagggatcttaagtaagtccgaggtatatacctggttcctaacgcccaggacattaagctccttacctggccatgtaaggagatacagggaaccctgattagctcatgccaccatttctccacaattacttttttagtaagaagtgtcatgtgggggatggaattcagattatgcattgagataactgatttcttgaataacatctcttcatatacaatgagttgccttttttggtggggaggacggggaatggagatggtattttttaatgaatgttttccctcacagtctgggtagtttgcctttaggtttttctttcagcaataattaatatacttatttttgctaaaatgcaaagtttatttctgaaccttattctctgtcctttgggaaagatggcagtgaggtgacccttcagggattatcacaatattgtgataatcatgaatataaaattcattctcaaacagcagttgtcacttcattatatttatttatagtgaaattctcctttctggatttagtgacccttttcaagatacaaatgaaaaagagtgacaaataagcattatttgtacaataggataacatgtcaatgtaaaagtctgttgtgatgcttaaaggaatctgattggtgttctgagtgatgaacactgatacagtcatgcctcagtattttctgagaaaatagtgaaatcatgaaaatcaaataaagtggaaaataattactaattcactttagttgcttttaacttttctctccaatgctaattactctggttttcttctgcccacgtatttctctcgatacatttacattaaatttatggaaaccagcatcatttcattaataaatgagtattttccaagcttagcaaaagtggcattttctagatgttgacttttttttggtcttaatctgtaataggagaaaaagtataaggatgatttggacctgcttaatacagttagcacacttacccttgctcctacttattgtggctgaatattcatgctaacagaaacaagcaggatacattcagtatcctgcttcagcagtcgaaataacagacgtagccccatctggcatctcttcacaccaggctggatgtaggttgagatgctggaagtaaaatctggagactgcgatatctattctccatccaaaagctaaagcctccccctttgctttcttcagcagaaagaaggccaaagccactaccttagtccttgatcacttctgtactgaacattctagtattttttttttattgtcagtaggatcaccctgaaagaagaaagtcatttctagaaacattgagattttcattatgctttttgcagttatttttctctctagttccaagaatggttatttttattctctaataatatattcttatgatttaaagagtctttaattacatgtctattaataaaatggcttttacagaacattggatgagtataaaagttttctcttattttggtaaaattgctggtagacttactttgcttacataaaagtctgtcgtattattagcttacatggagaagatacataccagatgtgtattcagctttcaactgtgacaaaaatgccctgctaggatgtgtttccaataatgtgattgttatgttatcagagtgcaaaatccattgatattgttgcccagtcctcatgaaaagtatcttctatttcaactttctttccaatagtatcacatgtaataatttcagatactaacttccacactggtgagtttcatacttctaagtggaaatgatatgggcacaacttacattagttctttgccaacatattatttacactgtgctttgtgatttgtgctgtcataatagctttttacttaagcctgtaaagaaggctcagcttcaggtaagtgaaatggtaatttttcaagtctatccttactcctcttcagcatgtctttgaaatgtggatggagggaaatcacctgcagagtccatgagctattagcgcaattgaaccataacatgaattctggtgtaagaaagctgaaggcacttttaacaatctagaaccgttttcttgaacactgtcccaagccccaacttcacagacttcctttgtttctatttagagcttttgtcaacagaggtaagatgctgttcattgtgtttgttaataaaatagacacctgagtatatacatgtgcaggtgtgtgtgcatgcacacacacgcatacacacccttagccaaaaccagtatattttactttcagttcttttatctgtagtgatacattcaagggtttaaaggagaagcctttgtttttgatctggttgtatttgtttatatctccttggttttgtgttccaaagatgtctgcttaggtctgtcacttttccaatccgtttagaagcagaagatttgagaaatgagaacagcagctcaaatcagtatttacataagcatattgcaaagaattcttaaagtagacaaaatagagaaggattggaacaaactttctacatttttgggagcttttgaataatgtgggtgttatacacacagagagacacacatatatattcattacatactcatgcccagctcatattctaaatataaatgaaagtatagactagttggaatcgatttgctttttttttttcttttttggcaagaggactaaaacttgttagagtgtgtgtaggattttcttttttttttttgttttgaacgtcaatgcaatgaacacattttcttttcaatttaaacgttttaggctgtattttctccttaaacatgtatttgaggtttcaatttgcatagtgtataattaagaacttagaggcagaatgatcttttaagactacctgtatgaccttggtccggttattttatgtctctgagtctatttccttatcaatacctacctattagtgttgcaaatattaaatgagataagatattttaatgaacacagaatatcactctatactaccaaataataagtactgccttctgttattcacacaatcgtgtgtgatggagcaaagttggtctcatcaggtggctgtgcaatgttgtgcaaagtaggttttataatttgtacctgtaggatagtagtattttattcttattatattcttcttgtagctttctcaggagcacagcttttgtatttgatcagttatttacattttttctgtatgtgaacataaaacagggtattcatcctctgtgattctatatgaacatgacgatgttggaatgaactgttctattagctgtccacatattatggttgttctctgtaatttgtcagttaaagttacttgtgtattttcttcctcagaagcatttgaagtacttggagcttttaaagactgcttagcagcttttaggattgggctgagagggaaggtacacctgttcaatatattccacttttatgaacttgtatcacatttgctcctttctgacaagaaaaagaaaaattgatgccctagcatatatgaacacagtaactgaaatcagtagaatgaaaagaccagtgagaacatttcgtgttggccagtggtctggtatgtcatcacaggaaagatctggactcattctttatagcacttgactccatgtggagttgggagctacttttggggcaactaaccagccaggcagaacttgattcctgctgtaagggaagtacagccttacttttttccaagtgacatgttctgccttctctggataattttcagccctcttccaggtttgaatctaactgtcttagaaccacagcctcaaatagcttgtatcctgcttttgtaaactccataatttctcttaaggattctcaactaataattttcatcttcctcaattgggtcacatctagtaattgacatactttaaagttatcagggaaaacaactcacttctactcagtgattaaaactgccgcattatatagtaaaggggaattgtgtagtggtatacatcttcagacgggatttgtataattattgttttcctgtgcagttgaattacttaagttgtgtaggtagtgctggtaacaggcagtaggtgcaaaatattgacctgtagctttccatccagggttataaaggtcatagtgggaatattctttgcccctttctaagtttttgactataaacccttgaaatatctcctgttttcctttgctataattttgtataacttcttcttttttctttttgacagggtctcactgtgtcacccaggccatagtgcagtggtgtagtcacagctcactgcagcctcagcctttctgggctcgggtgatcctcccacctcagccttcccagtatctgggagtaaatgtgcatgccaccacacctgcctaatttttgtattttttgtagagatggggctctaccgtgttgccaaggctggtcttgaactcctgggctcaagctatctacccaccttggcctcccaaagtgctaagattacaggcgtgagccaccatgcctggctgtataacttctaaaactgatttggtattctgtctaaccatagttgctttttaaccattttcccatttccccagataatactcaccagtggtgcttgcggctgcaacatttatcttgatgtaactgccagaaaatatcttgcttttattattttcccattgctctagtatattgactttggaaacaaaagacgtcattctactcatagcattctattttcagtagtggtatttccatttataaaatatagtaatttttataaatgccaccatgcccagccacttttaaatatttctgacacattgtattcatttattttctgggggtgaattcttttattagaacattcaaattaataattttgtttggtttgcaagaaaactgatgccatcaaggaagatgaaaagttactacacaaatttcaacaaagatttctataatttataaatgagggctgggcacggtggctcatgcctataatccagcattttgggagactgaggcgggtggatcacttgaggtcaggagttcgagaccagcctggccaacatggtgaaaccccgtctctctaccaaaaatgccaaaattaactgggcgtggtggcatgcacctgtaatcccagctgctcgggaggctgaggcaggagaatcacttgaacctgggaggcagaggttgcagtgagacaggatggcgccattgcactccagcctgggtgacaagagcgagatctcaaaaaaaatttataaatgaggttgaaaattcattttttaatttaataatcccagtctcagatgccctttcattctttgaatttgcatatctctataatatttctctttcaaaattttctggttgtcttatatataataccttgtataagctgatctagcagtggctagataggatcagattcaggtttggattttggcaaggatgcctcatagatcatgttgtgtgcttcaattaggagccacatatttagttctttatttttattaatgttaacagccattgattagacccagtgttcgttaggagctgcaaaatggtgatattgcagttccatcattctgtaaagagaaacatctacattaactacaggtatttggttatcctgaggtacagttaacacactgtatttgaataagagggtttgagctctccagagaacctatcactatttataagatttcttaggggttttagtttcagaagtacagatacatcaacttggtgctgacggcagctccatccaaagcagaagaaactgtcttcttccccacttggcagtacttgctgtgatgctaggaaaggattttgtaattcaagtgttcattcatcacctgttaagtacttatatttaagataaataacattaagtattttaacacttccccccaaataaagaccctaatctttgtatttattagtaattaacactaggtaaattaatttttggccattatatattgacaaaaatctattataatggaaatatttttgaaaatctaaattttatctagaaatccatgaaggatatccagttattattagggcatttggactaattgataaggagttgagttggaaaactactctccagatggagatttcaattcattttaactcacaagtatgacttaaatatctactcttagttcttaagttgcataacgtgtaagcatggctctcaagtcaaagatatgtagctgaatttgaagcaaagcaaactgattggtctatgagaagtgtaagtagagcacttggaagtataaaggagggtcagttaaatgtagcaggcttaaattgtgcagagcttgatggatgtttagatagtcaacaggaaagaaagggtggaacaagtttgaggcagggggagcaacaaagacaagaatacagagaaattgcataatagtgtggattgaattgactgtatgatgtctctggagaaagacgggacttagattgtcagggaatgttggttgattacagggaatgtgggataaagccagggaggtagtcgggtgagtggggaagagatggtttgtagagaaggacgtcaagtaaaggatcaatgactacaatactcttacttggagttagtccccagaagaggagatttgaatgtaggaaaatggtgagtttggaagttagaatacgtagttagaaatttaagtgtgtatttaagtgtaacttaaaatctaggacattaccaatgcctttgaagctacctgtgtactgtgcagaaacatctgggcaaacgaaagttgttgctctcccttatggtgaaacattgtcacattttttaaatgtaaccttcaaaatactacccttaactgtgttttttcctcctagtaacaaaaccagaatctaaggtgcattctgacagactcctccacgtggcgcagataaactctctaatttcaagggccttagacagaaaatataattgtatttcccatgtctaattcttacccttttttggtcatgtttttgatctgttaacattttaattgagggaataggatcagtgagccaggagcagacacaccttgactaaatgaacagtacaagttaaactgtggtgagagacatttaaacatttgtagaatctctacaacaggatgacttttccagcacactctgtagaaattatcttctgcctacacactatgtttaacttcagcttcctcattcagtacaagggaactgagaaatttgacaaaaaataatcaggtgagaaaagatcaattggtgtttccagttgcaaccaataattttaaccctttcattttctcaacatttaaatgagggaataggctgggtatttttaaacatttgctgtctacaggaatctttgacattgctgttgcaaactctttaaggagataagcggaaaacttaggtgctactgatggatgtggggaaatagccctcagccgttatctctctgtcctcctaacccccatctctggcccctcagatttagagggaaaaaatgattttggagaacaaagatttaatgagccactaggcaagagagtggctaaaggaccttaatttctaatatttcaaaatttatgattccagctgccttacaactagatgtctgccatgtgcaaccattgcttgttgctggcctcactgcctttctttgctgtcctttgagccacaggaatgcaaggccatagtgctgcttagtgaacactgttcttcactgtcaacattgaaaggagtcctgatttcaacggagtggccgagtctgcttttgtttgaaagtaatgtattttaaaattcattatgaacaataatgcaattattcataatgaataatgttttatatttgcatcattcatttagggctagtacatagagatactgaagctgttggcttagcctgttccatagctagtagattgatcatagagatgaagcggtaaaggctttagcacagtgcattgacagtcccagagggaatggacaggtcattgccatggaattctgaaaataattttatcttcattttcatctttttttctgacattggctttaaggaaggttgtcttatccttgttggagatttccacattacagaaatttgttgcatttgttgatacaagctatgtaaaatgacccacaggcaatgtcaattccggaggtttactctgattacccacacaacccttattttgatagatttaactagcctggagttttattgactatcactcagaatctttcagatcagagaactcactcctttgcttaactacttaaaaaatatttttgctgaaattgtaaattagatgcctcccaatccattgcataagaaacttatagcttggtgaaacaccaagagtatcatttgaaaaagaggttaaaaaacacaactggggcttgttaaagaggaaaagtggtattttaactccaagtgtcacattttcctatagtcagctctagcagtaaacaagagttattggaggcttagatagtttgagacacttcacttatctcccagtacttgacttcagaagccaaacatttaaaatgtgttttgctcaggtaaaaatgtttatccatttaaaatacaatgtcattttaacaaaagcaccctggtgacaagctgtttagatatagcacagttgataaactgtcagatcctgtacacatacacttgaaaggaccagcgcagtaacacaaggattggcattataaatcactgttaacaaaccttaatttgcttagtaggctaatgaatgatctccaatttttcttcagtaattagcttcgctaacagccatgtcaaagggaccttccttatactgtatttaatctctgctctgaaatctttggtgtctagtttgcaggatgaataaaaacaaacaaaaaacatttcggtctccattggcgactccctggtaataaatccagatgtagggattgtggctgttttcaagtagaaacattgccaaaggtgatgactgtctattagggcttgtaaactgtaatataatcacagatttggaatggagtggtgaagccagataattgcagtgtttcctgtctaaatgtgctgctgtgcgtagtggcctctgattttaaggagctgttaaaaatgcagcaaggcataacagctgtggttcctagaatactcctaatatttcatatgttcatcacatctcataaaatcttgcccagaccaacaaatgactacttatctgtacagctggactgtcttagaaggaaattagagaaagtgtgaatcatgtaggttagcattacagagacccaccaagagctcatccaagcccgtgctgtgccatatttctcttactgctcctcagagttctccctttccatttttagtccccaaagagaacatttgcctcttaccatttgtgagcagatcttatcaataacttactttttcctacctttgtggaaaatagactcaactttgccaagagaacttagggttctggggcagagaaattcaggcgaagttaatatctcaacccaaaatcaaaaagagacaacaaatttagttctcttagaattttttaaaattaatttttaaaataactttgcaatagaactagctctgtgatatgaaaacctggtttttctgggaggaacattagtactaggacattctgggaagcaaaggaagctagtgaacccaaaatgttcttttaatcagatattaaacagctaagcatcatgaccaaatggaagccttaaactgcatttgtacagaggcataatagagtcacaagttgttttcgcctaattgtttctaaattgcccactttactaatttgataattacagtagacctattattttggttttacataggtccagagttacagaacctctaggtcagaagggacttcagaaatcaccttacccaatcaccaatctgagacatgactcaaaaagttatgtattattagagtaggctgacaatttggactgtgaccttgctcatcctggatcctgtccttcagttgttatagttgaaagtcacattaatttttctgccatgccacagtgttttcttgatgtcagtgactgttttcatatgtgatactgttacatcttttttatcaaaaagtctaatggattctgtcttaagaacgagcctttattgaaaaatctctgttgaagtttgtcatggtatacttagtatacttggcttattactttaacttatgtagattctgtcatgtcatatattgttgttgcttttagttccacactggtgaagatcatcaagtgctacaactgtctttgtggcagttaaatttcagtgctactagattttactcattgctcttcttgtaatgccccacgatttgatttacgctggctgagtattacaagtcctatgtatttctttccattggtgattcttatctggagctttaacagaaatcagacattgttcctctgttttggttatttatagatacatctggaaagagttttgagacaacctgtgggcatacttaacatactgtaccttttttctttgtagccatcgtgtacaactgctttaaaaaaattagctggacatggagaagtgtggaaaccattgttctgttacacaatggcaaaataattgaccattaaaatatacctgtgatagacttagttgtgatgtggatgcattcatggtaagcctctctgagttattctaatgtatgtgaacaagcagtattatgtaaaaatagaggaaaggatatgctataaaagaaatacagtttgatacagtatttatgttttaacagatatgcttgagtactttaaatagataaatgaaaaaactttctattatttgtagtaggtctatgttatacacagtagtgtcctgagaaattcttgagttgtgacatacatataaattttgaatacagaagggataagttcattttagaaattactgcaaattttgaattggtagagccatcaaatttgtaaagcttgggtcacatttacttctgtgcattgagtgtcattacattctgttttctttaattttcaaacaaagggttgtaccacgcttctctttgaagaggccttttggtttcagcacatctatgggtacgttgttaacactgtcatacctccagttaaggaatggtacacgtttagagactgctttttcaagtcaaggtgccaattatttcctgcctaagcactattttagtgaactcactttagtctaaaatcacttgttatttatctcagaatgttattaaacaaggataaaatcaatgcaaagccagcgatttatgtaaatcttataaaagtttgattttctttagatttttgtgactaacagcctctcagtcttccttggacaggggagtggttagagtttgggttccctaattctctcatcttacagcctaagctaagcctcaatggttgatactgaagttttgtgaccctcgttcaatgttcagaatctattattttagtacttttagtggggaaaaaaaattctgctttacttcttttcctgctgtgatgtgtacattgtgttatttttctactgggtgtgatttttgttatctttttcagcttcattgaccataattttacttattttaattaacatggatcttattaacagttttctctcctgtacgtttgtgtttgtgacatactcttcactacatacttgaattaagtaattttattatttttcatctttcagcagtatgcttattcttggttcatttactgttttgaagcaatggaattacttacatatttttatttttccttttctctcatcttctgttttccaacctctacctccatttggtcctataacatgataaaagtgcaaacatgagcctgaataataaaggattgcttcactgattgctaaacatatattatagtgctttaaaactcatttcaggtcatcgtggtggcaattagtttgattacaagcatttaagctgtcacatagaaagccttccacttcctagggcttagtttcaaatcatgaaaactgaatgctctatacttatctatgtacacagctcaattttattattttggaagaaagctatgcctgttacaaagatcactcataatttcagaacctggttaaagccagtgtgcaattttggagcagagacacaattttattaaaaaatttaaaatatgcatgtgtacatatatgtaggtagggactatcaaaagagatgtcaaaaccatctatttattctcatttttggatacagtacacattaccaagttgttacaatgtggttatttaaatatcatttgggccaggcacagtggtgcatgcttatagtcccagctgcttgggaggctgagttgggaagatcatttgagcccaggagatcagtgttggagtgtgctataatcatgcctgtaaacagccactgtactcccatctaggcaatatctcttaaaaaaaaaaaaagtaaaatcatgactctcatacattatacaatctacatgtttaaacattttatttaataatgacggaagtaggcagatgttataactttttcaaaggtaaaccaaaagaaaatccacagttatagatgaggaatattgaaatgagtgtgtagatggaggcagaactggcttcaaggaagtcagctgagtctctacctcacatgacagagtttacatgatgttagagaatgtttattttgcattgttatcacttacctacaacttccagacttgtaaaatagtttccatggaatcagaaattaattatgctggagagtgtgctatagacgatgcctagtgtttccttgaagcacatgttttcctatttgatgaaaaatagtcttaaaggaaggtttgtttatttaaatttggcctgatcatttacacgggtgtaccaagaatgttaatttagcatataagccttttaaactttgctttctctgatgtttttacaaaataaatctcctattgcacttttaaaagtattatttgctgtcctaagggtggaaagccaaacccaagaatcacggaaaggatcactgaaaggagtgatcaagcatgatcactgaatggcactctagaagtcttcactcagcccactggtctttctgtcaccggcagtacctgtaaatttgggtgaatttctttcttcttgatgttcccaaaatatcccaaagtaccctaccaagaagtgatctctctttccatctatgtggctggattctgtaaaccagctaccaggctagtttttctgggaggattggtactttatagagataaagtcacctttaattccctgtaagtgtttaatcatatctgattaaatgagcattactcacaaataggacattccagacaagatcttcaagatttttcatactcatcttggtaaataggaaggccaatttttactgaacccatgtaaataactgtgttgctatgaaaagtaagaagacttagagtttttggattctggggtgtcagaataagattccattttaaaacacttcatttcagtttataaaatcagaattgttatgagttataaatagcttaagaaaaaagagagcttccttatattctcagataatagaacactgacataagaccaacaatactcaaaacaatcatccttcatcatttcattgagtcctgtttaattaattcttgctgtactgaatcttgacttattaatctcatcaactcatctcatgaatttcttgactgaaagaagttctggaaatcttgactcagcccactggtctggtcaaagttatttaagcaatgacatcagaaacctgtacccaagagtctattctttgaagtcttaattattttaagtacctggtgcagttttttttttttattgtgggtgctctgaggttgtctttcttatttgaaaaccagaactctgttctactgtgttactgaatgcataactttcaaggaaacataaaagtaaaacaaaaaacggtgtaagtgacagactttacatggctgtggttaattttcacttacaacttttaaaagtgaaaaatatgatgagaatttataacaaaaataatgtaacgtatttgattatttctgtggcatgtaaaacaaagctagtaaagaatgttttacacaaaactatttaagcaaatgagctcatagaaactatgaagattttaacatatttcattacttttcagactcaggtattacaaagcaaggtaaataaaattcactttccatgttctgttctcattatgttctttcatattttggaacaaaataatactttacttcaagactattcatagggtgttccatgaggtcagaactacttccatagtatttctaagatgttattaccatgcagtatgctcattattgctagtttgaaatgaatcagcaagtcagcattttaaatttttttaagttccaatttttaatgttgtaaatatcaatagttaaaacccacacacactctcatagacacaaaataagctcattgaggtcctcaataagttttaggagataactgtaagcggtttggagaccaaaaatcttcagaaacattgcattaggacacaggtgttcttttccttgaaaaatggcagcatacacataattatatttcttagaaactgttgcttctagatatgatgtcaacttcttgcattagttttaatttttaaccaaattaactaacttctatttcacataaaaaaactgggggatagttacgatcttccttttccatatcagcattttagaggagatcatgaataaacataaccaactttctatagccacacacatctcttatgcaccttcataaattgacaacaatgaacacattcattaacttgacccaaagatagtcttctctgtagattataaaaataaaaagcaaaacgatgaaattttaaattatgattagtgctcagtgttttagtattctatcttaattagaaatggtgtaactatccaatgaatatctgttaattaatttaatatcagtctgaggtttcaaattacttaaaaatcttggaaattatgctcaagccaacatagtaagaagcataattactattgaagaaaagtttttgagaatattgatgcagtttggtcaaagaaaaataaagacaaacataaacataaaatagaaataatgctagcttatttggccaggaaaccagtatatttttaggtaaattatctagtgtagagttaaaatgtttactcatgtacttaaaactgataaagaagacttactgtttttattaagccaagatttattaaactaatcttatttggcaaagttacacgtaaattaagtgaacttgagttcataaaatgtttccgaggtaatgtatgcaagaatttattgtttaatttagtacatttaaatggttagagattcaattcttttctgtgaattttaggaatatttagtatatgtaagcacttacactgaataaggctattagaacaaaactcctttagtcttagagactttataatctcattattaataccatctgaggtaggaaaatattgtgcacacaatgaaaggtaaaggtacttttgaattgtagaccctcagatgtgtagaaagcatacagttccaattctagaatttcagccataggtcaagagtaaatacagaaacacaaaaagtttcactagtccaaattgcaaagagctattcctcttcccagtagacatgctgttcttaattatttgagctcaaaacagacacatagaccatcagaaaatactaacagactagaacttttttttctcaagtgttttaagtgatagaaatctaagcttactgtgtggcacatttcttaaagaagcttttctgtgtttaactgtacattttgtagttagcattttcattctcattgataaattcaacagacagcaggccagtcagcctgttttaggttctgtggatatagcagcagtaaataagacaaagtttctcttttcatgacactcatagttaatcaaattaatccctaatatgccaggtgataataggaatctaaagaaaaatattcatgaaaagagttgggctttcagtaaagaataacagggactgaatttattgttctattagaaacaaccaaaacaaaagataaaatacatgacacaatggtttgcatgacactggacataaggcagtaaggacagtgatccctgaaagaaagtaaacaaatgtagtcatctctttgagtgtcccagcttcctgccttgagagaattccaggcctccatgcagggcagagggaattcagaagtaccaagtggaactcagtagactttctgcattaggagaagatactgagagtccaggaagaacaaggtagcaaaaattcaaaggacagagtattaggggggaggggtgatgcacggagaaaggatcccagagatcttcagaggattgctttccgttattcattagagagttaattagctcatgcatttcaacaaacttcctgatgcctgggaaagaaccatccagaaggattagaggcaacagtgccttacattaacccatagccaggaacagtgctgattctcaccagcaggattggaaaaaccactagactcatggggcatagagtcaagtacatagtagggtcttgtctcagtattgagaaataatcagtcattgactgagcagtgctacagtttgccgtgacactttttattttttatctttttgagacagtttcattcttgttgcccaagctggagtgcaatggtactattgtggcccactgcaacctctgcctcctgggttcaagcgattctcctgcctcagcctcctgagtagctgagagctaatttttgtcatttttttagttgagatggggtttcaccatgttggcccggctggtcttgaactcctgacctcagatgatctacccaccttggcttcccaaagagctgggattacaggtgtgagccaccacaccctgccctcccagcacgtttaaaatgtgagttctgatagggtcaaactatttcaagtgacttaactgaattctaaaaccattttatggcattcaattacgaattaccagacattcaaggaaccaggagaataagacccataatgaagaggaaatcagtcaatcagaactgaatcagatgttagaattaacagagaatgatattttaaaaattatagtggtattccgtatgttcagacagttaagtagtataagagcaaaattgaacttctaatgtaaatactacaaggtatgaaataaaaaatatattatatgggattaacagcagattagacattgcaggagaaaagattagttaacttgaattcatagcaacagaaactagccaaaatgaaacatgaaaagattagagaatttgcagattgaacagagcatccgtgagctgtgtgaaaacttcatacagtctaatgcatgtaaattggagtctccagagagaggagggtgagaggacaaaagtaatttccaaatttgatgaaaatagtgcagaacatcagaaacataaagaaaattacaccaacacatattataatcagatttctcaaaaccaataagaaagggaaaatcttataaatagccaggaaatagtaaaaagacataaatgcagaggaacaaagactgacagcagatttttttttttctggaaaaaaaaaatgcactggagcaacatccttaaaagtactagaagaaaaaattgccaacctagaattgtatacccagtgaatataactttcaaaagacatggataagagaatgagatgataatccacaggctaggagaacagttttgcaaagtttgtatctgataaaggacttttatgcacaatatataaagagatcttaatattcagcattaagaaatcaaaaagcctagttgaaaaacgagcaaaagatttgaactgatgtgtcactaaaggcaatatacaaatggcaaataagcacatgaaaagatgctttacatctttaattattacataaaagcaaattaaaaccataataggtatatagtaatatattattacacacctattaaaatggctaaaatgaaaatgactgactacagcaagtgttggtgaggatattgaggaattgcaactcttttacacactagtgggaatataaaatgtacaaccataaactctagtttctctttagatcatgtaaatctttcccctttttaaagatacaaccaattgagagaacagtttgataatttattaaaatgttatatatgtatgtacaatatattctagccattccaatcctgggtttttacccaagagaaaagaaagcacatgtccatacaaatattttacatgaatgttcatagtagctttatttgtaatagccccaaattggaaattggccatatgttcattatcaacttaatgaatgaaaatttggtatattcatacaacagaatactacttagcattaaaaaggaacaatgtattgatacatgcaacaacatggattcatctcaaaataattatcctgagtaaaaaaagaagccacacaaaaaaggtacatattgtatggttccaatttatataaaatgctagaaaaagctgtttaatctacagtgacataaagtagatcagtggttgcttggagaggcaggcacagaattgggagggaggcattaccaaggggcaggagtaaacttttgtaggtgatgggtatgttcattatcatgactgtcaggatggctccacagatatatttataggtcaaaatttatcaaattttatcctttaaatatgtgcagtttattatatttcatttatacttcagtaaagctgttttaaaatgattataaaaactatttccctgctgttgttaacaccctgagatgtctgcctcttttcctatctttctgtgttttaaatacaccagcctactgcactttaatacctctctagctcagacagctacacacaaaacttactctgaagaatgtcaaaatgcatgttttcatcagagaaatatctcatggtcctttgttaaatgttcaaaaattcatgattgggctttataaggcaaatatgtcctgttttatagaattacgggagagaaaatgcatacaaaagagcccaatcctttttttggctggcttttatgtcagagctcaaaattgctctctgataaaatgtaggccaccagattgaattacttcattgaaccactgctgtcctctgttaatggtaattgcacagatatagcagtctttctcggcaacatctcagatatttacctcccactgtttttcaattcaaacctttgatgaaaatattcccagtacttctttaaagcagacatccaactgtctttcttgacaaaagcaaggtctctaaatcagatcctgacaatttgtgacacagcagtctatccaaatcaccttttacctatgtcactatgtcatttcctgaagaaaaaagtgtccatcagacaagcaatttctgtaggttttgggggctggaaggttggtatgccagcaaaaatgagagaggaaaagggaaaaataattttttcctttgacttgtgtggaaggaattcagtgaggggttgaccagatctaataagcaaaagaggggttttgtatatttaaaagatacatttttataaagagagatctatagatatttgttattttcaagatggtaacaattgaaacttgaatctagtgatttctgaaagctgctccctttaaggagacagggaaacaaggttagtttttttttaattcttaactttttctgttagactactttaatatgacaatatttagcagtttattttctcgtcagggattcagctcagtttctggtctacctcctgtcctgaactgagcagactacatttcctcacatgaaggttgtaggttgtacaaacaatgccactggcatgaaccatgatcagcgctctccacttgactcatggtgactttggaggctggagtgcagcacatggtaaccaggagatcagctggatcagcctcagagtgaaactcgctgctattatctctttggctatggttggttgggtgctttttttttcccttttagtattggaaggatataattgatacttgctttcttggatcaaattgtagcatcatatgtttgactgatgggttagttgtaggagctgtcagagcccccctgggacctgctttacaggtttggtgaatgagcagctgacagcacagcaagcacactttctgctgccagcctggttttgttcttcccaggtggatgtttcattataggaatgggcctcaaaataacatttgcccaggaatatttctagagagtggtcatctttggtggcactgttatggtggtatgttgctcatttagagtggtctcattcaagcaagacccatacatcatttggggagaacagtgaggaaaaccgtgggctgagctctggggagggttcgatctgggaataaggcatgtcctagaatctcagtcaggattctactttcaagagacagtgcaaggctcctaggaagttggggccaggaggtaattaaagaggtagaaagagaaaatcttttaaaatcaagtttctgactgcatgggctcttgaatgtggtctttactttgattgtggcctcaacatacaggtggtagcagagtccttgaagggcccttgacttttttttttttttcagagatcagggaatttgtaatttagaaggagaaaactggcactcttgtgccagtaaagcctctgctgatagctgtgtgccgtttgtttttaatcctttctcggtatccgtctctggccatccttatctttactagaaatcaaaggctgtgaagggaccaccagaaaaataaataattcatagcttttcaaagcctgagccccaaatactcaactttcaaagcatgagccccaaatatcccttcccttgggcttgaatttgctaaactggagcctgtgtttactctactagggtaaccaagtattcaagagctcagagaaaaaaggactggccactatacctctttggaggtaagagaggagcccgtgtgagttcatgtgtagaagaatcactttcacctggaatagaatgtcaatcccagaatctcactatctggcaggcaggaagtgataccagtttctggcttggaaaggacatctgaaggatcctgttggttttgttttgttttgttttgtttttttctcctgttggttttgtctgctgacacgtgggtagtgctgacccagtgtctgaccggattgtctccatccataacttcatctagccctgtttacaaaagaatgaacacaagtgacagcctcagtgaacctgcaccatgaggatgcccttacttctcccacactctcactttcttctcttcttggctcctcttcccctgtacttctctctgttgacatagaatatgcaaagtccaagagatgtggcaatgccagtaagagctaagttacttgcagctggcggtgccacctgtgcctatcaaatttcagccaaagcaattgctttcccagaatgccctgttttggggaattggaaagtgaatctgtaggggcggcaatggctgtatagaagagagcttttctctgggctcaaatatgaggacaaaattgtgaagtaggactgtagataatcccaaatccccacttttgcatcttcctgagctcagaggcaacccaagagatttccgagttaatcctttggactttaggtgaactctcagctagaaccatcgtttgcaagcagatctcctgtggaggtgacagttccataacctatcctggtggttgtatagttgagaatgtttgtgattccttctctctccacaagacctcaccacttccagttatgttcattttatttttgtttagtcatttttgtgcttagggaacaatttttcagctttgtactctcacctcataaaagtcctttgtatcattgtgaaaaagcaagtcaaggcctggcgtggtggctcatgcctataatcccagcactttgggaagccgaggcaggtggatcacgaggtcaggagtatgagaccagcctggccaacatagtgaaaccccatctctactaaaagtaaaaaaaaaaaaaaaaaaaaaaaaaaaaaaaaaaaattagctgggcgtggtggcaggcacctgtagtcccagctacttgggaggctgaggcaggagaatcgcttgaacctgggaggcagaggttgcagtgagccaagattgtgccatttcactccagcccgggtgacacagtgcaagactccgtcttaccaaaaaaaaaagcaagtgaaattgacattttaatttagtctgactgcatttttctataattttctaagaatttgtcactttttagtattttctcttttctgataaactgttccagcttttcatcactttttaatcagctttcatcagttttatcatactcaacctctggtatttttctttgtatgctctctttttctcctttttttgttttgttcatgagacaggtcttgctctgttgcccaggctggaatgcagtggtgtaatcttggctcattgcagcctcaaccacctgggcttaagcgatcctcctatctcagcctcccaaagtagttgggaccacaggcacatgccaccatgcctggctaattttttattgttttattatttatttatttgtttatttatttattttttctttaagagatgggggtctctccctatgttgcccagactggtgttgaactcctaggctcaagcaatcctcccaccttggcctcccaaagtgctaggaggcatgagccaccacacctggctcttttctgttgttcattctcttcacccttgtttagatcctaaagtgacccaggcacttcaggatctgaagatagctggatgatgatgagtcttcttaaaaggtagcattttatagcaaacatgatgtagagccactgaagggttttatagttgctgtcctcaggggctggatttttaaactggaatatccatggggactttgaaaattccacctgctggggctctacctcatttgagaaccactaccttaataagttcatggccttacaatgggagtgggaggagaggtgactttggagcagacaattacaatgtgagtgacagttatctctttcatgagtactgctgtacaaactgggaatgcctgatctggttcttggagagggagtggaggttaacctgatttatgtaaagttgtagtggtcatggcgggggaggaggttgcattccatgaagcaccatttggaaagacccaaagtgtggggcctggttatttggaggacctggagatgttgttggaatgcttagaaattacaggaatgaggataggaaggagccagatcccaagtggtcttgacaagtcttgttaaagagttttcatttcatagtgcaagtgatgtagagccactgaagggtttcatgttgtagaatttattagatgtgtgtgagagatagctcactcagttagttttgtggaagatggctgtgtaagcatgagattggaggcaagaacttcaggaaaaattatgatgatgactgggagagaaggtggacaattctagagatgtttagaacacaaaattgacaggacaaagtcaacgagtcaatgtggcagtgatttatagagaggcctcaaggataaccaagtatctgctttattcaaccaagtgagtgctggtacaattcactaagagaggcagtataggggagtgaataagagcacatatttgaatcctagacctgccactcgcctatgagttacattttgggtgtattcatttttaagacgtccatgggatgagcaaagaaagagatcctgtgggagtttgagtctggagctcagagaagcagcctggacctctggtgcacgtgatccatgcagtccatggatcagaactctttcaggaaaaaaaaaatgcggttattaggacaagtgttgagtatgtgtgatttttatttctttgtgatttagctggaggactatagagctgaccagaataaaggcaataaatatataaataatcatctacctatgatatactcaaggcaataaatatataaataatcatctacatatgatatgagtatatcattatctgctgtcattattattagtgaaggcatgttacatatttgtttggaccacagcatactttcaggaaactcttgataaacagctttcttttttatttattgccctgctttcttttgattgcttttgccgtagcatcaacctgcatcttattttaatcatctcctctctgaacattgatgattccgcagctttgttagaatacatcttgggagattccattttttaaaggctctttcaagggcatatggcattagatgattatgatatggcgcatttagaatatgccatgatttctctcctgctgaatccctcacacgtgtttgaagtaattattatcctctctgctagctcatgagacttgttagatcactatttgtgggtgtcataaaatgttggcaagaccccagtgtgaaacgcagtgtgaaatacatgtggttaaacttctctgattttgtatgtcaatcaaaacaaaatggcttaaaacagtagatgaatttcaaaagaaacttcaggattctagagcaaaaatgacacatggaactctttaggtctgtgttttgatatttaattcagggagtcatacacaggaggacgtatgcaatatagtagaatttagatgtgttatgattatatctgataatgttacaaatactgagcagctttttgttacatcatatttggtcccaaaatgtcatgccatgcaatgctgggggtgtttaaataccaaatttatgcatattttcaaggaagaagcagataatcttctaactatacagactgtgttacttatcagaaataatagtttatgaattgtcaaacagtgaaaattttaaaccatgtatccctgataatacttttatgtcttcattaagcatcactaatactgaatatgagtatctatctgatgaggaccttagaatcttattatagttagatataacaagattttatttattgtttttatcatggtgaagggtatataatgtcagcatgatctctcctttagttttacctcttctggtgttttgcagtcttaaatgggtgtctttaggaatatcccttatttctagttttagagctcttacttctagttttagagcttctacctaataaaggtataattagattggtcttttctgcatttattaatcaaagactattcttttacatgtgactttttagcaacatccataatttaagtgatatttgcccaaatattatctgtactcccacctttacaagaggatttaataacttaatagagtatgttatagtaatgagttggatgaccaaatatatttcaactaatagaaagaccatgatgtagctgctgaaatacctgagaaaggtagcttaccatataaagaaagacagctaggattttgatcaccttcttgctttagtgaatgatgctagatcttcctccaacgtaaatctttctgctcactttaattctagatgtgtgaattcttgacttgaggactttgatgtcagatttcacctacttgaaggcccattggaagaataacttctaactcattaaacaattccccatttagccaaagttagtctcatagatgtctgtgatggcttgttaggtggcacagtgactaaatttgatgctcagaaaagatggtcttaacaaagagttctttcttttcacacaagtgtaagctttctgacagttatcacccaaaatgcatcttgttattgttgtcttttctactcatggctgtgagtgtcagacactgtgcttccattcactaacatgaagacatttgtgaaagggccttcatcaatatctgacactggtgaattgaagaataatatactagctacataaaactgtgtttattcttcctaaaccaatcattgctttttgcagcatttccaatgaaattgtgattttttagcagattcttctttgatggagctgtgatttgcaataatcttgtcatgccaggctcaaaatactactaaatgaagacatttgtggaagggaatgattgtaaattgcatgcaaatttcaactcggctggaattaatcaatatggaaacagaacttgtgcgttcctgatataatgatgctgaaactaatcccatggagttctatttccgtgggaattaggcagttattttgctttaaatctatctctctctctcctttttttacccttgaagacaaagtcctgtttttgagttttttaaaagtaacttctttggggatttagagaggttataaaggaaacaggagtaaaatcaagcatctgacttcccctgtggggacatctgacatttcctatttaatttgctgtgcttgtttaatgaatctttcccccaatttttcttgctagtttttttttttcactgaaaattctaaggcttatgagatagtaggtgatgcaatctttattctatgttaaatatgcgacactggtctctaaatgggatgttctttcttttacaccagtttcttagggtgatcccagcttatccttgatgaaagctttttgtttttgttttttaagtcgcttttggaggaacaggtcaccaaccttgactttttaatgcctgcttacattcaaatttctcattttctttgattggcaagattaggtttatggccttttattcttacacttggcaactagatcggttaaccttagattatttgttccccaccttttcttcagctgtttaggtcacaaatttgtagaaaggtcttatcattggcatattttgtaccaccagtgcatcagtgctatactcatatatccttagaggctgacaacttacttcccagcccctttggagtactttaagaatccctttatttatagcccagcttaagccccagtgggtaacactccataaacctgcagtgacatccagtggcctcgtggtgtaattttttacaaacttttctaaaaggaattacaggggcagtatttcctgtcaaagaaaaatactgttggagttattgaagggggtttcctaaatacatttatgtacaatagttactggcatactccttgataggattactaggagaatgattattcattttttggtttttgagtgaaggattaacggcctctgatgaaatcagctttattccaagatcagataaaaaatataaaattgaggacaatatttttaagaggacaatttttaattaaaaaaaatcaacagtgtagaatttcctattctggatagatttaagaaataaaggagaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaaaaaaaaaaaaaagaagtaaaggagaacctttagtttgtgcaactgatcatgaagtttaaaattctatgttgttccccttcttggttcttgtgcagtcaatgtctttgagagtcttcttccactgtgttaactctttaattttctcaaaccacctaagactgctactataaatcagagccaagagattcccaatctgattactgtctttaattgtattattaaacgaaaacatatttttataaaaatgatgccccattattataaaatatttacgtggtagaaaaatgtacgaagaaaatgtgagcacatcagtgcaaatcttacccttttcacagaaataaccagcgttaacatttggtaaacctctttgaaaatgctctctatatgctcttttatattctttccatgcatatatattgatagaacgataaataaattggaagctaagaaataatttcatgatactgaattgaacgacttataacggctgtgtttatttggtttgtaattaccgcaaaatgttatactaggtggggagaggaccaggaagaggtttgctttttttaaaagagatgactttgcctttcttgtgacagggagggctggctaggcaggatcaggtttgggagagggtcaatagagaggagtggtgtgcagccacctcatggctgccagctatgaggtttggtttagataagttaactgaggctggaatgggacagcatagttcatatgtttaaacacccaggacgagatgttcccagagctcagagagttcatacgagtaagtctagcatgtagaaactaagccagtagaatgttccaaactgatgctaggcacattcataccaaagatgagtgttaggttgtggtggtggggggggggggggcagagggggagggagaaggagagggagagatctttagatatctttagcaattgatactgaaccagaaatttgaaatttagatttcgctctgtcatgcccattccccagacacttctcagatacaatgcaaaagccatatgctactgggagagaggcaagaaacctgtttgccattctagtcctaacaaagattagctgctgtgggggaaggactatgaatctccccctgctttgcaaagaaatggggcaaacgtcgtttgcagttgagagagatcattttgcccatgattctgcactaatgcactgatcctctacctctggtagaggaacaggaaactttctcatgcccaagatattccaccaatacaaggcaaaacttggcttccccgtgggagggatgtggggaagaaaactgattgtatttcataccctgaactgagtaggaagcagagattacatgtcattggggtggaggaagaaatgctaagaaagtcatgtacttgagtcccagatgtgcagggctaggctaagactgtgcttggagcaggagaactgagaaattctccttcccccctccaagagccttcaaccataacaaagaaacagtaacaggcttgcagtctactgctagaggagtggcaagagcatgggaagaaacgcagacaccctgcaatgcttatgtgcaggtcctacttaggtcctactgtaagtttagggtggatcctgaacactgagaaaacctttttgacagcaaaaaataaaataaactttcatttctatatagatttagattacaaagttatgcaggtagaattctcgtataaaatcaatctagttttccctgttgttacatcttacacttgtaagatgtagttgttataagtagatgtaattgttataagatgtaattgttataagtagtaaaccaatattgctacattattattaaatgaagtacatactttattcaaattttcttagtttatactttactgatctttttctgttgtagtatcctatctaaagtaggatactatgttgtatgtttagtcattatatctcctcaggtgcctgtaagactgtgacagtttctcagatagtttttctttttgatgatagttttaaggagtactggtcaggtattttagagaatgttcttcgattggttggattaaaaaatttttttgatgtttttctcatgattagaccctcagttggcctctgttttgaatcttctagactcacaaaagactatgtcacagcagtctatcagaggaggaatttttatcctgtggtgcatcaacactagttatagcaacagtaaaatacagacacaattcaactactgagtagatttattcagtccccccatgctaacagcttgaaagaagtagttacccatttccaggtagaaatattatttacctgagtttcttttatacataaagtttgggttcaattaaaaaaattatgacatagacacactcacgtaagataaaaaaaaaaggtgactgttcaagatgtaaaatagtcaacaaaatctgacatgcaaacttcagacagggaccttgaaataactatgattactgtattaaaaggtttaatggaaaaggtggacaatatacataaatcgtgatgtggaattttagtagagtgatggaatctgtaagagtcagaaaaaaatgctagaaatgaaaaacacaatatcatatatgaaaaaattttctgtgggtttatcaacagacttgatacgatagaggaaagaataagtgaccttgaggataggctaataaagcctttcaactgaaatagagcaaaaagagtggaaataaaaaatggagcattgccatagaaaatttcctgaccgcctaacatacttcaagagagagaaaataggctagaagaaacgctagaagagataatggctgagaattttccaaaatgaaagatagccaaccacagactcagaataaatatgaagaaaagcatacctacgtacactgaagtcagactgctgaaaatcaaagataaagaagtcttgaagacagagaaaaaaataaatattcatgcagaggtataatagataaaagctcagtacattttatgtcagaaattatgttagtgaaaagagttggagtgacatctttaaaaaactgaaagaacaaataccctcaacctagaattctgtatccaggaaaaatatattgcaaaacggaaagtaaattaagtcttcgtcagatgaagcaagagaagttttgctagcagaacaggtctatctgaagagcttacaggaagctcttcagacagtaggaaaactcttcagatagcaggagtacgctgctctatagaaagaacattttgttctacacaaaggaatgatggacaccagaaatataaaaatatgaataaacagacaagacattttttcttctaatcttttgaaatgagattagagtatgggttgacaatgagcctggtatggtttgactctgtgtctccacccaaatctcatttcaaattgtaatccccacgtgttggaggaagggcctggtgggaggtgattggatcatgggggcagttccccactgctgttctcatgatagcgagtgagttctcatgagatctggtggtttaaaagtgtgtgacaattcctgcttgcttgctctctcctgctcccctatggtaagacgtgcttgtttccccttcaccttctgccatgattataagtttcctgaggcctctcagtcataatttctgttaaggctgtggaaccatgagtcgattaaacctcttttctttgtaaattacccagtctcaggtagttttttatagcagtgtgagaatggaccaatatgagtcaaatctaacatcaggcttgttttgtgcagcccatgagcaaataatttattttaagggttgtaaaaaatttttttaaatatagaataattaatgcatatgcaacaaagagcatatatggcttgcaaagtctaaattatttactatctggtgctggtttaaagcaaaaataataattctatattatggggtttataacatgttaaaataaaattttggcaataataccttaaaggatgggagggaggaaatggaaatatactgttgtaaggtttaaatggaaatatactgttgtaaggtttctgtacaatacatgaaatagtataataacatttcaaagtagactatgataagttaagaacgtatattgtgaattttagagcagccattggggaaaaagataaagtacaagatataattaacaagccaataaaatgaaatcataaaaatgctcagctaatacaaaagaaggcaaaaaaattaagaaaaaaagggaacaaaagaacagatgactttttttaaagtataatagtacatagataccatatcatccttagcaataattacactaaatataattggtcagttaaaaagcagagattataaaattggatagaaagtaaaacccaattttgtgctgcctgcaaaaaacccattttaaatacagagccatgactattttaaagcaaagaggatggaaaacagtatgtcatgcaaaccctaatcaaaagaaaactggagtggtctgggcttatgcttataatctgagcactttagaagtcggctggatcacttgagttcaggtgtttgagaccagcctggccaacatggtgaaaccctgtctctgctgaaagtataaaaattagccaggtgtggtggctcatgcctgtaatcccagctactctggaggctgaggcaggggaatcacttgaacctgggaggtagaggttgcagtgagccatgattgcaccactgcactccagcctggatgacagagggagactctcaacaaaaacaaacaaacaaaacaaaacaaaaacagaagtggttttgttaatatcaatacagtagacttcacaatattaccaagtataaagcatggtatcacacacaatatagtgataaagggatcagtccatcaagaaaacaagaattcatcaagaaaaaggcctatgtacacaataacagagcttcagaatacataaagcaaaaactaatagaattataggaagaatagacaaatctactaataaagtttgagatttcattgctcatccctcacattgatagaacaagttaacacagattaggaaggacaccaaaaacttgagcaacactaccggtcaccttgactcaatcaacatttatagaatgtgcccttcaacagcaaaatacagttttttgtccaaatgcacatgccatactcattgtagacatattttgagctattaagtaaatttcaataagtgtaaaagcattgaaatgatgcaaattatgttcactgaccacaacagacttaaactagaactcagtaacagaaggatacccggaatgtcctcaaatttttggaaattcgataacatacttttaaataacccatatcaaagagtaagtctcaaatctaatttgatttttacagtttacatgcctcttttttctaggcatttaaaaaatatacagaagtacagtctagactgcacatgtgtatataattgatgacagtgacattctctcggaatttatattaatgtagtgcacaatatatttgaagtacatttggcataaggacgtactaagtcacaagacttgtttggggaatgtgatttctttggataaaattaaattccttgaacttgacaactaatcaggctgaaaaaatacacttgaagctttctgatacattattaaggaagttacagaatatccatgaatttagttagctttacactccagtggtactcctgagtattttgtaattgaactcgttgatcttcagatgtgaattggttcttcagatctgtgaccatcagtctgtctacaaacatttatgcaggctctctgagcaagatgcctttcctcacggtggtttctaaactctcccaatattttcagctgcctgggtaggaagcattagggcagacgcccaggctggaatgcagtggcgtgatcttggctcactgcaatctctgcctcccaggttcaagagattctcctgcctcagcctcccgagtagctgggactacaggcgctgccaccacacctggctaatttttgtatttttagtagagacagggtttcaccatgttgactgggttggtcttgtactcctgaacctgaggtgacctgcccgccttggcttccctaagtgctggaattacaggtgtgagccagtgcacctggcctgctctgcttttaaagaagcagaatttgtctagatgtttttgaagaacattatgtaataaaatagcagtaagagtatgaattctcgatatgtattgaaaattagagtctttaaaagtcttggtgtttagaaattaatattagttttaatatgactctttaataatgaagaatataaagttctctgtgtgctggtgagaggactttttatttttactcctggaaatacatgatttgtaccagtcacttgtgtggccataatatttttgccctaaatattaggtcatcatttcctctttattgttaggtaacccagaatgctaggtattctctaacagaagaaaaaaaaattggtttgcagtcctggtaagctgttggagattttaataatcccaataaaatatttccatttttcaaatgtgtttagatgtccttggcagatttagattagttacatgagatggatagaaaacaggctcagggcttagggtttattttgatgatttttaaaatttgttgaaataagagttgttttatttaaggaaaaaataatatttctggattaagtatttcaaatgcgttatttttggagagatgctacagagcttatgtcaaatgattattaatatatatatattttttttgagacggcatctcactgtgtcacccaggctgaagtgcagtgtcgcgatcttggctcactgcaagctctgcttcctgagttcacgccattctcttgcctcagcctcccgagtagctgcggctacagacacgtgtcaccacacctagctaatttttttgtatttttagtagagacggggtttcactgtgttagccaggacgcttttgatctcccgacctcatgatctgcctgcgtctacctcccaaagtgctgggattacaggcatgagccaccgcatacggcctattaattcttaaaaacaattgtgaccatgatattagcacctaaagcactattccttttcttagccttgggaagacttcatggtcatgaatactattaatttgattttttaaaattatgagtgccatatggctgtagaatgcagaggtttcatgaaatatattcagtgagaaccagaagtgatttactaatgcctcaaactcatttaaatatctaccaattcaacatataaaattgtcttcacgagaaacattacggggtatgattttgtatttgatcataatgcttgctaattatttcctgttagtattactggtaaaatgggggttggcaaattctagatagtgatgccacatatgtgtggtgtgggttccttacaaaactttatttgctgcttaattttgtaacattgcatcattccctaaatagcctcaagatccaaatacaattgcagtaatacttgctgaaaattggaaactattaaaaacattcatttgctgggaatcaggagaggggagggaatttcaaataatagaggtttttttttattaaaaaaaaaaactcacaaaatctttgatccactgtctctcaaaaggcaatttgatagctaaatgcaagtattttttttttttttttttgagacagggtcttacttcttcgcccaggctggagtgcagtggcatgatctcagctcactgcaatctctacctcctgggctcaagcgatcctcccacctcagcctcccaagtagctgggtctacaggcatataccaccgctaatttttgtatttttgtagtgttggggcttcaccgtgttgtcaaggctggtcttgaactcctgagctcaagcaatccgcctgccttggccttcctggtgggattacagggattacagccactgcgcctagcctaaatatattaataagttttaaagttttatattatttccatttctattttggtagtaaaggtaaatgaacaagcattatagatcacagacatttaggttaaaaggtccaagctctttgagatgggatatactagggacacgttatcttttttttttttttttttgagatgaagtcttgctcttgtcccccaggctggagtgcggtggtgcgatctcagctcactgcaacctcactgcaacctccacctcccgggttcaagcgattctcctacctcaccttgccgagtagctgagattacaggtgcctgccaccacgcgtggctaatttttgtatttttagtagagacagggtttcaccattttggccaggctggtcttgaactcctgacctcgtgatccaccttcctcggcctcctagagtgctgggattacaggtgtgagccaccgcccccggccggggcacattgcctttataactctatttaattcccttgcttgcacgttgaatagatctaaatgactgggggaaaagtaaaaacatagtctttagtccctttcattgtggtaaattcactgaatgatagacggaaatttcagccttcttgggtctactgccaggttctgtagttatttgtatgtctcatggagaaatcctcattgattacactgtatggctaaactgacttaaaacagataactgagcctatttcaaaattgaaaattctttaaaatggaaagttagtactctattgttcccaaactgttggattgcatgccattttcccaaactcacagacgttgataagatttcaggcaaggggaacaaggaaggggtcacagtggaagcgaattcttcccctttttctgactgtgtttgcccacctgtcctttacccttcgcagttctattctgagaggtatgtgaggaagatgggagccactgctgctagattgttgccattaaccagctttcatggcttttgtgggagcctccttttcattagtatttgcaacatgttcaccagcaaaatgattatgttaggcagagacatcacatcacttacatttcatagctcagtgcaattttcataaactgcgaggcaacatccaaaaaaaacatgactcagaattagagtttcagaagattattatatagacattatttccctcaggtcacgggctttagtcaaatttggaggagaatgaaattgccaacagtgaaaagcagacagaaaggtatgagttcatgagcagagaaataacattttcatttgttccttccccatgggaaagattcagcattccggtaaatggagacggttataagaaatgaatttttgtcagcagggatgtgattttaaggctcacttatccattggcaatctagatttctaaccccaggaatctgggaaattgctacagaatgtagtctttattataaacaagtttttttttttgggggggggtagtttttccctccttcttttcttggtcagagctttttaagacgaaggactacatttctttctgcatttctggggtcagatgattgcagatttcccatctgccctgagtttctctccattgctgttgctttgtgatggaaaccctttctttcctcctcaccaagcttccctcactctgtcgttgcttttcctaacccccctgtgtttatccagcacgacactgacaatattgaaagctgcaaacttcctatatggccatggagtggtggatctatggcctgatctctctgttccccagcatttacaggatgtcttgtgctgctgctgattctatatcctcagttcttttgtgtctgtggacctgaaagagcaaggcaggaaatacagctttccaggtagctctcattttaccaggtataaagagcgaggatttgcaaggtttctgtaaggtaatcccagacaaccttcttcgtaattaaagaacgttctttcatgggaaattttattttccttcttcgatttcatcagatgcttctcagcccatcactcattcagattctatgcaatggttctttttctagctagagtacatccttgagagtagaaaatatttcatataatctaaacccttcatttctagagatgcagatagattctgtaacattaatctcacctttatattttttcaatttttaataacttgaaaatatgtatatctaatgccttctttccctatgcacttttgcttattttaatatttctcaacaccataagctatttgcccagctgcatccttattagacagtgctattgcctgccaaagctttttgagagcaaattgcattgccttcattattattatgtctacaatataatgattatgaaacatcattattatagttgattaataaatgataattgatgactctcagttcataggatttggcccatgaaattcatcacaatttgtaaacttttctccaaaccttcaaggattctaaaaggattgattttgctgcaaagtatatgcgattacattttttgatacctagtaagtagtagtggttgaggattcactggcctggccagagtgagggtgtatactaaatgtctgtggggtttcaatttcttcctattgaattcttttaaaatgtagagtctcttaccactgggagtttggggaacttcgcacagtggctcatgcctgtaatcccagtactttgggaggccgaggtaggtggatcacgaggtcaggagatcgagaccatcctggctaacacagtgaaaccctgtctctactaaaaatgcaaaaaattagccaggtatggtggtgggtgcctgtagtctgaggcaggagaatggcgtgaacccgggaggcggagcttgcagtgagccgaggtcgtgccactgtactccagcctgggcaacagagcgggaccccgtctcaaaaaaaaaaaaaaagaaagagagaaagaaaatgttgacggaaggcattctatctcagtctctgcaatgagccattcgcattttgtggaatcctttctggcattaattgggggacagaaacagcatctggcatatttacatgacagtagcatgtacttctcttttatatgtcattcattcgtacttccaataagttcttttctaatatgagcatacattgctttattgtgcttggcagatactgtattttttacaaattaaagttttgtgtaaaccttacatcaagcaagtctgtcagcaccgtttttccaacagcatatgctcacttcatgtctctgtgtgacattttggtaattcttgcactatttcaaacttttttattataattataactgttgtggtgatctgtgatcagtgatctttgatgttactattttagttattttggagtgacataaacctcgctatataagaacagtgtgtgttctgtttcaccaacctgcctttcctctctctctctctccttccctggccttcctattccctgagacacaacaatattgaaattaggtcagttaataacactacactggactctaagtgtttgagtgaaaaaagagtctcatgtcactcacttgaataaatcaaactctagaaatgatttagcttagtaaggaaggcatgttgaaagccaagatgggctgaaagctaagtctcttgcacctgttggccaagttgtgaatgcaaaggaaaagtgattaaaggaaataataggtgctactccagtgaacacatgagtgataagaaagtgaaacagcccttttgctgatatggagaaattttaggagtcttgatgggagatgaaaccagttacaacattcccttaagccaaaacctaatccatacaaggctctctgttcaattctgtggagagtgagagaggcaaggaagctgcagaagaaaagctggaagctatcagagtgtggtttaagaggtttaaggaaaggaactatctctagaacagaaaactgcagggtgaaacacaagtgctgatggagtagctgtggcatgttacccagaagatctagctaagatcattgataaaggtggccacgttgaataacagagttttactgtagacaaaacagccttctattagaagaagatgccacctatgactttcaaagctagaaaggagaagtcccatgcctagcttcaaaggacaggctgactcttcgtaggaggctaatgtagctggtgactttaagttgaaaccattgcttattttatcattccaaaaattgtagggcacttaaaaattatgccaaatctgccctgtgctctagaaataaaacaacaaagctgggatgacagcacatctgtttacgacatggtttactaaatattttaagcccgctattgagacctactgcttggaaaaaaagattccttttaaagtattactattcattgataatgtacatgatcacccaagggctctgatggagttgtacaaggagataaatgttgttttcatgcctggtgacagaacatttattttaccattcatggatcaagaagtaatttcaactttcaagtctcattatttaagaaatgcatttcataaggctttagccaccgtaattagtgatttcctctgatggatctgggcaaagtcaattgaaacctttagcaaaggattccccattctagatgccattaagaacattcatgacatataggaggaaatcaaaataccaacatgaacaggaatttggaagaagtttattccaaacttaatggatgtctttgaggtgttcaaggcttcagtagaggaaattgctgcagatgcatggaaatatcaagagaactagcattagaattggggccttgaaggtgttactgaatttctgcaatctcatcaccaaaattgaacagatgaggagttgcttctttatggatgaacaaagaaagtgttttcttgagatggagtctactcctggtgaagatgctgtgaatgttgttgaaactacagcaaagaatttagaatattccataaactcagttgataaatcagtggcggtatttgaggattgacttcactttttaaagaagttctatgtgggtaatatgctatcaaacagcttcccatgctacagagaaatctttcatgaaaggaagagtcagttgatggagcaaacttcattggtgtcttactgcaagaaattgccacagccacccaaccttcagcaaccaccagtctgatcagtcagcaaccatcaacatgtatgcaagaccctccaccagcaaaaagattatgacttgccaaaggatacctgcaaaaatccatccaccagactcaggtgtttgttagcatatttttagcaataaagcatttttaaaattaaggtaactacattgaatttttagacataatgctattatacacatatagcctaatatgtctattagttttagacataatgctatcaattatgttaataacttaacataatttttgtgttcactgggaaaccaaaagttcatgggacttgctttattgcaatattcattttattgtggtggtttggaaccaaatctacaatgtcttaggtattcctgtattttcattaagaagtagtatgactatctcacataaaggctgataacctggaagacacttagatttcaatatagtttggaacctgtctggattccatgtattacttcaacaggagtgaagaatcccatagtctgatgaatttttgcaggtattctcttcaccataatgaggtttcattagggttactgctagaataggattgtttgttattagtttccaatgaaggatggaatattctcaatgtaggaattcatagtacgtacaagaaagctatagatattgttagtataataattatacaatagtagtagtataataaaatattcaagcaatcacttaataattacttcaagtctcactgtctgccctccagaatcaggagcaggatgtctgaactcctcattctttacacttttactcaaaagctcttaactctagagacagtctttaactttttggtatttggtttcttcttttgtgcaatggcaatgattctgcctgtgcaaacaactgtcaactgtttttctcagcagtgctagtgtaaatgaagttgaatattaggaataattaaccttccttgcttacatatgccatttgataatgctcaatcttctttgttaagaaaacaatgcagtaaaatctttgttaattgagatgaagtgttgtttatttaaatttggatcattctgaaaaatatatttgttccaacaggcttattcctgaaaatctttctaaaatatgttcagtgtctgtctgccttagaatggtccccaaatataattgaatctctctctggtgatgggttgtcttgcacagcctaggacccatcatactggagtgcttttctctctgaatcaagcagcagataacggaatttggactgctttgatctcagatcataccctggaagttgtgttttaataagtaaatttcttatatgaattgttttcttagtgttgtacctcattcttcataaaagtaaaaagtatattagcaagttacagaacaagaagtatcatgttgcctaatcaatgcaaaatatcatcatttcctagacaacttcacaggagacatagcatgattagaaggtcagacttgattaaatcccgtgctttgcccttagttttttgaaatttcaaaggaggcaatctctctgtcaataaattttcaaattttataaataatagtaatcctgatgccagcaagcagttattgagctttgtgtgccaagtactgttctaagcatgtttcaagtaataactcacttcttcacaatgagcctttcaaggaggtactgttattgacatcatttttctagtgaggagcctgaggcttagattcagaaacctgtgagtcgccatatagctagtagctggccgagccatgatttgaacttagctgtgctcaaaaccaccacaccatgatacctcagagatgaatgtgtgcgtggtggttatgggagaagagaaccacatttacttattttttgtctgggtcttgcatggtgttttagatcatttcatttctgttatttcattttgaaacatttctactataattattatccatattttacatatagggaatctagtctcagaaaaactgaagcttataaccaatattttacagctagtgataatgagggagcagacatttgaacttgacaacctaaattcaggttctggctaggggtttcgttaaggaaaggaaaaattccctccaacaaaggtcatttttatgatgtgtaagtgatttaagctttctgtataccaccccaccccttacaaagatttgtgttttcatttttaattaaatctgtctgttctgcattctcattgtttggacttttttcaaatcattgctaatacactggttcttcttcctgttagtggtttgtggttgactggttcatcttctaccgttaacataattctgttttttttttttttttgaggtggagtcttgcgctgtcaccaggctggagtgcagtggcatgatcttggctcactgcaacctctgcctcccgggttcaagcgattctcctgcctcagcctcccgagtagctggggctacaggtgtgtgccaccacacccagctaatttttgtattttttgtagagacagggtttcatcattgttcttatttttatttgtcattcctggaaattaattttgctttgagtttgggacccctaacatgatgtcctttagccccgtgaagagtgaatgtccctgtggtgccattagccacttgtacagtgtcctgagaatattttaagagaaatatgaatggcagtaccacttggataccaattaaaaatacttttttttttcagtgaaatacgtctttaaacctgcaagacacagagggttggttctcttggtttccttagtcattattgacatcatctataactttctgttgaaataacaaggatttttatggaaagctgtttttgttcctgttcctgttgccagttttcacatccttatatattattaaagatacagaatgggcttttaatagatcctacaggccaggcacagtggctcatgcctgtaatcccagccctttgggaggctgaggcgggtggatcccatgaggtcaggagtttgagaccagcctggccaacatgacgaatccccgtctctactaaaaatacaaaaattagctgggcgtggtggcaggtgcctgtagtttcagctgttcaggaggctgaggcatgagaatcgcttgaacccagtagatggaggttgcagtgagctgagatggtgctgctcactccaacctgggcgacagagggagactgtctaaaaaaaaaaatgtaggtcttatggagtcacagagtcttaatgaatctccattgttatatgacagggtcttatggatgtcttttggaatgcccagcagcaagtgggcagcttcttaacaacccactgtgactcatgaggaagtgtgtctttgtgttgtttatgactgtgtttttatgggtaggacttcccactgtctcactttcctggcttgccttctcttctgtttaccctggccccacctttggctcagctgggcactacgggttttaccagagtcagttggaatgcaagtgcatcacaccagctctccatctccctgtggcattttatggctcagagaggattggaactaaaccttgggtggctcatgatcggttgtacccagccaagtctggagaaatggagaaaatgcctgggtttgttagtctacatgtccttcacattcttacagacacgtcttttgagtccagagaaatgtaaatcttttcctttttgtttttagtggtttatttctcaggccctgaagcatgagttttggtcacccctacagcaggggagatttcttcaaaaacagctgtgattatccgaaggtgttacattgtgcttttcttttcatgcatttttagcacctgcacatcatagttttcccgggaacctccagcagtgtcacctgctaacttggcagactggagagactctcaaagccatgtctgacttctgtgtccatctggattatttctgtcacatgatgatttggcagatgttttctgcagatctctagctctggtaaacaatggtgaactgggcccatatactcaacttgtaaagagtgatttccccaaaaacaggagacagacatttagcaagataggggctccttcatgtgaaagttgatctctaaggttagtataaattttctgatctagagggaattataggactctgaggcccacccttactagcttgccaccaggcttggtataaccttcattgcaaatgctaggattcatgctttggttgtacatgaaggggattatttctgggtggtattttatctcctactctcagactctttcagatctagctggatgttcaacataagccttttgtgtaattcccatgggctgtagctctgtggcttgagtagtggtcacaggagctctaatgccagaataaatgatgctgctaacagaaaaaagtagggctcatttctctgcaaaatgctgcacaaagaagactttctttgcttcttctggtacatgtggtaagcgtagaaatagtttattatggaagtctttcagccacaggtctttctaaggcaaaattgtatcctccagggaaactaaaataaataccagcctaataaacttcagattttaaaaaataagttatcatattgcatttctgtaagaagaaaaatatgaaaggttgatgtgtgtttttattccactttgatttacttcccaagctgtcctgtcccaattcaatcttaaaatggaagaaaatactttatcatttgaagaaggatgaatgtagtacagaattcaatttttaagaattcaaggtaggggaagtaaattttgatgccaactttcaagtttttaaagaataaaataaaataaacacatacacacacagttggctttgtgttggaagttaatgatagatgtcttctcggtattctttgcaaaggaagtcttccatccaggctttccctcatttgtttttaattacagtcatggtctacctggccttctcactagcactagctccctatgccttttgctttgctcttaggccgggcttttggtccctccctcctcatctctggttctctcgctattccttggctcctcttgtcttgctgcccagtttggctcaggtacatgaactgcaacctacattctgccatccctgcagctgcacaagcctgtcgttttccatactattgtattttcaggtctaacatgtcccctttttactgccctttctcagtctactttagtggttattatcttgtcatcaatctctttaaatatggctaggctccgaagattcctctattgactattgtgtttgctttattttataaaatttattattaaataaagctaggaaatgtaatataataggcttccatttacccaccacccagcttgaaaagcaattctgaatttgctatttatgttactaatttctttatatatttttcacatatgcaaatcaacaaatatatagtatgcttatattttggaaaattgtatcttattctttatgtgcttttttaactttttaaatggaagatgatgcttgtgagattaattcaggttgctatgttttgctcttccactactgcatagtattctattttaagcctatgccaccatttattctatttatgagcattcagattgttttcatttttgttattacgaacaatgtttctgtgaacatgcttgtacagatctccttgcacttctgtcaatttattatttcagcatattttattgagcacctattagtgcttggcgtgattgatacaagactgctaaaacaagtcgtatcttgaagccatatgctttagagagacaaacaggcaaattctgttgtaggagtcttctcacctatcttcttatttttatttcactcctcctttgtcatatttcacagttctgctaaagttaacttttttttttctttttttttttgagatggagttttgctcttgttgcccaggctggagtgcagtggcgccatctcggctcactgtaacctctgcttcctgggttcaaggattctcctgcctcagcctcctgagtagctgagattgcaggcactcgccaccacacccagctaatttttttgtatttttaatagagacggggtttcaccatgttggccaagctggtctggaactcctgacctcaggtgatccgcccccctcggcctcccaaagtgctgggattacaggcgtgagccaccaagcccagctgagctaactttttttttttttttttttgagatggagtctctctctgtcacccaggctggagtgcagtggaatgatcttggctcactgcaagctccacctcccaggttcacgccattctcctgcctcagcctcccgagtagctgggattacaggcacccgccaccacgcctggctaatttttttgtatttttagtagagacggtatttcatcgtgttagccaggatggtctcgatcgatctcctgacctcatgatccgcccatctcggcctcccaaagtgctgggattacaggcgtgagccaccacgcccagctgagctaactttttaaacatagttttaatcattactgttattgtcaaaaacattcaaagtctccctgttgcttatgtgataaagttgatactcctcagcttgccattcaagaaccatcctagcttaaccttttctcctgtttacatctcacccatacacctttcagatgccagtgtcatttccctttcatgcctctcagtgatatttctttacccttagctatcttgcctgttttgaactttatccaggatgttgaggctttactcagttttcaagatccaaatgaaatagtttattattcctcttatacccttcgtctaagtgtttattgcagatagtgggatatgcatttgtttagctgactaggagcaggaaccatatggtaattgcctccaacatagtaggacctcattaattaaaataataatttataatcaaatcgaactgaatggatcatttggttctcagctttgctgttaaaactctttaatggtcctaatgggaggagggagtagaaatagagtgaatgttttagttttctgttgcttttcaaatgtttctgactctcaataagtgcttgtagcttactaaccgagcaaccattctaagcgggatccttaccacatcaaagtgggataggttgagaagaaaactggctttagtaagagagacagattcttcataaaaaaaaaaaaaagaccatattctcaccttagtaggattgaactaaagcatacttaaaccagcttccattctcatctcttggtcacctcctttctgccttttgggtggcaatacacgttgatggcctgtcacctatcatgcccttctacttatctccagtccccagggtagaaggcagatgtggctgcatgtgaataaggggaagcccgagtccactgtgtccgcgtttccattttgaaggaaaatgggagaaatgaggccagtggtttgataaattatatcaaaaatagtcccttcatgctaatggagtgcgaagaagctgatgtactggagatgatctataatatttcatatttctctgaggagaaaaatgataaacttgatgatgtgcaatttattcatgtttcttcagatgagaaaaaaaaatcctcaagtcaactaactgcctgtttctcactcctggaagctggcatgtggattttacactgggattggaggctgggcttgtttagagaaatgcctagagagactttgattaatcaccagacctttggcagttggttgggagagggtaattacgctagcattgccactattttatcatcgctattttatggctctacaccgccaggtgacaaatgtgttaattattgcatttcttatcctggacttctcttgcctgccccctcccctcatggttttggcccttagtccttctctgcagctcagccctggacggcagtaacttgtgcaatcaaagagctgttctttgggagccatgctgagagggacagggctatcagccctgctgtgtgcagacgctaaccacggggagctggttaattccctttcctcttccttctgcccatcaccctttgggtcaagtgctgctcagagccagaagctccactggcttctttaataactgaaaatagcacccctggactgggccatttcactctaaatagccccctggaggaggttagaaacagaggttgtcttaggcaaagagatttaggaggtaaaattgtcctttttctgtctttttcttttttttttttttttgttgccccttctgtctttctgttacccagagaaagcttcacaagcatgcctgtaatttagttgcaccattttattacagctgaaagaattgaatgtaaagaaggaagtttaatagaacatataattcagcagatttattgatggggaggtatctattgtagtttggccagtgaaggcaggtcatagaggaaaatttaggtaagtcggattttctttaaaaagaggcccaagagttagtacctcaggattttgttttcttctgttccttgggcatgctggaaatttgttagctcttaaatcaacaacttgttattgacagtcatctttttgctggagaacgtattaaaataagtataattatggtgcctgacctcaaaaagaaaaccagttggttatataactctaaaaagatgagtagccacagagtgtagaaagccacagagaagagcaaatgccattgttgggaagcagagcctatgctgggtaaagtttcctgggagtttcatcctccaagaacaagaatttcttcttctgaccctccaccttctctggaaatggggtgccacatcttttgccttctggctaaatttttgtttattatatgcctctttcactagaatgcaagaacatgactacttggttatgttcttgcttgtaatccttgtttttagaacaagacctgacaactcgattatggtcagtatatatattttttggatgtatgaatgaataaatgaaatgagatcttaacatgtaactatcttcttttagactacacagggttttgactataattgaaatttttaggcttcttcagctctctcttttttgggtccaaaggatgtctcaaaccaaataagaaattccttcttattgatctagtggttacagacaagagacgccagccttctttgtcttttggaagttaggagtgtgtccctgaggaaactatgccctgggaaggttctttatttataatacaaaatttcttttttgtggttgagctagatacagatatttttcaatttttcctttcttcgaaggctatattttggcttaatctgtacttacagcataactattcatgctaattataattcatatatgaaaatgcaccaaatatgactattagaagcttttgaaatactgtttgatactttgcaatatagttatttatgcatatctgcatttgattttaaacttcttgaagtaatgttttatttatttttgtatctccattgctcagcaaagggtggcacatagtaggtccttcatgaactaatattcactagagcactgtgggaacttatttgcaacacccttggcatctctcttatccattggggatagcaagtaatttgaactgtcaaaaccagtggtgttgctttgggcctaaatgacattaaactttttttttttttttttttttttttttaagaaacgaggatcttcctatgttgcgctcgctagtggtcttcaacctctggcctcaagtgatcctcctaccttggcctcccaaagtgctgggattacagttgtgagccaccgcacctggccccaacattcaactgttttttctgacagtaactaagaatgggataaatgcctctctgaggcctttcccagtttgtgaggccacttgtcttattatttgtgattgcaggaggacatgcatcatattcatctaaaggttgaatacatttatttaattgtggcttgtgaagaaagaagagctaatatgtggtcacgttttatgctatttaggatcgaaaatcagtcagtcatgaagccatttcttttcattctacttttggagatcatattatgataagcttttcagaagcattaataacctagactcaagcctatgtagtttggaccttcatgtctttacatgtgtagaatcaaagagcaataggagttggtgtatatgtgacttgagaagcctcacatcattcttggaatatgttgtcactagtgtcatcagtggggcctacgtgccctgcctgccaactcaggaaaggcgtgagattgagggatctagatttagcatttattgaggaaaaagtgttgtataaactattgaaattttacataaaaaacaaatagatctgttttgggaaatgaagattttcaaaagaaatatggtccattttgaaagagataattgcaggatatattttagtgtggcctggagcttaccaatcagaatgatattttgacattcatggtgtcaaaaggtaatttctttttgccttgaatcttatgcttgaagtatgttattcatgtagctatatataatgggattacattttaggggaacttcgggatgatatgtaaaaatcctgaagaagttgtctttgtgttttaaaacaagaaaaacttgacacaaactggcttacaggaatgtgtttcttgcaggtttcccttagaagccacacaggaggcagttttcattggctgatgatgtttatgggtataaaaaagaaactttgggaggatttgataaagtctcttttcagcttaagataacatcattttactcacgttagagcgtttgtgtgtgattggagttttgatggtggttatatttttggctttttttaatgtttgttgcttactgccattcctgaaccaaaagataagttgttcagataattgcaaagacagattatggtaatagtgatactaatatctaacatactacattaaatatgtggaatttaatttaattttttgagatggagtctcactctgtcacccgggctggagtgcagtggcgtgatgtcagctcactgcaacctccgcctcctgggttgaaggattctcctgcctcagccttctgagtagctggaattacaggcgcccgccaccatgtcccagttaatttttgcatttttagtagagatgaggtttcacctgttggccaggctggtcctgaactcctgacctcaggtgatccacctgcctcagcctcccaaagtgctggcattataggcatgagccaccgtgcccagccaatatgtgtaattttaattatttagcacttatagcaattttataagatgggtactttgtttatccctattttttagataaggaaactgaggcagcagaggttaaagaaacttgcccaaagttaggtagctaataagtagtagaagcaggattcaaactgaggtattctggctctgtaatccatgctcttctatgcactgcctttgcaaatctaatttcaacttgaaatgagttcagtggattgatagtagattagtaggggagccattccaaagagtttcttataattaagtgaacttgagaatgtaactggcaacagtgaagagattcccactctatttcatctgtaactttctgatcttaccgtggtggtcacatttgttgtaagaatatttatggtggtgtttaggataagtttaaggaaatgttgatcactttttgtttgatctgagatattgatagatatttatatactttataaataggtaattaggtatatatgtaaatatgtaagatatatacctattaattacctattaaatcattcatgctggcctctgggtatttacatgaatttttttcagtaagtcttgcctttcagatatatataaactagattatgcttaaatatttatttggacaagtgttttcctctttagttaagaggccatcttctgaaaaattagactgcagtaaagcagtaattccgcctcagttttccatgagggaagatttgtcatggctactcctacttttggcattataatcacgtgaacttattattcaaattaatggcttcttggcataattttcagaggtctctactgcaaatctcagacatctacaaatcagtacatgtcataataaaaggaagaatacagactgtcagacatactcaactagtcttctttttttttttttttttttttgagacggagtcactagtcttcttttggaatcacatcaggaaagggaagttgttagtgcttatgccaggtagctggaagacatctttgtgatatttatgaagatcagccctgttgggcaatcgttgcctctgccagaatgacttacccatttatctaataaagggaaacatctaaattcttgaacatgtaataattcacttgataaaattcaggtttttataaacaaatcatattaaaaccccaaaagttaattaacaggtgataaaccttgcttttacttccttgtcccatcacattcattcatagtcataatacactgacaattattgagtgcctttgatgtgccaaaagcacttgctaaatgctttgtttggaaagggatgtttgttaattggggtggtacctcccaaataatgaaacatacacacttttgttttattgaggatagggttttatcattccacagctgttccttgagtaagatccgggcttgaaaggccaagttcttctacaggggcggatctttgaggaggaagaggcaggtagctaggaagggctaggaggctacagaggttaaaagtggtctgagattagggagaatggctaaaagtgagtgagattttctctcgtgtgtgaataattgtaggaagagattctggacaacatatgcagaggaacaaatggagggatggtctttagtcagtggaagtggaaatccattggatcatccatgagcccatctgaaatcagcagcccgttaggtagaagcttgaaaaaaagaactgttgtgtttggtgaatatatcacgattttggagaatgatgagggcagaatcctgcatcctttctagctttcttgagaactttgtacgagagtcactcttaccatcatctaaatataagtgatgtgtcctgctgttaaggaattccaccatttgctagctagtggacataaatgggcatcttgttttcttttctttctttctttcttttttttttttttgagacggagttgcgctctgtcgcccaggctggagtgcagtggcctcccaaagtgctgagattgcaggtgtgagccaccgcaaccggctgcatctttttttctttattaattatttatatgtctggaagtctagatatatatttgtcttcgggaatggaaaggtaccaataggaaattttgagtaagccagagtattctagcaaatataggaattacgccaagaacagccagaattgcccagcactagtgataacctggtgaaaagaaagaccatcaatttatgtgttccaaaaatgatgtcagcattgcaagaggagagctgactgcgtaggctcatcctcatttctcaggagagtgtgcctgtaaatgaccaaccaattacaagcagatgataatgaagcaaaatgatgtaaatcaagatctgaggagtgacatttatggccaagacttgataaatatggaattggagaaagaagataggaaacaccagaggaggacagcaaggactgtagttttttttactgtggataagcccaactccctactgtggcattgaatcttggccaggcaatagtttgattgctgatttccttagaagggaaggattcttgtgtaggattaaagtaaaagtaattccatgacaacttgttactgaggaagacagccaaatacatatttcatgagtaagcaacagtcattttggtggaatatggtgtgttacgtaaagcttggtgctagattaatgcccaggtgaccacttggaggacaatcagtgtagccctgtgaaagatacaaagtattgcctgcctaagtctcagtttctttgtctgtaaaatgtgtgtttaagtggagctgtgagacaatgagaatatatgtaaggtgcctggcacttaacagttgttcagtttctctctcttgagcatcctcaaagctccttttattgatttctttgatgctgaaagaaagagaataaattttgactgcacgatgagcttcattttttgaaggtgctgattctcacccccatttccagctacattgactatcgttagccacttgttacccatctagtgaagccatcttctatagtgcagtgtgtgttagtaggaaaggcttatttggccttgaagggctcgtttggccttgatccggtactgattgtggtttgaggttgagcatgttaaggatgaatagtagctggaatggtccatgatgtgtgcttagtatccttcagaatgtttacatagtcatatttagattgcttctgagaacaagagaatacagaacaaaatgttatgttccaaataaagatcacaataagaagaaatattgcccttctagcttggcatcctttttctgccatgatttccctttgcattttcttcccataccttagctttagccaaggatacagcagtaagtgttgcttggtatttaatcaaattaaaacctgtgctaggtaatgcctcatagattttattttgccaagatagatgtttgaacggaaaaagaaatagtgtatattaaggactaaagggggtactcttgttttctttcaaatatgataattagtataaaactgtctttttcctgccagttggctcatctcatctcctagcagctgttttaaattccttaattgtctattgcttactcagctatcatttcacaaatttcctcactgccgcattttcgttgaagcaaattctgacagtgggggatgctcacctcacaggctgggttgagctgagttctagttatcctctttgagtaacaggattaactatcattagacagtgcattcgggtaaggtgatggttccctaggtctctttggagttgattactatagaaatgggcatctggtggagcctcaggttgccaattgcattactcttcattttactgatgtttcaattctgtttaacccaacgtagacttttttttatgcttataaagtaataggagtttcctagaggatttgcagcgtacactattgtataatctcattgcttataattttttttcagaatgaaggaagtgggtattttaaccatagcattttcattccagtatcattaaccatttaaatacactttgttaaatctatcacattttctgttaaaataatgtaaaattctagtagaaattttaacagtatcttactgtaaaaatactgtaggtaatagaccctgagataagacagtctgctgctttcagaagcatcaacacagagcattcctcaagcatttgatttaagtaaatattattgaagccttactaaattcaatttcagatattgtgctctttgatagcacaatgacagcttacatatgatgctttcaaatgtcatccacttatttctttttttttttttttttttttttttgagacagagtctcctctgttgcccaggctggagtgcagtggcgcaatctcggctcactgcaagctctgcctcccgggtttacaccattctcccacctcagcctccctagtagctgggactacaggtgctcgccaccatgcctggctaattttgtttttgtatttttagtagagacggggtttaaccatattagccaggatggtctcggtctcctgacctcatgatcctcccaccttggcctcccaaagtgctgggattataggcgtgagccaccacacccagcccacttatttcttaatgatgggaaaactggtaatacaagaccaaatttttgtttatacatcaaattatcaactttcatgtcttatttcatagtcatgcattgcaggaatgtgcgtactgcataaagtgacttgctttatcaggtttgaaattcataatacagtcagaagatgattaacagatttgttcaaatttttatgctacgatatgttcttgtccccatgtgaataaatgcaacagattgtttgtaaccattttaattgctctgattttacatggacaatagttttgtataagaaaagacaaaaaaggccaggcccggtggctcacaactgtaatcctagcactttgggaggccgaggtgggtggatcacttggggttaggagtttaaaaccagcctggctaacatggtaaaatcctgtctctactaaaaatacaaaaaaaaaaattagctaggcgtggtggtgggtgcctataatcccagctattcaggaggctgaggcaggggagaaagaaaaaaaaaaagaaaagagaaaagtagtcacttggtttaaatgcctggattttgaaacctaactccttgttttacctctgtagttttaggcaaatcacttaacttgattgaatctcagttactctcactataaaaatgggaccagtaataccttcttcaatgtgatcttgagaagattcactggaataatggtgaaagtaccctatcacagaatttatagtaggtgctaaaaatgttgtgtaccttcctttccttcccttagaaagacagtctcttttatttattgattgtacttttgccaccacagggggaaaaaaatccctgtttcttataaaactttctaggaaattcatgaatttagtgtgggccctctaattctgacaaatacaatattgattttgagtttgttgctttaaatttgccaaatgaaacgaaagttttacggttttccttttaagtcacttctgatatgtggagcaaacaagtctgtatttaatagtaagtagtttgctaattgcaaagcactaccaacttaacacaacttaaaatgagaagctgagagggggccagagcatgaaataagtaagtaggttaagaactgccacacagtccatcatgcttgcagagaagaatgtgagactgtccgaggctacagtgctggtcaccttagcctgtgtaaactctcactttctcagttatcagtggaagacaggggttaatccttattagtctgaacacatcacattgcaatgatctgaaagctaaagacatggcataaaggaactctgaagaaaccacctccactgagactgctgatgcttcgaatggaatttgggcagatggaatgctcatttaaggagcaaatgacatggacggggggagtcaaaatgataaagggagcctccttgcatttgttgtatcttacttctgtgtgagttctggcaaaaagcaagcatgactagaaccctagaaaaacaaccattaggtagatactagttatagtcaatcagagaaagccagtatgtgcgaagagagaagagaagaaaaccacatggtaaaaatgtaatcaaccagtgggattcttttagttcataattgtaatcatagatggcattccactacctttgtcttccatctggaccaagtatggctgtgtctagaggttctgttgtactatttctgtggtccttgaactctgatggcaacctaccttgacaaggccaaaaacctacacaactctgagcctttcttggtagtggcattatctaaacgtatgcatttgtaccttatcaggcttaatgagggaaaagaaacggcttttgaagacactaatgggaaattattataagtcaatgaagtaaaaatgcaaatagatttgtatcttaaaacaggaatactgctagaagctaaaactgagtaagatcttgctctgtgccaagcacatgctattttgcattaaaagagacccctgccttctacatagtatcctcattttacgggtagaaatcttgaggtttagagacgtaaagtaaagtaactcacctaaagttacatagctcatgagcaatgtggcagatgtttaaggacacctcgtctgatttcagcgcctaaatgaagagccttttacaaggatgatgatttttgcagcaacaagacaaagatgtccagcaataggaaaaagattgtaaagaaatgttaatccctgtagagggcactgttcagatttaactcatccaacataattttctaacatgataaagcagacctgcgccagctcctgactgtttcagataggtttgcctctggggaagaaagtgcagtgattcgtgtaacctactgtcagtgttatttaaatctcagacctaatctagaatttactttaataatcttttattattttcctgtatattcttatgatttctcccttctcaatgaataatgaatttagcataatgaattcagttagttctaggcttcttcatatctatatttaatattcaaagcactttcttctcttttattcctgatttaccaaaatctgtgattgtgccatgaaaagatgataaaggagaccatctcttggatctggaaagtgctgcgtgttagtttataactgggcaaatgtaagcataacgtttggccagggttgggtgcggtggctcacgcctgtaatcccagcactttgggaggtcaagatgggtagatctctttaggtcaggcatttgagaccagcctggccaacatggtgaaaccctgtctctactaaaaatacaaaaattagctggatgtggtgacagacacctgtaattccagctactcaggaggctgaggcaagagaatcacttgaacctgggaggcagaggtggcagtgaaccgagagtggcactgcactctaacctgggcgacagagcgagaccctgtctcaaaaataaataaataaataaaaaataaaaaaagtttgaccagaggactacctccattgtctttcttttctacaatccagtttagatactttctggactaaccataacttacatgcttgtccaggagtattggccagagttagagtggtcacattaattctaggcaagggtgaagatgaaggagtagagccatgtttccttgaaggacagtgatgatgctttttagagcttattacgtgtttgctatctctcccatcccaagcagtcaggggttttaactttgaagataataataactgtcttcagtgggtgaatttacatctgttttgacccaaaagataatttaggatgacttatggaatctgaagctaaatgtcaaatgtaattaaatgttactgttgtgtcttgccttaagaagagagctggtgagttctagcagggtttgggaactatttggattaactgctttgattctttcccacattatataagaggtgttatctcagacagcacagaaattgtccctgggggacagggaggcatcacatttcagaagtacctataatatttcttcagcatgtctttgggcctggctttctcaatatttctaccttttcttgaaatctccacttggatatggctctggaagatggcagaaacgccatcttaaaatatacataatatttttaagaaatcagttttgaaaaacaagaagtctcttttcctgacggtccttcctcaatatgcttaaattattgaataggaaagcttcagtaagacacaactattaacataagtgctaaggattaagaaaaagatctgtcacaaattatgtctgtctgtaggaaggtaaagttgtgcctttgatatgacacctacccctggaaatcatattcttttccaagatataaacccaaatcagaatagggagtgagctgttaatatgaatactgaatctggacaggcacggtggctcacgcctgtaatcccagcactttgggaggctgaggtgggcatatcccttgaggtcaggagttcaagaccagcctggccaacatggtgaaaccctgtctctactaaaaatacaaaagaaaattagtcgggcactgtgctgtgtatcagtagtcccggctacttgggaagctgaggcacaaaaatcgcttgaacttgggaggcagaggttgcagtgacccgagattgtgccgctgcactccagcctgcacgacacagtgaaattctgtctcaaagaacaaaacaaaaccaaaagaattctaaatctgctctgaatagtagaagacaatgggagacatttatctttggtagcaacatattccaaagacttaagagtttaaagaaatcatcattttcctatcgcttccttcctttctctctcaatcctaaaatactctctgggcaatcaatttcggaattctttcaaggaaaggaaaccttgattcgtctgcctgttaactactacaaaatgtgtagattcctgctcttccatgttactactcagagtaataacgaaacacctattattgtcattatctggagaaaagaagctcctatactggattaaatgatgttgctgtgcccataagaaaggcaggtattgggcagtaatgaaggtatggcagcaggaatttatactttgtctctttcatcagagtagctcccccctcccctttttatcctgtaggaggaaattgtggagtgagagaagaggtctgatctgtttggggaaaaagtatcacagcctattagttagaagcaatgaaattgagacagctttgggactccattaagtgtgtggtgtttaggcagactgtgtccctgggtaaagtgtgctgttgaagaggatagtacacaatgaaataattgggcttgggaaatcaactgggcttcagcagcctcatatctccttgtggggaatgggtgagggagctacagctttccctcccttcttttagcataaaagctataccgaataaaatagaagggaatttcttgctgagtagatggactgtgaatatattttgaataacacaaacaatggagataattaaattttgtctggcacaggaaggattcagagcatgtcacttggaaccccctcatgccatgttcttctctaggcgtctggatatatggttgcagcaactgaataaaaataactcagatttgatcagtaatggcagcatctatagggacatgttttaatgcactgatgtgtatgaaattaggttcttaaataaaacattattcctggatattttcatttcaaaggataagctgaaattcacgaacagtgtgaactagactgacttttcccactgagatttactgataggcaaacttttgtgcacattgtggacactggttgagggtaggctcactagttttggtactattaatggtcagttgcctgtagaacttgtgaagtaagaaaaggtatatctatagcaagttcaaggttcagataattgttgttctctcttaagaaaaaggttttgagcggttgtcttctttacacttagtgtatgtaatgatagtttggctaaatatgaagaagaaagagaaatagcattactactgtttattaataacttttctttgtgccacacatttagctattcaggcactttgtgtttgtgtgtatacatatacattctcttatatacatttgcgacatgtggtaaaaggccctactttttggagtcagaaattgtgctcatttctgtatctgccaccttgtagctgttggctcttgaacaacaactaagcctctactttgaacatcaattttctcagtaaaatgagggaactagactaaatagttgccaaaattcttagtccacacacacacacacacacacacacccattttgtacttctaaagacactggaaagaagtttacggatggaggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaatagataaaaccacaaagatggggaaaaaacagaacagaaaaactggaaactctaaaacgcagagcgcctctcctcctccaaaggaacgcagttcctcaccagcaacagaacaaagctggatggagaatgattttgacaagctgagagaagaaggcttcagacgatcaaattactctgagctacgggataacattcaaaccaaaggcaaagaagttgaaaactttgaaaaaaatttagaagaatgtataactagaataaccaatacagagaagtgcttaaaggagctgatggagctgaaaaccaaggctcgagaactaagtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaagggcaaccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatattctttgaaaccaacgagaacaaagacaccacataccagaatctctgggatgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaactcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagacatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatctctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaagaagtttacggataaaagaatgagaagtagactgacattgtacttttcattaacgtgttgaatgcctaaagaatggaaggaaaataagcttaaaattttgaatctatgataaagaaaactattgattaaccatatgcatatttgacattaaaataattcataattaggactaacagatttctggcttaaaaaatctaacaattactttaagaagcaaaagacatttccagaataaagtagggggatatatagaaaagttggtaccttttttaaacagagtcttcttttgtaaggaagtagaatttattcatcaaaggagatttatgaaaagtatggtggtatagtgagtggcctcactagttttaatgattgatatttgaatatagcttagtcttataacaactccccaaataaaaatttaaaattcatttgtatccctttgattttcagtgctaaaaactagattgtgaatgtcaaggaaatatttaagttatttctgaactaatgtatttgtagagagaagaagggagtgtgcacgtgatcgagaattatgttttgaaaataaatgaatgattggctattaaaaaaatttttaagccttaaaaaaaaaaaaaaaagacactgtataaatgttagttgtttgagcatttttgtatatacgtgtatgtccacacacatatacacaacattttaaaataacatcagttattttccctcttttatgtttttattttcctaataattcataccagtgatgtaagatagtggtacccagaccccataatctaagaggaatttgttgccatttgaacaaggaatgtgttgcctcattcatattttcaaaaggatataaatacattgttgtatatctttaggggaaatatatattcagtattttaaccagagttctcactgctgtgttcccacattgttaatatcaggtagtttgcctagatgttcacagtagaagtacagggatgtagaaacatggtctttcttcccaaagaagtcatttttctttaaaatttgtgaaataaatgaattaattgagtcagcctttaacatagtaatccattttgcattattcagctttgattgaaagagacagagaaaatatgttttgtcggggggtggggagaatgggagatagagatttctcagaattaacagggtgctctatagctcaataagaggccctgtatatacagcaggatagatttgtagttagttaaggaaatcttaagtctaaaggttgtaattcccttagaattcctgtaagttaattgtttttcccccactgtaatgcatacccttgaaaggcaggaaccttctgtttatcattgtatcccaagggcctatcataagcacctggtaaccaataaatgttgaactgatatatgaaattttcctgatcttagagattaagtattatcctcatggtctaggggaataaaacatccacacgtccaaaccatagtaattctgtttccatattctgctatctatgggtttcattattttaagtattctaaacttacagagagcaagactaatactttaaaattttattttggtctatagggaaaaaaaaaggttatttgagtttggtgactgtgtccatcactttggtttaccactgaattcacagcagatactaagaagtatctgcattgttttgtttggtttggttgggtttttaaaacagggtcttgctgtgtcacccaggctggagtgcagtggcatgatcatagcccactgcaacctcaaacccagagtgaatggatcttcctgcctcagcctcccaagaagctgggacttcaggaatgcaccatttgtgcctggctaatttttatttttttattttttgtagacatgggatctcactgtattgcccaggctggtcttgaactcttagcctcaggtgaccctcctgcctctgtctcctgagtagctgcaatcacttaatcctttaatagtcccaccaatctattattatctctgtttgacaacttatgaaactgaggtcagatagggcaaatgcagtcatgcaccatataacaacgtgtcagtcaacaacagaccacatatatagtggagatccaataaattataataacatatttttacagtacttttctgtatttagacacacaaatacttgccattatgttacagtactgtactacataggcaactatgctattcagtacagtaacatgctgtagaggtttgtagcctaggagcaataggctataccatagagcctaggtgtatagcagactgtacaatctaggtttttgtaagtatactctatgaagtttgcacagcaacgagatcacttaacaatacatttctcagaacgtatgcccattgttaagcaaagcgagactgtaattgacctaaggtcacacagttaacaagtagtgaggttttaaactaaggcctttgaccagtgctcttgatcattacagagtggtaccaacatggtagcataagctttaagaggagggaaaacttggttcccgtggctttatcagggaagacttcttagaggaggtagcagttaagctagcccttaaagaataagtcttatcttgaactgaatgtatgctagagtcagaattatagaggattagattcagaataaaaggccatctgtttcaagttcctaatttgcagaggagaaaactgggatctgtgaggttaaataacttgttgtaggacatatggctaattaagtggcattagaactgttctcttccctcctctatcctgtgttattccctgtccccctccgttaatgcacactagctcatgttaagtctgttttttcatcaacactttctaataagagttcctaaaaacattttacagcttgaaagtggaggctttcttgtgtatctatgtatggtgatgaggttaaaccaggaaagggtcagggcaggcatggaaggagatactagagatacgtggagacatggagagacagaccttttctatctgttttttgtttttttttcctagcattttactttattgttacatctgtttccttccataagtatagataattgagtgttgagagaaaggggacaaatgaaattctaatgagaaaaaaatgatttaaaattccacaaaatctatggaatttcagcctcttaagtaacctgggatgtttttaactttcactaatgtttattagccagtgtccttcctgccacccacctacaaggatgtctcaaggatgaaatgaggtcatatatgtgaatacacacttaggatacaactgccatgtattggcagtcttgtctgttccctgggcctacactgttccttgcctcaaaatgtagtactatcaggtagtgttgatgtttcattagccaagtggttatatcagatttatgtactgctaaacaattgatctgggacttgggtaaatactcattggaaaaacatttgttgtattctgagtgctccctgttaatcttctcctcctcagatagcaagctagatctgggacttaaggtggatttttttccttatttttttttcctttgttttacccaatgattgaaaatataaaactaaacctttttcagtaaagtctgaatcagcagatacttacattactttggcataggctttttatagactagctagaagaatacagtaattagcatatgcatttcctcattaaaatgtcattagtgaaggctttgttcttttaaggtccttcaaataaggtttattgcattgcattccatcactaatattttaccaggagtcagatatcttacttaggtgtgttgaagcaagggttactttggactttctatagggtaatgacctaagagcagacctggacacacataaatctctatgcttacattgggtgggccctactttatgtactagtaataattaccagtctcttctcacactgtccattcagaatcctttggatatatagacatttagcaaacctagacttgtttgaaagaataaactgttatctgcactaaactgttttccttggttatcttggtaggatttgatttgaaaaaaatgtatgaagaattagaagaaaagaaatttataatgtactataatcatttgagatacagtattatgcaggagtaagaatacaggctttagaatcagaccattgaggattcaaattcttgcttcatcatttactggttgtgtaactttgtgatacttagcctttataaacctcaattgtctgaatgtaatacggaaatatgagtggtccataccttataggaatgtttgagaattcagttagattatgcatgtaaagtatttagcactgctgcctggaatatatgatctattattacattaccggctgggcatggtggctcacgcctgtattcccagcactttgggaggccgaggagggtggatcacctgagctcaagggtttgagaccagcctgaccaacatggtgaaaccccatctctactaaatataaaaaattagccgggcatggtggtgcatgcctgtaatcccagatacttgggaggctgaggcaggagaatcgcttgaacccaggaggcagaggttgtagggagtcgagattgcgccattgcactccagcctgggcaacaagagtgaaactccatctcaaaaaaaaaaaaaaaaaaaaaaaccaacaaaaaattatctttataatagaaaaaaggagtgtgtgtattttcatatgtattgtatctgctttctacacatctttgacttaagaaatcctaacatgaaatttcaaaacaagtaagaaggtatttaaggagtggtcattaatatcattaattggcttaaggcaaactttctttaaaaagtcacacacatggtgtattcaaaataaactacttcacttaatcattttaacatttctgctatgcagcgtgactagcaacttgaaggagcaagttaggaaatgcctttgatgaccccatgacatcactatgttattaaataactggaaataaactgaaaattatgggatagtctttaaggctttcatgacatttcagcattttagggttgcagtattccaaggacttttagagtaattgcatgtcatcctttgtgtgttgtgggcaaatttgggttagctaaaagttggtcagttaaaaaaaatttatattaagcatctactctgagccaggcattgttcttttttgctgtgaatatagtgctgaacaagaacagaagccttgctgtcaaagacgtaacattccagggtaagaaaatagataactcataaagaaggaaatgattaattcagatacttgtgaggctatggagaagataacctaggctaacgtgatagagatgggtggtgaggatgtgagttaaggggaggccttttgcaggttgttgggaggagatgcaagtgttccaagcagaagaaagaagaagtacaaagtccctgatacactaacaatcttggtgtgttcaagggacaggaaaaaggccggtgtggctggaatttggtgttcaaagcaagagaggagagataaaggaagatgagtcatgcagagccttttgaaggctgtgggtaaaatgtatgttatacggaacttagttctaaatctagttgcagtggattaacctggagagtgatgcaaactgagttttactctggaaaaacactgtgactgttgtgtggagaatatgctcccaagtgtagaaactagatcaccttgcatgggccaagagagatggtggtagtttaagactaggattgtagcagtgaaatgtaaagtggttgcattcggacatattttggatagagatttgacaggaggtaggtggattggacatgggatgtaaagtaaaaagaggaagcaaggatgacttccaggagtttagcttgagcagctggatggctgatatcatgtgtaggcatagggaaaggttgtatgaggaagaatttatagggtgtgagggtgtgaagcagggaataattttgttttgacatgttatgaaagaaatgccaattgacggctaagaaaagatgtcatctgggcaggtaaagaatctaggagattgggaaaatgtccagcgtggaggtataaatgtgaaaaccatcagcatatgggattgaaagctatggggctgtttggattccctaggaagagaatataaataaagaagggggctgagaacagagtctcatttataatatcctgataaggaagaagacccagtgaaggagatgaagaaggagaagccagtgatgtaacacaagcatggatcatggcaaaagagaaaaaggtgtttcataaacaaggatgcttggtatggccacctgtgtcagtactgtgaagttgaatatgatcaggacaaataatattaattggggctttatatttctcctttactacaaccgattaatgaaacaaaaaattaacctagcacccaaggtgtttcttatagttggtctctccagtctgttttagtatcatttgttagttatttccccaaactaatgtttagcttctttctccaaaaagaatatattttttttcctggttctgcttgttggaatccccccctccaccatgatataaaagtaatggggcttattgtaagaaaacagaaaatacaagaaaataagggacaagatttttaaaaatggattcaattctgggaacaacaaatgacattggggtataggaattaaaccgtgtgcattctgtctctcaccccaattttatagtcatttgctggggaccttttctccccagggtacttgcatagcttttgtcaagaataacccttctcacttccccacctccttcttctacatgcagatgcagcacttttctgggtaaagttttagcaatgccttccttctaaaatgaaagcattttctcctcacgattagcatctgtttatagaatagttcgtattttcgtaattagatcctgcatagaaatgcaaaggctgctgtgtaaaaggataatgaatctttattgcacagttgaaatcagatttgtgcaaaaggcactttgaaaacagtaataagcagagacatgtattaaatcacccagataaggcacccactttatattttctatttataaatggaaattatgactacccagtggattccatatgacatttcctattaccagcaaaggtttttagctttgaccataaaagttatctaaattcaaaagcctctgtggattcatggctctaagaatacttctggaaggggccaagacagagtggaaagggtcctttgtctttttcttttgtgtgtgtatgcactctgcagaggggaaggttagcaagtggtagaagaaagaagccatttgaaataaccatgataagatctaatcaggaaacccagtgtccattacacacatgtggtaacattttaagactcttctggttgggctccttgagaaccaagctcgtgttcttataagctcatccttatattttcccattgtatgcatcgttgcatggcaaacacaggatttattcccaagctaaacctgtctcttggggtttcttatcttttacctccttggtgagcctcgggaagctagagcattgctctatggagaaaggagggtggcattgggaggaagggtaggaaaaacattattgggaagcagagaaagtcaatgtcaaatgaactgccaaggatgaatattatggctgctgggagcctcggagagtatcgtgtgtcttatgtgtctatttcacagtcggtgcttcatgtgagatggcagtctcgcctggaccgtgcttagtatcgatttactctcaggcatgccagaccattttagcattgctgaaggaaggaaatcctatgtatttccccttataaacagacatatcaaaagtgtatcttttaaacctttttctttctgtcttcttactgttctttctgtcttactgtaactcctcctccctccctgatttaaaagaatttttttttttttttttaaaagaaaaaagactttctggccgggcgcggtggttcacgcctataatcccagcactttgggaggcagaagcgggcggatcacgaggtcaggagattaagaccatcctgattaacatggtgaaaccccgtctctactaaaaatacaaaaaattagccggatgtggtggtgggcgcctgtagtcccagctactcggaaggctgaggcaggagaatggcgtcaacctgggaggcggaggttgcagtgagccgagatcgcgccactgcactccagcctgggtgacagagcgagactctgtctcaaagaaaaaaaaagaaaaaaagaaaaaagactttcttattaagagagcattatacaggccaggcgcggtggctcatgcctgtaatctcagcactttgggaggccgaggcaggtggatcacgaggtcaggagatcgagaccatcctggctaacatggtgaaatcccgtctctactaaaaatacaaaaaattagcggggcgtgatggcgggcgtctgtagtcccagctactcgggcggctgaggcaggagaatggagtgagcctgggaggcggagcttgcagcgagctgagatctcaccactgcactccagcctgggcaacagagcgagactccgtctcaaagagagagagagacagcattatacagagaacaaattgagtagacttttttagaatgatagagtgtcagtaactactcatacctgtgggggaaagaaaaaggcttcaaactttgcacacttctagcccttccatgaaaatagaaggaccttatttgaggctagttttgtggtggtgggatctgagcactgctgagtgttaacaaaagggaataaattgatgccaaatttagagaccaaaaatgccatcattttcacctgcctgaactcttctgttgttttccctagttgctgccttgcgctttttccgcagtacagggagagaaatcagttgtctggctgtctaaactcacggcatctgcttagcagtttcaccagctcatagttgggactcatccctctgtcagaatcctttgctccattagaagggagactgggaccacgttcctgaattgatttgcatacttctacgttacctagctcagacaacatatggccatgtggagcacttggatttatttctgtttcctcaaattaaattcctaaaaaattggataactccacagtttgtttggtgttacaaaaaattttagttccttttttggtcggcaaagcaacacaattttggcattaaaaaaaaatctctggattactttaaaaagagtgttgatttgatttgcttcccctcttctcttacccctttcaggaaaaaaaaaaatgtatgttgaatcttaaaacactgcatcatgttgcaaaatgtccatttaggcacactgaatagaaagtatcatcgagtcatttttattcttgtaattcagtaatcttgtatcttttgcctttttctttttccttaatgttaattgtgtaactaaatgtctcaaacttgggacttttcactttacacatccatgtgtaaaaatacatagatacatacagtcagatagaagaaataagactcagtgttaatagatcagtggttggggtgggggaactatacttaacaatagtatgttgtacatttcacagtagccaaaagagaacaattcaaatgttcttaacataaagaaaagataaatatatcaggtgataggcattctaattactctgatttgatcttcccacattatataaatgtatcaaattatcacgtactccccattaataatactgtatatcaacgaatttttttaaaaaaagaaatagatatcatacaatgaataactggattaatgtgaaatgatagaaaaagttaccattttaggctggatgtggtgacccacgcctgtaataccagtactttgtgagtctgaggcagtaggattgcttgaggccaggagtttgagaccagcctggttaacgatacaagaccccctttctaaaaaaaaaaaaaaaaaagccaagtgcagcagcatatgcctgtagtcccaactactgagggcatagaggtaggaggatcatggatcactggatcacttgaggagtttgaagttgcaggaagctatgatcctatcactgcactccagccgaggtgacagagcagcaagaccctgtctcaaaaaaaaaaaaaaaagttactattttaaatgcacttcaactttgaacagtactaatgtatgaaaatcatcttgtcttctttaggaaattctttgttgcctaaattagggataggtatcatacactggaatgagctctaaaacgatggctcttgctatgggaaacagttttatttgggtactcatgtcttctctcttaagggatcttaggaagaggctacatggtaaagaagaaatagcatgggctttagagtcaagaggcctgagttttaattctcaggctttatttgtccttctgcagtggccttagcaaatattataacctccctaaagttagagttattgtaattgtcgtacatacaatgttatcataagaaaacagtgagataacagatatcaaagtacctgggcagtgtttgacacttggtggtctataaatataaatatcatttcattcctgaaggtaactgcagcacttttgaaaggctggtttgatgctaacacaggaggattagacctaattatatatttctaaggtcttagaaatggggagctaggtttttcagacaatatactgtattttgtttttcctcccttttgctttaaaacagaaggcaatttgtttcaaactctgtgctccaaactggtggcttaattaggcaagtttattgactgtcacagaggctgtggttaaaaactggcaaatatcatgtgactatattagtatctctgagcaaataaagggaaaagacaggattccacccaaccacatttttttctttctcttttctcccaagctcattcttgcactgcaacattccacttataatctgttaattaaatcatttcactccattttatataatttttaatttagcattcattttcaacttagcttttggcttcatttactgataataaacagtgttgcatacaacacatgttccacaaaacactcagtcacacacatacagatgccaataattttttccagtatgtcaggcatattaaaattaaaggcagcatctcccctcaccctttccattactgaatgtgcaccctgtttgaataatacatactccccgacagccagcagtggtctaatgtgtaaaaattatgtgtagcgtgtcactagtacctttttttaaattcgtggttttctcagacatgctctgtggaaggtttctggaatggtcacttcgataccttggatctgtatatttggcttaatgtatacaaacagtaatattttctagacttattactttatgggtttatagctatgtgatagttattgagaaagaaaactctagtgtagcattcaaattacttttcttgtagcttattttttgaatcatagtctgaattctaaatatatgaatatctttaaccgtagatgatatccagaagtttccaagactgcaagctcaggggtttatggaccacttttaaaagatagatactaagccaggcacagtggctcacgccagtaatgccagcactttgagcaagcaagatggactgatcccttgaggccaggagttcaagactagcctgggcaacatactgagaccccgtctctacaaaaagtacaaaaattagctaggtgcggtgacatcttttagtcctagctactcaggaggctgagaggagaatcactggagtccaggagtttgaggctgcagtgaggtatgatcatgccactgcagtccagcctgggtaacagagtaagaccctttctctaaagaaaataaaaataaaacatagatacctgtgttgttgttatagctgttcatatccttagaattaatttaccttgtctgctcctgcatattatttgtctcctcataattagcaaagttccacagggccagatatcaccaaatatgaatagtagattttattctaaggtcagtgagaactgaagaatgttaggggctgactcaatcagatttgtttgtatttatatttggaaaaatattactctccggagaatgttttggaatgtttggcagggtggttggagagacatactacaggaaagaaatgatggtaacttagttggcagtgggaaaagtgagtagtgaattactcagagctctttgggggtgaaatggactggacttatatcagttgaacttgagaaaaggagaagcatcaaggatgatgtaacttttaggtttctggcttgagcagttgtgtaggtggtagtaatttttcatggtgaagatgatgaaatactttttgtacctgtctcatgattgctttctgtacatcaaggtcagaggtcataagctcataaaatgcttggtattagaattcttacataaaggatgtcttctgttttagtttagtaatacaatttggcttaaatcacagactttctctaatctttgttttgattgtcatctgccgagagcttaagacagcaactcacaggttggcccattgagaatctgacaaatgaaaaattataaaaaaaattcagaatccctatattgtagcccaactttctttagcacttctatccttgaatgctagggcagtgttgtatactgtgaagatctttgtagatttttctactctgtaacattttaatagttccattttggggtattacagctgttcagtcctccccatacctcaaattatagttagtctccttcaagtcccaaatttccagtgtacatatgtttcatcttatgtttaatctggacagagtgttggaacgaaatatggaccctgaaaggtgtatgacgggcttgaagtctcagccctactacttgcttaatgtttgatttgctaatccaaacaattataatctgttaattaaatcatttcactccatttcatataatttttaatttagcattcattttcaacttagcagatgctcctggtgtcccacccatacccctctttcccttccactttagttcacaatggccctccttcctcccgctaggccttatattcattcatcttcagggtttgtctagtcaatgaattctgctttgcctaaggagtaggcaggaagtaggtgaaatgaactgctacctgagcaacccacagtcaatgactaatgagagttgttgtataaatacaccagcttccttgcttcttaagtgggataactttgaggtatacattctacactggcttccggagtcctcccagtggcatttgcttctagttgcccatagtggtagttggctgaataattacataccctttattccctgtctgctgtcatgatcttactttcccagtctcctgctattgtttacctcctaaataaacttctcattgtctgcttctgggagaaccccagactaagacaaccactgcgaacattggtttcctcatctttatttattattactgttttttgagacagaatcttgcgctgtcacccaggctggagtgcagtggcacgatctcagctcactgtgacctccacctcccaggttcaagcaattttcgtgtttctgtgggacgtcttacataggcgtattttttttttccggctactaccactatttggactaattattctgaaattttacttgccaagtttcagcttttattagcaagaaaaaatgttatgtccacagtttagaataaaatcacagagaagaaaagttggatgaggatattggtttgcagtcttctgtctgtgtttctgtcttctgagcattcacagatgttcctatccttctttccactggtgttcacataacctgggatcttgtgttgtatgcagtcactctcaaggtaggaactggaagataaagtatgtgggtgacatggactacttagaaggaaactgaagtttacatgttgagcccaattagaagcagctgaagagaggagagaaaaaattaactgagaagtttaataggcacttagagcatggcgaataaagctgagtggcacccacttttcatttcctagttcattctagttgtgcttttttaactgcaaagactaaaaaacgaaagcctttatttcccagtctgtcttgcagctaggattctgggtgtgaatcaggtatatttgctcaagatttggaaggtcgacatgaggtaaaggttattcatcttcagctttagctctttttatctgattagccagggcaggagaagtatgatttttctgtggtgatgtttcagttttcaactcagcttcctagatgttgaaaggcagttatgatgcgatttcctgatcccaggttgcagcttcgctagtgcatttgtagctgggctgctgcaacaatggacttctgtttatggcagaagaaaggccatactttaaccttgtctagtgattttttgtaagaggttggttctctgtattaaatcacttcctacagaaaatttcttaagtgttttctggtttttgtttgtttgtttgtttgtttttaccagaaccctaactgatatagatggttgaagcaaactttatgctgtaaaggtccagacccagataaaaacgagagacaggaaagatgcagcaagatggtctgcaggcctgcccatgcatacactactccatgatctggtgtctgcaagaaaacaaagcaactgctcattaagtaacagggcagctaatgctttagctcttgaggccctgtgtcatataacttctaattcctctaattcatccaccaagggggcagtgaggcagttctctgtttgaatgctacatcgtttctgacttagtgctttgaagtggatgacatcttacttttttttcttatcttagagataaggtgaacagaggaaaaggagaatgatttgcccaacctttggctaaaggagaaaggaaagatttagagtccagtgcttctgacttccctctgatgcggtaacaaggataatatgagtatctaatatgctggggcacagtaagatggctctgaaggtatgcacagtagagaaagccatggtccttgccctcagggtctgtgatcggccactgaggcacacatttccacttcctgtgttccattaattatgctaattttccaacaagccccagccccacctctgtcaattatttttgtctcagccttctaattacaacattatatgaccattcagactggtactaattaaatcattacttaattcacaaagtgtgcgataatgctaatgcttcttgtcagctgaaattacaacatggcacctactttcttcattcttggtagatggggccagggggttgctcttttaccaaacatcttttgcttaccctctgatagccacctgaccatcagccagaacctaccttcttccagaactgggaaaacagtgcagtagacctagcgatatgtacctgtaattcatcactatcatatgaaatcatcatcccagttttgtttgtggagtaaatcttgatactcaagaaaaaaaaatagtagtaagatttagagtactatttgctacattttttgtcatttgttctgcgtattatttttaacagagtaaacagtagcttgtctctttttctcatttctaaaacagatttgttttccactcaattagacttgtgatcacgagaacacaaagtagtatttttctccttctggagagagacataccgtatgatgggcaaattgtcaggaataattataccaaatgatggaataaaatccaatggaaaacatctctctcattgctagtgatacatttttatttaagacacaatgagcatcaagcacatttatgacaaggtgaaattgacaagtggccctctgccatgattttatttttaattgctagtaaactaattagccagaacaacatgttgtataatccacaaaactgtcgctcatgcgttctccaataaaagcaagatatatgatgtggaaaagttctctaagagctagccaaaaaaaaaattatttcagaattttgagtgtatagacatcacagtaaaagatgtctcctcaccagtggaagaacatttgtatataacatttgttttgagatctgaacagaaattaaggacaaacagtaaatttttttcttttccttttttttttttttttgagagagagtctcgctctgttgcctaggctggagtgcagtggcatgatcttggctcactgcagcctctgcctcccgggttcaagcgattctcctaccgcagcctctcaaatagctgggattacaggtgcttaccaccatacccagctaatttttgtatttttagtagagacagggtttcaccacattggtcaggctgatctcgaactcctgacctcttgatccacccgcctcggcctcccaaagtgctgggattacaggtgtgagccactgtacccagcctgttttttccctttttaagatcaaagtatgcatcaaaatagccaaccactttcttacatgtaattaagttttatgtagttgagtcacattaagtctaagacatacattctaggactaagactttacagtcattcagtagttacttatttgtgcaaggcttggcaaccttttcctttaaagggacagataatacatatttttgtctttgtgggctgttcagtctttgccacaaccactcagctctgatgtagagcagccgcagtcatagataacgcaaaaataaatgtggcagtgttccaataaaactttatttatggacacaaaaatttgattttatgtaatttttatttgtcacaaaagataattctttgatttttttcaatcatttaaaaatataaaagccattcttagctcatgggttatacaaaaggcaggggtgtggatttggcctacaggctgtagttgccaacctttcctctgtacctgctgcatgccagcgtcactcctcattctttagtatcagacgtgtgttaggcagggtgctaagcatcgagggatattcagagatagagcaaagtcccttccctgatgaagcttacagttaagctagaaaggaaccatagatgggacagagacacataatattagatgttaaatggtgtccctctgtgacaaaagccaccattgctttacaagtttaagagagagggaagtcacttcagctgatttaggtgatctgctaagtaagacatgacctggctagctacggatgcatggaaatgatgggatatcagctggatcctgaagaaaaaggctgtggacctttgaaaaggtaacagggcataatgcctccttttagaggaagggggaactgaggatggcgaaaatgtcaaccatgagtcacttattcctatcatttttcccccaattctttctttcatgtcttctcatgaaaatttcaaacatatagcagttttaaagaatgttacagttaatacccaaatactcaccatatagattctaccattactattttgctatactgttttattgtatatctatcctatcctcttttgttttagaattctggtctcgctctgtcacccaggctggagtgcagtggtcactacagcctgcaactgctgggctctgcctcctgagtggccaggaccctatgtgtgtttcaccaccatgtttggctaattgtaaataatgttttgtagagatgaagtctcactatgttgcccagagtggtctcaaactcctgggctcaagctgtccccctgtctcagcctcctgcattgttgggattacaggcatgagccaccacacctggctgctttattatatatctgtccttctgtctattcattaatccattttatttttggtttattttaaattaaatttcagacatcaagatacattttcataaatatttaagcatgcatatcattaactaaaatttaatgttggcttatagtttttcttcttttggtgtaaaatttatatacaattaatcgtaccaacattaaatgtacattctctgagatttggaaaggctgatccttttgtagcctaaattggaagatacataaagttttcatcacctcaggaagttccttctgtcagtccttgcccccagcctacccctggaggaaccactactctaattttctctgctttaggttagtttgcctgttctagaatttcagagaaatggaatcatacagaacctatcattcggtgactcacgcctgtattcccagtactttgggaggctgaggtgggcagatcacctgaggtcaggagtttgaggccagcttggccaacatggcgaaacctcgcctctactaaaaatataaaaattagccgagcgtggtggtgggcatctgtaatcccagctactcgggaggctgaggccggagaattacttgaacctgggaggcagggattgcagtgagccgaaatcatgccattgcactccagcctaggtgacaagagcagaactgtgtctcaaaaaaataataataaataaagaatctatcatttgggtttggctttttatcatcatatattttgtctttacttgcttagtatctagcaagaatataaatgcaattattttgccagagaaaagtatatgtttgattaaggaaaacataaaatacaactttgtttaaatatctgtatgtatattcttaaattattgtaaaattaaattacctatggattaaatttttcacattaacattacttagtctattatgctccagcattttacatatttatgttatttaattaaaatctttgcagtagatatttcccattttgaagaagaggaaactaagacagcgaataaaataataaacaatattatttcttacctcttactgttgccacttcagtgtcagggaggaagagggatagcaaatgtaggaagggtgtttgcaaggtgagtgaaggtgaagctgctttgttacaagttttcttatcaagaaatggatagaacataggagtagagaagttcaataggaacatgcaaaatttgtctattgtaaaagaaggaagaaaactggagaatttaaggactattttttaacatctatgattaaaatattatgaaacaatatctttttaaaaagtgatatttttcctctagtataacacaagttgttagaaactaaggaatcaccctatcttctttagtaaaagcctacaactggtagagtttttttttttttaaggatctcaagatacttcatgaacctcaaaagactttaagttctctgcaatgttaggaaatgacttcatgaatatcacagttcaaggttctgctactgcttttagaagcccccaaagtgtgaagacatctagtacagtatacagtaagaggagaactggcttttattgctcacaataggaatgttcccatctatctgtttgcaaaccaactcataaaatatttgaatattcttcactctgctttatgataatatttcttggcttggaaatttgctttttttttttttttttgagacaaagtctcgccctgtcacccaggctggagtgcaatggcgtgatctcagctcactgcaacctctgcctcttgggttcaggcggttctcctgcctcagtctcctgagtagctgggattacaggtgcccgccaccacacccggctaattttttgtatttttagtagagacggggtttcaccatgttggccaggctggtcttgaattcctaaccttgtgatcctcctgccttggcctcccaaagtgctgtgattacaggtgtgagccactgcgcctggctgaaatttgcattttcattaatagatcatccttatttaacaatgaacttcctatgtgtttgtgacacatggaaaataagtaggcagcatttaatgtcatttgggaagcagtgcttatagtagttcggtttacattcctcatacagccatgtgccgtatagtgatgtttccatcaatgactgcatatgcaacagagtcccacgagattataatggagctgaaaaattcctattgcctcatgacatcatagcctggtaaggttatagtgcaacaaattactctcacttctgtgctgatgctggtgtaaacaaacctactgcgctgccagttgtataaaagtacagcatatacagttatatacggtatataatacttgatagtaaaagactatgttactggtttatgtatttactatactgtaattttacacttattttagtgtagtccttctactagttaaaaagaaaaaagttaactttagaacatctcaggcaggttcttcaggaagtatttcagaagaggcattgttatcataggggatggtagctccatgcatgttattgcccctgaagaccttgcagtgtgacaagatgtgcagctggaagacagtgttattgatgatcctgttcctgtgtagtcctcggctagtgtgcatgtttgtatctttgtttttttttttttttggttggtttgtttcttagaaggggtcttgctattttgcccaggctagtcttgaactcctgggctcagtggtcctcttacctcagcctcccaagtatctgggattacccacatgcaccactgcacctgtctgtgtcatagtttttaacaaaaacatttataaagtaggccatgtgcagtggctcacgcctgtaatcccaacattttaagaggctgaggcaggtggatcacttgagcccaggagttcaagatcagcctgtgcaatgtggtgaaatcttgtctctacaaaaaatacaaaaattaagtgggcatgatggtgtgtgcctgtagactcagctactctggaagctgaggtgtgaggatcacttgagctcaggaagtagaggctgcagtgaactgagatagtgccactgctatccagagtgaagccctgtctcaaagtataatacaatacaatacagtacagtacaatacaatacaatacaatacaatacaatacaatacaatacaatacaatacaatacaatacaatacaatataataccatacaatacaatttaataaaagaaaggttatagaatatggatataaaggaagaaagtatttttatacagctgtacatttttaagctaaatgttattaaaaaggattcaaaatttgaacaatatataaagtaaaaaacattacagtaggctaaggttaatttgttattgaagaaagaaatttttaaataattttagtgtaaccaacatgtacaatgtttataacatctacagtagtatacaataatgtcctaggccttcacattcatgcactgctcactcactcactcacctagagctacttccagtcctgtaagctccattcatggtaagtgccctatacaggtgtaccattttttaatcttttatactatatttttattacgtcttttctgagtttagatatgtttagatacacaaatacttgccatcaggttacagttgcctacagtattcagtacagtcacatgcaagtttatagcctaggagcaataggttatgctatgttgcctaggtgtatagtaggctataccatttaggtttgtcgaagtgtattctatgagttcatacaatgacagaatcatctaatgacacatttctcagaacatattcccatcgttaagcaacacatgactgtgcttagtcttctacacaggcttagtcttccttgttaattgaaactctatgtttcttctcagtttaagaagcttatttcaggactaattttcccccttttagaataagtttcccacatcacttggttacatgacaaaacaagttaaatcactgtccctttttgggtttaatatgtccagatgcaaattaaagaaataaaatcccttagatttttctgtatcttgtctcccttcctcattttctgcagaacagtttttaaaagttaatttaggaaatctccaaaatattagattagcatgacttcagagctataaggttcctgaaaagtttatgtagaaatgttgtttttagtgctttaatttctcttatagcatcttgatgggtagtcattctgcctaaaggagaactgaactcatcctgtgtcccaggagctttgtcatatgaaaagttgtaatccattctggtgcttcagatgttgaaggcccagtgaaattctacaagatggctgccacttgagctttggccttgcaagtggttaggaagatgttggtcctttaatctctgtacaggggttcagaagtagttgatagtttactaatgaaaaatgttatatgtagcaaaacacaagcaaaaaaatcaaaaacactgatgacttatataaattattaacttaaggaagattatggtacttgaaaaattattttacaaaaaaagattgtattaggaattttttctgctcttttttctcaagttagtaccaatgtaacatggctgtgttcatgtaatttcttttctcaatttggttcaagatttgtgtagctcccagtggtagattttgcggttgtattgcatgattaaagtgtccatcaaaatcttacagttggtaaacagtattaaaaatccatctccagcctctgtaaactgtacagagagctatgaatactagaagaaatggaagtattttaattaacccaagtaggactaatcaaagcagagcaaccagtttattcaattgaacatgtaaatgtctattcattcttgacatggcagaacatttatgtcatctattaaaagctattctgttgcttgtatgattataagctattgttcaacggggaactgaatcttgtaaaggcttccccaccccactttttgtttttttgagagggagtctcactctgtcacccagtctggagtacagtagagcaatcttggctcactgcaagctccacctcccaggttcatgccattctcttgcctcagcctcagcctcccaagtagctgggactacaggcgcccaccaccatgcccggctaattttttttttttttttttgtattttcagtagagatggggtttcactgtgttactcaggatggtctcaatctcctgaccttgtgatccgccctccttggcctgctgaagtgctgggattagagtcgtgagccaccatacctggcccccccttttaataattacatattacagattattttttaacatgctttttgctgtattcaggccacttcagataacccagcttcttgcatgaaagaatacagacttgggtaacttggttcagctaccctgccatcacctctttccttcaaagggttttctcttcttcatttcttcataataattcttagtaaatatctactacatgctgggtacatgtattctaagcatgttatatgcagtatatcatttaatttttgcaactatattgttattttttccattgtatgatgaagacatggaggaagagtgttgcatagtgctgtaagtggtagaaataggatatgaacacaaatctcagaagatccattgtgttgaaatgaatttgagttgtaccaaaggtgattgacattagacaccaggaagaaatttttgaaatgagtggatgctctaaggagccttttaagtgagtacagctaaaaggggttggggtgaaggtagtttcctgggattttttattaccattaagacacgtaaaaacagtttgtataaaatcccatttttcatgaattagttacattcttaccttgagccaggaagttaaactagatggctgtctgaagacccgggtaatacatttaatacagtcttatatgtgtataaaaagtggaaacaatgattcttttaacttttaaatatgaatttttattgcaacaacaattagaaaatataaataatacttacacccctgccattctaatgtaacacttagttttgggcctacttttttctggtcacttttctcatgcatttaaaaaaaaaaaaacaacctttttaaaggttttaaaaacgtttcttaaaatgtagtgtattatatttatgcccaaaaatctatccatgttaagcatataattcaatgagttttagtaaatttgcagagatttgtaaccatcaccacaatatgatacagaacatttgcatcattccagaaaggttcatgagcagtctctcttcttctccattctttgatttcttaaggtggaagtgtctgttactggtttactgtttcttcctttccaacataggtgtttatggaacttctttagctgaagtcatgaaaatttgtatattctatttttatttctattccgttcaaaatatcttctgatcgctcatgtgattcattctcttaactcattggctatttagaagtctattgacatatttcaaaatatttgtgaatttcccagattttcttgttgtttgtttctaatttaattagcaatacagaaaatatactttatgtgatattagtcattttaaatttatagatagttatggcctagcatatgatctattttgatgatgtaccatgtgtgcttaaaaggagtatgtactatactcatttggggtggagtgttcttaggtcagtttgtttgatagtgttggtcaagtctactatattcttgttggttttctatctaggtgtcctgtttattatttagagtggtatatcacagtctccagttatttttgcattgtttgtgtctccctttagttccgttagattttgctccatctgtttcggggtttgtagttaggtatatccatgtatatcattgtatcttcttggtgggtagacccttttatcattataaaatctctttgtctctagtaacagttttgctttaaagtctgttttgtcggacagtattctctctcccctttattattaaactacatttaatttgtattaaactacatttattgttcacatactgtttttcaatcttttttaaacttatttttgcatttgtatgtaaaatgtatcgcttttagaaagcatatcattgggtctcttttgaaaaaaatccagtctaacaatctcttttttttgaattttaaatttatttatagttaatattattattgatttgattggatttatgtctccattttgattttcatctttttttgttcagttgattttcctttactgcttcttttgtaactaaataggtgtgttttagtgtatcatttttattacttagttcatttttgctctatgaaaatatttttttctgaatgggttagggtttatacatgcattctaccttaacacagtctattttagtttaatactgactttgtattaaactttgtcagtttaataatgactttgtattaaagtctgtgcagtagtatgcacaaactttgcttcactatagatccatgtcaccatcttttatagctattattatcacatacatctatatatcttatatacccaacaatgcagtattgtaattattgctttgtataacctatgcttaaagaagttaagacaaagacaagaaaatagaaaaatgtatgtatgatttctttcaacatataaaaacctatatgcttactgtttccattactcttcattttttaaatgtggaattgatttatggcttggtagcatttctttggcacacataactatattctttctctctttctttgtgctactattattatatatattaatctttctatattatatgtcctacaacacaattttacaagtactgatttatgtagctcttttttaaatcgttagagacaagaaaagacaaaaattatatagcctcctatagttacctacatagttacctttaacaatgtttatttttcttcatgtggatttgaattaaggtctgttgtcattttgtttaatcctaatgaactttatgttttgtaaagcaggtgtgctaacagtgaattctttcagtctttaataggggatttcttaattttgccttcattttgaggaatatttttgctagatacagaaattttggttgacatctatttgtttctttgagcacttgaagacatcctcccactgtcttctgccttccattatttctgattggaagttggctgttcatcttattttgggtgccttgtacatagtgagtcatttttacccttgatactttctagatctcctctttttctttgcctttcaacagttatatatgaaatgtgtagatgtggatctctttgtgtttatcctacttagaattatttgataattttggaagtttagattaatgtttttcattaaattgggggaggtttttaccattatttcttcaaatactttttcagaacctttttctcctcttcttggaatctccattatgtgtgtgtttgttatatttgaggtgtgctacaggtctgttatgttctgtttattttcttcattttttccccctgttcttcagatttacaacctggatcaatctgtgttgaaatgcactgattctttcttctgccgttcaaatctcctggtgaggttctctagtgaattttttatttgttactgtactttcagatttcagaatgtccaattggttctatttaagaatttctacccttttattgctattctctatttgatgaattatgacatcatgcttcccattaaatctccaaactttttcggaaggggatctttgaatgtgtttataacagctgatttgaagtctttttctgttgagtccatcatgtaggctccctcagagatagtatctattgacttttttttccttttggaatggtaaaattttaattttttgcatgcctaatatttttgctgaaaactgaacattttagataatatattgtagcaactgtataatctgatttccccatctcttccctcacacatacctagagttaatggttgtttcttttttgttttttgtttttgcttgttttgggtttattactttagtttcttactggaatggttctgtgcagcatgtttccctcataatgtgtggctgctgttgtctctactccattgagtttgccaccacccttaccacttatataagcctagctttctagggaccacccctgaaatcaaaatagttgagtgctcagttaaagattggctagagattgtatctaaacacttagaacccctaaatcactgccttctgcttttatgatggatccataaatgatttggggaatgaatcagcagtcagcctatttaccagtctggcccaaatcttaatttttgtgttgtaaggcctcatgctcagcagaaataagtagcttactaaggctttctgcaggctctctgagcaagtgtgcagctttgtgcatatgcacagctttccaggccatcagagataagtaggatcgcatcaatgccctctttcagttcctggatctgcctattaattttctgactggcctactggtttgttgcttgcttcagtcagttatgagatttcagggtagctgcagtgttgtcctttcctgattgtttgcattaagatcactattgtttttgacaataccctttgtcatagaattttccacataaaatcagtcatttctaggatcagagccttcatcttcacagcacacccaccccgacagcacttctgcatcaggaagcaggggtggaactagggagtgggagtagcaccgcactaaagtgctatagactctcactgttgtcaatgaggttcggtgagttttcttgaagaaacacttctcagtttattgcatgcctttggtcaatttccagtgtcctttagagattgtttttgacaattttgttctgtttcattgtttatttttgtggcaaggatttgccaacctcctcactcagccattttggaaggtctgctgtcttgggtatgttgttgttgtttagaaacatacatgctacaaagtacactcttgagtatacagctaaagatttcttacatgtgaaaacacactcgtaatcaccacccagattaagatacaggacatgtccagcacccgttaatctttccttcctagccttctagtttcatcccagagttaaccactgtcctgacctctgtcattacagattactttttgtaatctgtgtggtttttttgttttttgttttttgtttttgagacagagtctcactctgtcgcccaggctggagtgcagtggcacgatcttggctcactgcaagctccacctcacaggttcacaccattctcctgcctcagcctcccgagtagctgggactacaggcgcccaccaccatgtccaactaatttttttgtatttttagtagacacagcgtttcgccatgttagccaggatgatctcaatctcctgacctcgtgatctgcccgcctcagcgtccaaagtgctaggattacaggtgtgagccaccacacctggcctagatatgaggtttttttgtttgtttgtttgtttgttttgttttttttcttgagacagagcattgctctgtagccaggctggagtgcagtggcgcgatcttggctcactgcaacctccacctcccaagttcaagcgattctcctgcctcagcttcccgagtagctgggagtacaagcatgtgccaccatgcctggctaatttttttgtattttagtagagacagggtttcaccatggtagccaggatggtctcaatctcctgacctcatgatccgcccacctcagcctccctaagtgctgagattacaggcatgagccactgcatccagcctataatctgtgtgtggtttttaaacttcatttgaatgaatatttaaaatatgtcctctttttcctctagcttcttttactcaacatagtaacttttgaaatttatccatgttttaggtgtagcagggatttttaattttttaattgttgtataatactttattaatagatatgccacagtttccttattgtgggacatttgggttatttccagtttgtggctattattaatgaagctgctatgaacatcctcctctttgtctttctatgagcatacatacgtacagttttaacgtggtcagcaacataatgcatgtgtaatttaggctcttgctcttttttttttttgagagacagagtcccactctgtcacgcaggctggagtgcagtggcacgatcttggtgcactgcaacttcccccttccaggttcaaatgattctcgaacctcagactccccagtagctgggactacaggcgcataccaccatgcccagctaatttttgtatccttagtagaggtggtcttgaactcctgacctcaggtgatccgcttgcctcggcctctcaaagtgttgaggattacaggtgtgagccactgcgcccagcctggggtcttgcttttttaaacttagcattatatcaagtgtttttccttatctctgtcattgtcatgacaagagtcattattttttcaggtaggtataccgaaagctatttccatttctatttttagaaaaagtcaaaggcctgtatttaataattactcttgacaacacaggtagcagttgatgctcaattcaataaatatttgttttcaacttttaaagaaaaactccagaatcgtatgctttttaaaaatagtatttgattgaagattaaacaaaacttactgctttttctgccccttgaaatgttccataactctatgcaattcacatattagtagtatcactttttaaatgtacaaaagcagacattactgagagccttggcctcaaaacattcatttgattgcctttctttaaaaacatatttcatactgggttatggaaaactcagcatttggttttggatataaataaagccatatgacctttcatatttaggagctgaatccctcttgtagaaacttgtgatgttgctttgcccactttcctaccctccctaccacgtcatccaacacatgtgcacttatgctcattcacatacacctcgcaggctctctgtgtcctgggacctacacttcacatagtacttggaaatattttctcttgaggaaatggatattagagttgcaatggtataggaactgtatacgtttttcctatctatactgtggtttttcttttcaaacattgtcgagatttctgatggataacagtagttgtgaaagacacaaggagaatgggagggaaaggaattgcttaatggacctcacataattgtgactatgactccaggtctgctgcgtttagaaatggaattgcgggcagatacatttgtcaaatttaacttaatcccttggcttttatctgatgtatatttttccattaacacagtatacctttcatctctactttcacacagtcaaacagcgtctaatttttggtggactttcttttcttcttttttgatgctaacattatccccgtagggtcctaatcaggttttagactatggagagaagaccataagaatcaccaaagcggaatttcccattgctggtaaagagatgcccaagatgcagaaggcttgaaataaatcgggcatgaaataagtggcgttacagccctatactggctttaccgcaagggttaaatttgctcagtgtctgcaatttcacctttcctgattgtcatacagagtgagatcattgtccaaaggttgatcatgtggaggatgtatgtgcttttgaagtgatcaaactaaaagagaaaacaaagctcatggctgaagtcatcacacctgaataccatcttgtgatgtcatggttttattggtatgaattctaaccaagctgtgggcatttaagtcatatttgtggatcagaagccatagatatttgcgcttctcataggctgtgcttttctgatactttgatcattattatatggtaactaacatatattaatatattaatgtattatatcatatttatttagaccccagtatggatactaaatgggataaagcatatgccaagattttttaggtcttgggattatttaatttttttagaactggcgttcattgattgtcattcacgtttctcttcacttccttatgaaaagtttctcaactcttctctcagtattttcttttcccctgtgagatatgtttccttttacactttttcattcctctaccaaatagtaataattgcaaacatttattgcatgtttatgtgtgtaccaggtgctatgccagttgtttttatgtgtattttctcagttgctgtcttaacggctctgtggtatttttatccttggtttacagatgaggagactgagcctcttttggtctctttccccctttaaagataaactcctcctatctccttaaactgagcttgtaacctggacctctgattcaacagcccacaccccaatttgtatttggctatttgtattgggctatttgggtggtggtcctttgaatgttgttgtgctaatggaggcctaaacgttgaatcccgtgaatggaaacctcttcacatctttactgcttgtcctgggatcttcacacctggaatattgatcttcaccgagtaatttgggaaaaacagaggcagaggctggaagctgctcaccgtcctatggcagggcaggtaatgtccttaatgagatgggcttattccagtggagcagtggtggggaagcaaaagcttggtgttctctcctcatggttgcgaaaatattcacataaaagattcactagctactgttaataattgaaggactttcctcaaaatccatgtattataacggtttaatatactaaaatgatttggaggaaatcggcctcagcattggtgaatgtgttgacatatgaagctattatttttataattcttattttagagatggagtctcactgtctcacccagcctagagtgtgttggcaagatcatagctcactgtaacctggaactcctgggctcaagtggtccttctgcttcagcctcctgattagctgggactgtagtcacatgctaccacccatggctaattaaaaaaaaaaaaatgtgtggagacaggatctgactatattgcccaggctggtcttgaactccgggcctcaagtgatcctccagccttgtccttccaaagtgctgagattacaagtgtgagccaccccacccaacctaaagttgttttaagcttattgtgtgcatgttggttgtgtcaccagccgggaggggcttataggctgcaacactgttttctttcctatactacctttattatcacgtaataactaaaatacgtactatctgtttttaggtggatgctctgcttctcttgatagatatgaaagcaggatacctatcttccacccctgtgtttttcttttttcttttcttttctttttttttttgagacagagtctcacactgttgcctgggctggagtgcaatggtatgatttcggctcactccaacctctgcctcccaggttcaagtgattctcctgcctcagcccaccatgtagctgggagtacgggcacccaccaccatgccgggctaattttttgtgtttttagtagagacgggggacgtgatttcactgtgttggccaggcttgtctcgaactcctgacctcgtggtccgcccaccttgggctcccatctactcagatgtcctgtcttcacaggggccctctttgaccaccctctgtaaaactgtactcatattattcactattctttaccttgaccctgtattttcttagcacttatcactattcgatataacattttatattcttcaccaccaacccagactagaatgtcaggtccctgaaagtgaggtatgtgccatactcaccactttctccccagtatccagagtggtgtgtggtacatagcgaaactcagtaagtattattgaatgaatgaatgaacacagatgactagaaaaatttctagaaaattttaaaacatgggcatattagccatgaatttaatttatagttttgttgttttcttttgggtattcaaaaatataatttcatttgtttatatctctaatgagatagtacagtatttgtgattcttctagtgtgatggcatgtacagtttcattggtgagtatatgtgacctactgtgccaggtggaaatggagtgaatgaacattttggggggaactaaaaagcaattttcaacctttttgataagctaggttaatactgtcttctcaataaaaagtactttttcttcctcttataatgttcatggtcttcatctgtatgtgtatattgccgatttaggaactaaagccgaaatggatctcagactatttcccacagactggtagctgtatcccctctgtcagcaagtatttgatatcttcagtgaaaattgtttctttttccacttttagcttctgtttagttttacaagtctaaacaatttttggcaagtgctaggggctcacctgatgcactttttaatgcattccactcctcgttgttattttctctgtccagtacacatggtgctccttccccctcattgccatcccactttggcagaaagcattatggatgctgtgtatgtagactcatcacccaagccagcatgcatgggagagggggcctctagaataataattgttacttggtgttctctgtactactctgtttaatctccctgcttaccacttactgccttcgtaaagtaagctcaatacaattatttattgcaatttgtgtagaatgtcagatgtggaacagactttgcacactcatcagatccagcccctttgttatttagatacaaagactgagccctcagagaggagtcttgcactagactctagacctcccttgggcaggggactttcttgttcactgttgattcctgcttgtctaatacagtgtctccatgtaataggtgctcaataaaaaatattgcatttttcaaagtctcatatgtaagtagtgatggcagggccagaacttgaaccttgcatctcctagttatttgttcattgtcactgccacaattatctcattgtagtttaaagagagtcagcttccagtcttttaaaatacaattacctttaattcatctgtggtaaacaaacagcagctgtctctcattggcatggccgcagttccaccactgagcaattctagaaactgacactattaaccattctgctaaaaaggactcttctactcatatgatatcctggctgtgtccaaagtgtaatatttaattgcattttcttaatctttaccactgtattgctaagctttctaataccttcaaaataccaaatctcaggcttatcctaattaaagaatctcaatttaatccataatgcatgacaattcaatttgttgattgctttttctccccctctttgtgaaattcccgtcaaatgtattaattcaacatgatgaatcctgtattcaacccactggagtgaataattaaaattagctgataaaactttcagcagaattactttgtgaaattgctgaacagatgtgtcattttaatgaaaatccacagacaagctccttctccccctcggcaggataaaaatattatcccctcggcacatacttaatttggtggtaaatacactcggagcgattgctggaagggaagaaaaagcaacttgtcacacttagtaacttgatttttccccagcatgcagtaacagctatctacagtaattcatagtgctctattgttgctgcaagtcccaaagagaacttattaaaatgcaataatctcctatttaaacagaaacaataaccattaaatttcctgtggatccaaaattgagcacaagccccatctggtaagagtgattagaggcctgatgagggaatttaatttgcaacattcaaagactaaatctgagcagatcttgtcacctgggactcgagtgctgcttgctgtcttcttaaaaatctcgacctaaactgaaaatggaatgtagaagtgaaaatgttacccaggggccacccccaacagtattgtgtttcattatgtctccagcaggcctagtgagcagaggggattttagtgctgtccgctttagctttgccggcaaggccttttgacaggaccaacactaatgctgtcatttcctctactgccctgtgcatctgtcatgtggctgcccctcttagatcgtggactgcctgctccctcccttcttatttactttcctcttttagcttagcaagtcctctctctaactttaagagttctctagatctcaccagtctccctttcctgtccaaggagtcagatgctttcagcaggctactttgagcaccactgtatcatgctttacattttatgtctcctccttgcctatagacagtaccccctctgagtttattattagtgttttttttttaactgtaggaggactaagatttattgcatgttattagtaaatacaaattgtcattttcctcctcttcttagcttttctcttacaatcccccaccttatttatattacttctgagctccagagaaacaagatatgcgtgcactcatcatcagagagatgtgtttctgtgtatgtgtgtttgtgtgtgtgtgtgtacatgcacttgtttgtgtgtggttataggcctgatcagacagatgtcagtttatcaattagtagaactccctaattaagtatttgctttgagcaatagagctcttattggttgtgaggtaacttggcaggagggaggcagttaccgatgtaatagagatgcctgagcagatagtttcgttgagcagatactatttgatgtcctttaatcatcagactcctccacttttccttcttctgggctcctgatttatccctaaacaatcagagcctctcctccataattttatgaactacaaaatttacaaaaatgttttacaaaccctctgcctccccagtatcttctccagcccccatgtcttggggcaggccacatcaggtctctctggctgcttcctttcccaggccctactacctactctggcccatcatatgtcttttgagaagatgatttttcagttcttttctttagtttagaaaatcagaattaattgattaatttttaaccccttctacctttctcctcccctaccatatgaattcatgcagagccagccctgcaacctaattttttttgttttgtttttgagacagagtttccctctttttgcccaggctggagtgcaatggtgcgatcttggctcactgcaacctctacctccggagttcaagggattctcctgcctaagcctcctgagtagctgaaattacaggcacccaccaccatgcctggctaattttgtatttttagtagagacagggtttccccatgttggccaggctggtcttgaactcctgacctcaggtgatctgcccacctgggactcccaaagtgttgggattacaggcgtgagccaccatacccggcccctgcaacctaatttttaaggagaggtggtaaggttcattccatgaatcataccacttggaattcttgaaaaattaattgcatttattgcacacctactctctgtaaggcaatgtacataagaatggaggagatactaagaaaattgagtcccactcctattgccgatcgggaaagtacggcataagcacatgaatatttagaggtcctgtggtttaagtaacggtaggtaaggaatcattgggccagatgggatcagtgactcactgaatattataatcagagatgtgagtgcagaataaggaggagatatgactggggactggtgtagttcttagaggttgcctgagctggctagcgtgacattcctactaagcaatgagcctagcaaccagaatctcccagccccggtagccaaggagcacaggtggtaggctatagaaggagatttaatgcaacacagctgggttcaatatggtgcctctttcagagccctggctacaattgatgtaacctggtaactagtagctttgactttgatgtcagacacatctggttgtgaatattccctgaaccactcttaagagtttctcaactctttgagtctgagttttcttgattgtaaaatggtgtttgataatacatatgtggttttcatggggattttgtaaagtgcctggcatatggaaggagctgggtaaatgatggtagtacacttataatcttaagggcagaaggaatgaattaaatacagagtgaggcctagggactcttgctatgctccctcctgactccggtctagtattactaacatctttccagaaaccattcttctttatgttggttttggccctttgtgtccccatctctagccctttattcagttggtctgctcaaggcttgcatgccatttttggcattgaacatgtgatcctctagtttaatatagcatgtgcaatatggtaatttaagaaaataaatgtctgtatgcatagaaaacacagcatcctcctttaattcatgggtttatgggagattacagttttcttttagtttaagcctacaaagtgtttatagtaaaaaagtttcaatgaaatgatttccaatttatatttccttttcactcaccaccacaagtcagaaatcaaatcttatgcttagaagaaagcaactccaggactgtatccacttcgggttttgaataacaacagtaaggtggtctgactccaagattaggtccttgttgtttggacatatctaacaaggaactccatccccaagtgctggagaatccatgaagtcagtggtgtcttatgaagcttgagcaattgggaagccttcccagtcagctttttggcctcctctaggtcttaattacaaagcggattcatggtcctgcctgaaatctgattgagacatagactcctctatcccaaatgatatcattatcaacattggttccctgtggtacacatttgtcatattcattatgatttgtacctaagattccaggccacaataatagggtaagagtgtataatgggaaaaataacacaaatcgttttgattttctttaaggaaattcattgccttaacattacatacttgcctttgttttaaaactcactctatgccttatctaagaggagtcaatataaaagattttaattttagccccatatgctgtagctatatataaatgttctgtaaaatatatcccctagataaaagtacttactacttttttgaagttttttttaaaacctttcttttggtaaataaaagtctttttagctttgatgtgactattacacccttggtttgggttctttctccattccttcatccctagcccctgtgggacccctgtaagaaaaatgggaggggagagaagcatgaattccttaataagtcccaaaggtaatcaaaagaaagaaatgcagtatgaacaaactcacaaaatattcttgtgcttctttggggaatacttaatgcacataaggtcaggcctttgtaatgttaatttgagagtgttaggaagaaagccatcattttacaggcaatgttgctctctgaaaaaagctttgatttacagagaaatgctgttctaacacacctgcattaaaccagtgcctgccgactttgagaggcctgagttgcttgagcagaggaaatgcttcattgaggatgcttagggcatttggctgaagtggtaggaagtttgccagaggtcctattttcctgtggtcaaaacaacctgttcagtttggatatggtacagcccctattctttagacatgtgcagagtgacagcacaattccgcaatggcctcctttccaagattggccttagggagggaagtcttaccagacacagtggcaacatagttagtataggtatcttggttatagaggttagacatgaatagcctggtttccacctcaggtggttgcccgtgccttctcatcaacttgtaaacctccatactgtgtagaggagattgtgtggctagaaggaatggattcatcccaaacccccaaaacaggattcggataagtgaccatccagcctgcaccagagcattgccagagactggccattaattatcttcagaggcctctcagttcatctttggctctcctctctcatccatttctgtttcttccttcttccatccatacttcccctgctctttcctcctgccttttatattggtctgtattctacttttgggtgttatacaaatcagaaaacatttttatgttaaaacaaattaaatatgaatactctttgtgaagtgcctgacatgcagtaggcactcaattacttcctctcttccatcctactgtgtgataactcttctagtaattgagattatgttatcatgagactacatgaaaatattatcatgccccttctgagttaatcttattcaacctggtttctcatcccttcatcttcttagtctccctgccctcaaatagtccactgtgtgtgcacgtgcgcacatgtgagtgtatcttaaagtacagttttcaaaactagctgcacttccctatgttgggtctgatttgccaattttttatgaaggaataagcaaaaagaaagagagcaagagaggaagaggggagaaatgccgtgcttttctagaggagcaaatatatggaaattacccttgtttcttctctaaagtagtaaaggtcacagcagtagttgcaaaacccgtaggccgcctactgccttccacacattcagcattactattcttgcctattttacccttaggcatcctttatttcttgcacagatggtctcactcaggcctaacaaaatgttttaagctttgcataaattaaaacgaggtctctgagtacaaaagtgcaacttgttttttacttgaaaacaactatgctggcatcttttacaaaattacagcctcaagccaggtttccataatcagttttcctttaaaaaatagagaggaaagaatgtatccttgtgtgtgtgtgtgtgtgtgtgtgtgtgtgtgtgtgtgtgtgtgtgtgtatgagtatatatataatatatgtatgtataccaaacacaaatggtcctaatcaatgggattatggcttttatgatgttctgtgttcctttgaaggttgatcaggcatgagtggtggatgattcagtttgaataaatagatttggaaatattattttgggggtccaggatttctgagtttcttcattagtttagtacatgataacaactgttgagacatttcagtgtgcggagactccctcctagaactctttactatgtaccttataacagggttttactcaggctaaccttgactgtgctcaattgaaagaaagtgatgagtcagctcaaagagaaatagtctgtttctcccaactctgcgataatgtgtcccaaagtagtgacacatggcatattccattcttaagataactggcagacaatttgtacaatcttctagacacattgcttccctttgattcacacatcatcaccaaaagggtaatgctacaaatcttttctctattcatgactactcttaacagggatatggcttgtaaagaagcttattgatgtgctttgcttgaaatagaatcattagactgggcctgccctctcatttttaccttgacagtaatagtaagagtatgggagatactcttactcttattattactataactataatagtaatactattacagtatagtaatactattacagtaatagtaagagtatgggagatactcctattcttactgttactgtcaaggtaaaaatgagagggtactgtgtgagttattttttatatattgtcatcttttaataaccctatgtgcccactatagagaagttggaaaatatagaatagaaagaagaaaaagttatttttttattttccacagttaatattttcacatattatttcattatgtttatttcctcacacactagtgatcatactttcaacagatcatactgtagatattactgtagatgttatattcatttgttcacttaaactaataatttgaatatactttactattattaagaactctttgttaaagatcaaattgttttaaaacttaagttagagaggcatttatagcattagataatgccagccaggacatatacactatctttaaaaatgaatctaacccttaaatgaaatccagcagccaatctaatgtttctttgtaataagcaaaatatttttctgtgttattgcatctcacaggaatctattcctaaaggattcaatagtaaagatgctcagtaatcatgctctagagtttctcatccctctaaagaacacacagcagttctgtgaatgactaaggatcagcaggaatggatgtcaggtgaatgttggcactactggatacaattgatatgctttatggattttttgtttcaatgtgattctgcatagatggcacctgtaattatgaccatttggatcatgtgaaaaatgataaattttcggtgaaagggaatggtgcttgatccttttctttgtctttgaactgtttagaaacactaaacttaactgataaaagtaagtgcaagatggccgggtgcggcggttcacacctataatcccagcactttgggaggctgagacaggtggatcacttaaggtgaggagtttgtgaccagtctggccaacatggtaaaaccccgtctctactaaaaatacaaaaattagctgggtgtggtggcgcatgcctgtaatcccagctacttgggaggctgaggcaggagaatcacttgaacccaggagatgaaggttgcagtgagccaaggttgcaccactgcactccagcctgggtgacagagtgagatcctgcctcaaaaaaaaaaaaaagtgtgtgtgtgtatatatatatatatatatatatataaaaaataaaaaataaacaaaaattaaaaagtaagtgcaagacatcttagaagtattgcagttttttaaagctcttgacagagtaactttattcatgcaggtaaattctagctcttttgagcaatatgttaataagtcactgctaatggcctaatagtttttaacttacaattaaagacccatgatggaaactggcagcaatttcataacccaccagtctaattgtttcacagtgaacaattatttgccttgcgaatacttacagtaaacatttctgtaaagtttatctttgtttcctaaacagtgatatttgttttgtacattctgtagatggaatatattctgcagtttggtttttctgctgcttagttgctgagaattgactgtgttgttgcacatagctgtaatgcattcattttcactgccctgtagtgttccattgtatgaatatactatggtttacatataccttgtattgatggacagtggacatacaggttgtttccatttttgatttgttagaaatagtgctgtatgactgttcttttatgtgtctcctggcacatatccttgaaatttacttagcattagaattgcttgggtttagggtatgcacataaggaacattactagataacgctaagttgatttcaaaattaattgtaccaatttccactctaactagcagtgtagaattgttgccatcgtttccacattttcatgaatactcttatcatacttcatatgaaataatcttgtgcacatgtgtatgtgtgtgtgttcaacagcctcattgtggttttaatttgaatttttctgccctggtttcctcttctgagcatgttcttttgggttttttaatctatgtctttattttaatgttgaactttttcttattcagttataagagtgctttatatattttgatcactattcctttgtgaataatgtgtgttccaaaacatttcctaagttatggtttatcagcgcattctgtttatggtgtcttgtgataaaaagttcttaatgatagaatagttgagtttatcaaacttttcctgtatagtttgagtcttgttttgagaattcatccctactctgaggtcataaaagcattcttacatgttgttttctaaaagtgttctagttttatcttttacacttaattcattgctttatctggaattaatcttcatgtatgatgtgaggtaaggtaagggttcaactttatttttctccatatggacaagcaactataataccattaccataatatattttaaaagtttcttcatctctcagtgatctgatggaccaactgtcataaattatgcctccaaatttgcctaggtttatttctgagttttctctttcatttgtttgctaatttatataacaacacaacactgttgaaattattacaacttttaattattgcttgatattttaaaattcagtctccctcccccacctcttattatttttcaggtacacattggtgactcttgtcttactactcttccgtgtaaattttagaatcaactcatcaagtttcatattctcaaaaaagtgaaattttcattggaattgcattgtttattggataatttagaaggaattggcatctttatgatattgattcttctagtccttgaatataatatttatctttatttatttaaatcttttttctccttccggaaaattttatggtttttctctatatgttttttttattacctatttgcaaatttctattagatttgttcccaggtacttgattttttttggtcctattataaatggtgtcttgaaaaaccatgttagcagcagttctcgttcttcgtatatacccaaaatcattcatagcagggactcaaacagatatttgttcaccaatgttcatagcagcactattcagaatagtcaaaaggtagaaataactcacatatccattgactgataaaaggataaacaaaatgtagtatatttatacaatggaatattattcagccttagaaaggaaggaaatgttgacccatgctacaatatagatgaactttgaagacattatggtaagtgacacaagtcagtcactaaaagaatactgtataatttcacttatatccagtgcctaccactgtcaaagtcatagagacagaaagtagaatggtgattgtcagaggctggtgggaagagggaatgggctcttattgtttaacaggtatgaggtttcagtttgggaagatgaaaaaatttctggagctggatggtggtgataattgaacaatattatgatataattaatactattaagctacacacttaatggttaaaatggtaaatttcattttaatgtatattttaccacaataaaaattatgtgttctaaaatttactgctggtgtatagaaatacacttgatttttgtatattgattttgaatctagcaaccttgccaaacttaccagttatagtaagttttttgcagctcgtctagatttctgtatatgcagtaatgtcataatgagcattttgtttcatcttttccaatcttcatacttttatttatttatcttgggttatccagttacctatgacattcaataatgtcaaatagaataataatagcaggatttcttgccttgatcttaaaagaagcgcttagaatgtttcccattaaatatggtattttgttttgttttgtttttaggtagcttttatcagattaaggaagttcccttcatttctagtttgctgagatttaatttttatcatgaatgactgtcagatgatttattgaaatgatgatgtgattttcttctaatctgttagtgtgataaactacagtaattgattttccaatgttaaatcaatctgtaattcgggggttaaacacaaattgattatgacatattatgcctttcacacaatgctagattcagtttgctgacattttacttaggatttttcatccaagttcatgagtccagttgtcttgtagtgtttttctcaaatcatcattttgaggattggtatcaagattctcccacctcagccttcctagtagctgggactacaggcacccactaccacgcccagctaatttttgtatttttagtaaagatgttcagtaaaaaaacatcattttgccatgttggccagattggcctcaaactcctgacctcaagtgatctgcctgcctcgacctcccaaagtgctgagattacaggcatgagccaccgtgcccagccatgtctctgtgttttaggtatgtttcttataggtactatatagattgattttttttaaaatttttttctcagacctcacagggatgaagatgttttaaaaagctcttctgaccagataatatttgtctgttaaatggagctttttgtctatttataattatagatcagttagaatttattttgtgcattctatttttgccctttctacattttttttctgatttcctgcttttctttgaattgtttcttcttacttcatttttttcttctgcaatttcagaaattctgtaaaccattttcattcttttggttgttactctagaaatttaataaaaacatttcaaagtctaaagttactcaggaggaaaggaaagataatgatgaatacagggacttttgaacactttaattcccatcagtttgttatcatttaccttaattctgttgtatacacccagcagatgatattgttcagaattaaccacatattttcccatgttctactcttcatttttattgctttcagaccattcatgttggatcacttttattctagataaattatattttttagagaatttttactatggaaagatactttttactctatgatattttaagttaacaagtttcactttgaatattgaagatgtcattctagtgtcttcaagattctacactgttactattgaaatataaggtgttatttaattgttgcttcctttaatgtaatttgttctttttctggctgcttttaagtctttcttttgtctttggtgttctgcagtttaaggtgcatttaggttgaaattattttttgcgtaacctgcttaggatttgttgtcttctttttttaattttaaattacgttttatttaacccggtaggtccaaaatatcatttcaatatgtgtcatcaaccacgctgcaagccctcaaaagccacatgtggccagtggctaccacactggaaaccatatgggacagttctatagaatggagtttagtgcgcattagaataaatgggaaatcttacttaaatgcaagctcctggggcgcgttcttagaggctatgattcagtaggtcagcaaagagaccctgggatcttcatttttaacaagtttccccaagtgactccaatgagagtggtctgcagaacactctttgagaaacactgatgtaggagattgttcagggcaaagcagaaggttcacctgactctcagggaaccagaataacctagtaaccatgggatcattgttacaggatccacatccctaagaggatgttccactgcagttttcatttttctctgactcaaactcagtaagtggattagatacatgcaggtgatgatgcaggtgcccatatgggacataaaaatttcaagttgggtccatttgttcttgcatcaaattatgttttaagtaaaatattaatattttaagtaaaatattttaagtaaaatattaatattttaagtaaaattttattttacttttaaaatattaattttttacttaaaacattaatttacttaaaatattaatattttacttaaaacataatttgatgcaagaacaaaatattaatattttacttaaaacatttaatattaagtaaagtattaatgatcctaataaatggggaaggagctcagacagaaccccattcccttcaaagcaagacaactttgaatagctgtgaatcttcataatggcttctctttatgaagccattgttttattcaaggatctactaattgggtaacaccatctcctatgcacaaacatgccctaaacttggactcagttacaaatagggatgaaggtaagaatggtcagactgtctggattttccttctcttagtgtttctcaaagcatggtctaaggaccagatagggccatgataccagacatgcaatagacagacctgcacatttgcagcattctcctccagagacagattcacatggtcaggtacagacccagaatctgcaaggtctgccacccacctccattctctgcccctggataattctgatacaggggattagggtgaaactagtggaacccatatataccacgctgttctcatcagaatgaaactacaaaattcactaacatctctcttgtttttaattttaattatacatgtactatttacaatagcaaagaaatggaatccacccaaatgcccatcagtggtagactggacaaagcaaacatggtacatatacatcatggaacaccatgcagccactaaagaatgagatcataccctttgcagcaacattgacagaggtagaggtcaccatcctaggcagaccaacacaggaacagaaaaccaaatactgcaagttctcacctatgagtgggagctaaacaacaacaacacacagacactaggaggggaataacagacactggggcctacttgagggtggagggtggtaggagggagaggatcaaaaaactatcaggtactatgcttattacccaggtgacaaaattatctgtacaccaaacctctgtggcacgcagcttacccatataacaaacctgcacatgtacccctgaacccaaaacaaaaattaaaaaagtatacatgtcatatgaataaatttccagttataaaatatttctttttttttttgttgagacggagtctcactctgtcgcttgggctggagtgcactggcacaatcttggctcactgcaacctctgcctcccaggttcatacagttctcctgcctcggcctcccaagtagctgggattacaggcgcctgccactacacacagctaattttttgtatttttagtaaagagagtgtttcaccatgttggccaggctggtcttgaactcctgacctcatgatttgcccacttcggcctccaaagtgctgggattacaggcgtgaaccaccacacccggccaatataaaatatttcaacaaatacaagtaaattaagtaaaaagttccctcacctcttctctaaatgtactcttcccccggggtgaccacttttatcagttaaatttaaggatttcttgtcttcttgtatctttggattgatatttttcatcagttttggaaaattgtctattcagtttcttttcaagtattgccaactcctcattctctctttcccttcctcttctctgggaactaagattatatgtttgttagaccttctttctcactgtctcttccttgactgtcataatttctgtactacattccagatgatgttttattttagcttccagtttgcttgttggctcttcaccagtacctaatctattgttaattctgattactgagattttcaattttgattaatatagtttttgtttttataatttttttaaatttaactttttatttggaagtgatttcaaatttgaaaatcattgtaaggtcagaaactgtgtgaataataccatataccctttacctagagcctctgattcttatttcactccatttgatttataatttgttttttctctctcggatatatttttttctgaccatttaaagataaatttcatacattatgacctttttcactaaataatttaggttatatatttcttaataggcatattctcttacctgattacagtatagttatcaactgtgaatattgctgcaacgaacatgagaatatagctacctctttggcatactgatttcagtttctttgaatttatatcagaagtaagactactggatgataatgtaattctatttttaattttctgaggaactttcatactgttttccttcatggctgtattaagttacattcccatgaacaatgcacaagggttctcatttctccacaccactgccaacccttacctttcatccttttgatatctcattgtggctttaactttaatttccctgttgatcagtgatgatgagcattttttcatatgtctgatggccatttgtatgccttctttggagaagtatctatttaggccctttgcccattttttgactgggttatttgttttattgctattgagttatttgagttccttatatattttggatattaaccccatattaaatatatggtttgcaaatattttctcccaatctgcaagctatttcttaactctgctaatcgcttttttttgccatgaagaagatttttagtttgatacaatcccacttgttaatttttgcttttgtagtcatattcaagaaatcttttcctagaccaatgttgtggaacgttttcctatgtttttttccagtagttttacagtttcagatcttacatttaagttttcagtccattttgagtttatttttgtaaaaggtgtgaagtaagcatccagtttcattgttctgcttgtggatatccaattttcccaataccagttattaaagagactatcttttctccattgtgtgctattggcatctttgtagaaaatcagctaaccaaaagtgtgtgggtttatgtctgtgttctctatcctgtttcattggtaatttgtctttctgccagtaccatacctttatgatcactgtagctttgtgatagatcttgaagtctaggtaacgtgatgtttctttttcattttttctttatgtagtcaatttatgaattcctattttcctaagcagtcttgaattcattactaaataattttagtactcatttcatatttggccagtggtgtccacatctaaaatggctcctgtaacctagtgatgtgctcatgtcattgatttgagcagttgtttatgttatggcataacaagatgtcattttgtatctactctgccttagtcctggaatggaaaaaagaaattttttgaattcaaaactgttgattctttatttaaaatctttaactctgttagtacatactaggtggtgttgattttttttgagactgttattcttcttgagacattacatatacttagcgtgtctgaaatttcaatgtctgaagcatttccaatgatttatgtatctgattgttgttatctgccagctttcactcatccttttgcctttccttacttgtttggtaatttttactgtgaattgcttatttccctgagaactttgtgtgagtattgcttgtttttcctggaatttttaggaattctttgacacctgggagaaggtggtttttaccagatatttgattatttcatgcctctagtgaaactacctgtgtgagaccatcttatattctcagggtgaggtttttcttttcagaccattttatgtaaattaaggctttaaaactctatgagagtcagcttgtcattatgcattatcagaagagattttttttttctgccggcaatactatttgagatgagaaattttcattgcaatttacttgagggagagggtagtttatttttagttcatctagcactgaatgtgtagtaggtcttttgtgtatagctctgttgggatcttctactagatgtcttacctggggtgggggccatgtgctatgctcttgatccctggatttgtgaagacttgaagccaaagctgaagttctaactagtttgggaaatattcataagaggaaacaaaaactaaattttttttcttctctttgctttatttttgacctgagtattgcttactttctgtctagctcatggatgtagattagaataatattttaaacttcattctgtttagtttttaaatcgttttcagtggaagtatcagtcttagtacctaatctcccatggcataaggctggaaatagccatgatcctgccaaacacggacactctgcaacctggaacaaaatattctactctaaaaatcaagtaattatgtcttttttcaataaaatataaagtataatcattaatgtaatttacttctttcattccagtcttcactcatgctttcaaacatagattatattattccaacccttcttaagtggaattagtatttcattattccataaggttctacaaatacctacaaagaccatcatgaattccaggtgctctgtaacctgatcaggttggagaactgctgatgcaaccaaatttaatcacttaatgttcttactaagcactcatttgtttttctgcttctatgacttgctctcactgcttgctatcccaaacactgtccgtttgtacatgttccaatgtcaccattcctttttcgggcaaatgcttcaaaagctactgtttctataaaactttcctttacccttctcttttgacttgttatgagctccttttgtagtttgtaatctccttaagagcaaatttcacaaatgttatatttgtaatatcttatgtagcagagtattctcacagtctagaacagatggttcttctgtatctgttgaaagaaatgggaagatagcaaagcaacataataggataattttatttttgcctactagactatctcaggatgtatgtgttttaaatcctaaaactggttagtggtatttcagttgaaaaggtcttgaccctttcccttctaacataacaatcctcatcataagtgagagagaagattgggtgagtagggctcagtgggggaagctggttcctttcacccaccttcagaaatccaggtatggaatacaggggttgttctggacctcaaaattacctttttttttttttttttttgacggagtctcactctgtcgcccaggctggagtacaatggtatgatcttggctcactgcaacctatgcctcctgggttcaggggattctcctgcctcagcctcccgagtagtggggattacagggatgtgccaccacgcctggctaatttttgtatttttagtagagacagggtttcaccatgttggtcaggctggtctcgaactcctgacctcgttatccgcccgcctcagcctcccaaagtgccgggattataggcgtgagccaccacgcccagccacgaaattacctttaaaaaggtggtctttaaaaggcaaatagggagatactaattgcaaaaaaaaataatgatgaaataagttatctttctgttttccactttttctgtggtgttccttttgacatttgcattccaaaccagagccccacaaataactgagtttgcactcttttggcaagcaaggactgctctcagatgtattttataacttcagcttatatgggaagaacttttctttccagagacggtttcatagtaatatccttcaaaagctcacattgtagaatatgacttttttttttctttgttgttatgtttgctttgttttggtgggttttattcatcatttcagccagcttatagaaagagatagaacttttgttggatactaaatcatgtctatcaaaagcactattgaccttgtgttgttaaaactaaaaatgtaagaacaaaccattttctaaggtttttaattatatgcactaaaacagagtaaggcctagatttattaatcattgggttatggtttgatgtggaaagaaccagcctataacttttccctttgtttaacaacgttattgctgaaaactttaatagacttaagtgtactggaactagggagtgaaatcttatctttccctgaacaccagggctgctttgttatggtgtttccatttgtggcataatgaatgtgtaggacgctaatgatgtggtctctaggtgttctcctactacacagagcactgataatgagctgcgagtaatctagtacgagtccctgaagatgaatcctgattaccttcatggggccattccgctctgctcccttcctccttgatgtttctgtaaagagcatttggattttgaagagagtattgtgtatttgacttttaattagatttgcagtgtgttgggttaataaactagggcttcttcttcttcagtttcctctaaagggatgtgtgtaaatgttgcacagtgggccaagagaacagagggtcataacaggcagcaatggtggtgtcgcccacttcatgccccagtcctgaaaagaaggcttatagtggctgaaggttgatttcatcccatggtccatagttacaaatggcttccaagctgccaaggacctgctaaacctattgcatctgttctgtacgaggaagcagtctcagaatgaaatatgacagttgtctgtcagggctgccccagagtcctgcaagttggtattatctgcttgcgttcagaaaacacatcaccgtggctgaccacagctttgtacttactgtgatcttagggctcgcatttttagggacaacttgccctttatgcctttggtccctttctgccttctgcttttgtttttctgccagttgggttcatttatcttctttcctgtgtgttttgccatgcttttcttattatagctttcagattcatcatggacagagatagaaagtactctagtgtctttatcccacctcagctctcagtctggtgtagagctaagggaaggagaattgccttcacagtcaactttcagtgtggtccctgaactttttattttgttcagtgaatccagcacatctcatattgtgccccagctataatgggtagtcctttcctgatcttctaagaaaattagatgcctggcttctgccttgctcttcattgttttttaagcatagtccttacatgatggtccgggccttccttacaggtctaattgtgtggctgggccttccttctgcatgcctattctgttttttagtttttgtttttcttttaagaattggggtctcactctattacccaggctggagatcagtggcataatcataactcattgcaacctcgacctcctggactcaagagatcctgccacttcagcctctcaagtagctgggactacaggcacacgccaccacacccagttcattttgaattttgtttttgttgttgttttgagacagagtcttgctctgtccccctggctggagtgcagtggcacaatctcggctcactgcaatctccgcctcccgggttcaagccattttcccacctaagccttcttagtagctgggattacaggcacatgctaccatgccgagctaatttttgtattttaagtagagaagagatttcggcatgttggccaggctggtcttgaactcctgacctcaagtgagccgaccgcctcgacctgccaaagtgctgggattacaggtgtgagccactgtgcctggcctgaagttttttttttttttttgtagagacggggcctcactgtgttacccaggctggtctcaaacttctgggcctgagcgatcctcccaccttggcctctcaaagtgctgggattacaggagtgagccatcatgcccagcctgcctatcctattttattctgaggctactactactccttatgggtagatccaaggatctgacatcattttcatacatcctgttcagtgtgtgagtatagaattgaggtaggctgacaacacaaaagtgggcagaggtttcccactcatccccgacagggattctctgttggcataggtgggctctggtccaactcctggccgacatgagcatggacaatgtggcacagttgtggctctgcatcttgtgtgtgactgctgccctgtttttgtttagcaagctgctgtgccaatttactatgcatgttgttacatattctgctctaatttgactgccattttgcttcagcgagacgatgattgtttatggcagggctgtaatgtgttgtcagcacaggttactcgctacttgttggcaatggcctaacattgcctgagacatggtgtcactgtgaaatggtttgacaatgttgagactgtagttatgttgagcagtaacaactgtagaggtcaagaaagggcatctaagaggaactgtgttcataggggaaagatggagaaggaatactaagtaggacagtagcaaatgtcatcaaagagcttcattttcacgcaattttcataattcagtctgttttctgtgaacagtgttggttcagctgttgctcgggagtagaagcacatttctgagttagaaatgaattgtgctgatcatgaccctatcattttcttctttgaacatttttagaaagttatccagcttgctgaagaatgcactagatccttgtccatgtgtgaggcaagggactcattgggccaccttcacagggtttcatttttggaacatttatctaaggactatcttactaccctgagagaccaagatgtaggctaccttaagtcgtatgaggctgctgtgaaaatggcatttgtttttttggctctaagaaattttcaggacctagtcaagcatgtgacaacaaatatttaatgatagtggacaaggtaaacttcaaaagtgactagaaacccttgtggaatctaagacagagggactctaacaagcttgatgacattttgaatacgttttgtattgattactgactcttttcccaataatctgtgaagctggctttctgtttggcaaggcagccccaaaaggaaccttcatcccatacctccatgcaggagtagcacagaacagcacccagcatcgggccctccagagtctgggagggttcggttgtctcatgaattatgtggtgcccttcaggaactcactttgacctctgatgcctttcctttcaagcaagtggtgtggaaaaatattaaaactctcagtaatgacagtttccagatatgcatatctttgagtggacaatgaaggcaacatttatattctgtccacgatgcgagcatggtatgcattctgcagctgtcacagagccttccttctggtaccaaataccttacttcctgacaggtatgacctctgagacctccctaacccctttctttcatttcatacaaaaatctagagcttggcttttttttttttccttctttttttgtaaaaagaggtttttccattttaaaaagccttttcagttcttaaacttgatcattgatatgttccacctcatcaaaaagaggagtgcagctaaactgacaatcagttcatgccattggcctcactcatcatcatgtcaaggacctggcatgcccattgagaagggcctctgtgcattctgtcctcaccaagcctaattccttcccctgttgatggttttgccagattctttgcctgttgatgcccatgccagggccacggtgcttatgccaaagcctttgacagaatgagtcaaatctggtgccagtcacccttggcatatgccaccttgttcttgaccacttcctaccagggatgggctgaaaagaatagtgtctgctaagagcttgtagaggacttttctgttaagtgctaagtgttgacattactccagtttgaatcagatcatttggaactcttgcttggatctctcaaagctgttgactcatttgtatcttggcctcacattagtggggtagataggagccaaaaagtttgagtgaagtcagaataaatatattttaagtgtggatctgtggagaagaaagaggtcccaagagcataatgaaaactgtggttaaaactgtgaatcaagaggtttgttttaatttgccattttcttacgaagttttaaaatattttctaataaagcttcttatttattgccttagtacattttctgttacttataacagaatacctaaaactagataatttatggccaggcgcggtggctcacacctgtaatcccagcactttgggaggctgcagcaggcggatcatgaggtcaggagatcaagaccatcctggccaatatggtgaaaccctgtctctactaaaaatacaaaaaaattagccaggcgtggtgttgcgcacctgtggtcccagctactcgggaggctgagacaggagaattatgtgaacccaggaggtggagcttgcagtgagctgagatcacgccactgtactcctgcctgggtgacagagcaagactccatctcaaaaaaaaagaaaaaatactagatagtttataaagaatgggaatttatttctgcagttatggaggctgaaaagtctaaggtagaggggctggggctgcatctggtgagaggcttcttggtggtggggactttctgaacagctccaaggcagcacagggtgtcacatggtgagggggtgagcatgctaacatgctagctcagttctcttccttttcttataaagctacctgtctctcaatattgctgcattggagattaagtttcaacacgagttttggagggggcatttaaacgatagcatatatatagtgcagcagtcccactcctaggtatttacccaagagaaatggaactatatgcttacacaaagacctgtaccctttttacactttttttttttttaagacagagtctcactctgtcgccctggctagagtgcagtggtgcaatctcggctcactgcaacctccgcctcccgggttcaagcgattctactgcctcagcctcctgagtagctgggactacaggcacgtgccaccacagctggctaatttttgtatttttagtagagacaggtttcaccatgttggccaggatggtctcgatcccctaaccttgtgatccacccgcctcgggctcccaaagtgctgggattacaggtgtgagccaccgcgcccggccaacctgtacactttttgtaatagccaaaaactggaaagaagcagtatacattactaggtgaaaattacagcatatagagataatggttatttctaagcacaaaaaagaatcaaactgatattcctaacaacatggatgaatttcagaaacattgtgctaagtaagagaaggcacacacaaaaaggtacatacttaataattccacttgtgttaaattctagaaccaacaaaacttatctgtagtaacaaaaagtagttccatgttcacctgggtgcaggggtgggaacactggctacagagttgcatgagggaacattgtgggtgatggaaatgttgtttcttgattgtggtggcagttatatagatacagacatatttgtccaaactcatcaaactgtatacttcaagtgggtacattttttcttttatgtgtattatacctcaagtataatgaagttgattttaaaaatatatttgttgtaatcccacttttgccacataaacagggtccagagaaatattaggtattccttctctctctctcatgtatatcctgatcaaaacatttatatgaacatattgaaatcagatttaaatatcagtttccctaatggactcagctggactcaagttaattgacttaataaaatttcgaatctcatttgttcctattttctcctccctacagttgttatctttactgttatttgaaggacttgaataagtgaattttgaattcagataatacactatagggagtaggaaagcagacccctggcctcaggagcgcctctttgatcatgaatgtctatgactgccattttgttctctagattcatgtctttatattgtctatttggcttatagttttttctatcaccatttttgttttcaactgttttttcactaaaagacaaaatttgattttcatgctattaatttcgtactaaaaagagcacagcaggcataattaaagcattttaagatgtagtaatttgatttaaaatattttactaagcgatatattacaaaaagttatttaattatctgtaaactttaaaagcaggtattagcattctatggctattgtctttaataattacattttaattttaattttagttttttaaatgtatgtttctttttgttgttgttgttctgagatggagtctcgctctgtcacccaggctggagtgcagtggtgcgatcttggctcactgcaacctctgcctcctgggttcaagcaattctcctgcctcagtctccggagtagctgggattacaggcacctgccaccacacccaaccaatttttgtatttttactagagacgaggtttcaccatgttagaaaggcttgtctcaaactcctgacgtcaagtgatccacccccctccgccttttaaagacctgacatcttagttgttactgtgaaattgattttcttgttttctcctcatcttaaccttgttttatatatcaaagtaaagaagaggaactgttaaaacttatatgaagtatggctgaatcttcaaaaagatatcaaatatttagaaactaattttaagctgcatatgttttatgaatggtagcaatacaatttataactgtcatttctgaaatctccggatttaggtctccattgccaaaaaatgtaaaaaatagaattatgacaagtgatctcttgaattaaaaccaaatgtttttgtattacaatacctgtgatgatgattccaaacaggcttctctttaataagtggccacagtagagtcatgatgttagcccttatatttataatgaggacaattctgggtcaccaagggcctggatatgggacccttggggcccactgtgatatttatggacatgaaatacagtcataggccatttatcagatttatcaaatttggaaacttccaaataaattaatttgacaaatatacataaacttcagtaaattttattagttttattttttgccctgtgtatttgcataaatgttactaggaaatatatttaataaaagtagaaggattttttttttttgcgtgatactcagctatattcttccaatagttgtggaacagcttagtgccttcagcagtggcagtctcctaaaacgattgtctatcagttaaaggttaactgagtatttggaccaagtagcaaactagaattcttttcatctaatctctgtttaatatagggatatccaatataacatccttgggtcagtgtagtacatcttacgttaagttttgtctctaatgaatatttatattacataaatgggaaaattggtgggttcccttggtagaaacatgatattggtatttttaaagtaaacttaaataggtcagaatttttatcctctagagaaaatttcacgtctgattaaatagtttacataaacttaatctttttctgctagatgcattataatctcagatattattcatgtagctattcctctgtgaaccataaaatgttcatttcttcaaaatgaatatgaagctcaaagcattagtggtcttaagagcataaaaactttattactttgtgcttcacatttttcaagtgactttggaaagccgaaacaaattttgcatttagattaatggaagatgttttccatgtgaaggaactggcaagggagcaacaataacaaaaatcccccaaggttaaaaatgtagtgcttttgattcttcccagaactgtgttagcagaacaatcatttctcagcatggaaaggtatcataattggtctatacagtggcaatactgaaaacgagtatgcttcagagaaagctaatatgactctacttaataatttccttcaagagcctgaatttgaatgtatgttccacccagcttgaggcaaacaatttgttcctataagttctagtggaagttaccggggggtcatgtaatttatttttgtcttgaagttttcaaaactgtgtagaaataaagacacgtttacttgcattgttccactagtaatttgatccaattggcaatgctcctttctcttcttctcaattctattatgttggaagagtggaagcgttcataaaatgttgtgacaaacaattcttcctagagacgtttcctctttctgtttgaacctctgatccacttgcgaatgttagcattctttttgtttgtttgtttgtttttgagatggagtcttgttctgttgccagactgcagtacagtggcacgatcttggctcactgcaaccttcacctcctgggttcaagcgatcctcctgcctcagcctcccgagtagctgtgactacaggcatgcaccactacacccagctagttgttgtatttttagtagagagagggtttcaccatgttggccaggatggtcttgatctcttgacctcgtgatctgcctgcctcagcctcccaaaatgctgggattacaggcatgagccactgcacccagccaaatgtttgcattatttagtaagtggttttttattatgggtctttacttacatgtgctgttattgtccttttcactgggattatctaggttttcaatctgtttctttgtattaattttttggctatgggactagttttaaagccctaccacagaagtagagggtctgtagttggagtacggtgagtaacatgagagaatgtttcctttttttccttgaagaatggatagttttaggggaatgtgtgcagatgtcagaagatggctacatagagaatgaagcatcagaaggtagacacaggtctctgcattgcaaatatcagtaacagggatgaagaaagaacagcaaaatttttagaaaaagtgtaaaggatggttagacacttagaccctctcttttataagtttgattgtgtacttctaagaagcagcaataagttgaaggtaaagttatctcaatactctgataagatgtggtctctggattcataccaaacattagagttcaaggcattccccttcagtttattttatattcctcaaatgtatctaattccttaggattaatgatttgtttctcttaaaaacagcatttattgctttaatctgagaaaaaaataagacttccagtgtttatatctacaaacacaaggattgaaaaaaattttataatcagcctcgctgctaattcttataggtgaagcaatgacttagaagaatggggagactggagtacatgatagttttgtagacagccacagttggcaaaagatggtggtgaggctgtccccgttgtaaatcctttatctccatgagagcaactgttgctggctagtttcttgtgaattaagtatgcagtttgtcttttttttaatgtgataaatgaacgtattttctaactggctatttgcttaataaaaatgagtaatataataaggaattaggggagcattggaaagataatcactgggaggtgagaaaaaaagttatctctctgcttcagtcccttattctcatctttatagatcagttctcccagtgagaagccaaatgggatgtcattctttgtttgtttgtttcattaattctttgcaatctatagtaggactgttgaggagaatgtataaactgcaggttaccagcaggtggaaggaggggaatgagggcaggtggtccataagcagaaatattaattcttgactgattgggacagtgaatattgaccaacattgaaaacattatattatggtcttatttaggcctgaacactgacagccagttgacaagtctaattttttataacttaaatgtggttcatttaggaaaaactgccatcaagggcaattcaattctattatgacaattaactctgactttgaagtaagtagaataaatcagtttatttctcagtaaggcccaaataaactgagattgttgtgaaaattatgcagtttgtgactacagtgtggatgttgtgtgttgggttgtgcagtgtacaacctgcaaagctgtatgaggcaacctggacattctactcctagctatatacccaaaagaaaatacatgtttctacaaaaccttgtacagaatgtttatagtaccatcattcataatagctaaaaagtgaaaacaacccaaatgttcataaactaataagtggataaacaaaatgtggtgtatccataaagtagaatattatgtagccataagaaagaatggagtaccacacgtgctacagcatggctgaaccttggaaacattatgctaagtgaaagaagccagacaccaaacggcacatactgattgtatgagtacatttagatatgaaatatctaaaataggtaaatccattgccagtggctgaaatggggagtgattgcttaatgggtatagggttttcctttgggggtgatgaaatgttctggaatcagacagtggtggggttgcacaaccttgaaaactactgaaaaccctgtgaaatgtacagtttaaaatggttaaaatgatacattttatgttgcataaaagaacatttaaaaaaattaatccagtggggtctgatggcaaattgacatgagggaacttttttgagggtgatggaagtgttatcaatctagattagagtgatggttgcacaactgtataaatttataaaaactcatcaaactgtactcttaaaatgtgggtgtattttatggtatgcaattatacctcaataaagctgtttaaaaaaaaccctctctgagtcattactgaaatcagtgccattttctgaatttcagaaatatcaaaggagagctttcctagtgtgaatttatcataaataatgtttggtattttttttcctttgacttaacgagagcctgagatgcagaaacaaatctgcacttccatgttgtgttacccgctttgggccatggcccatttgccagttgcagattgcctccttgtctgaaaatgggtgtgtttcttcatagtaactctcaattctattgttggtgacagcgcaataatggaactttcttctgtgtggataagccccttcagtgatatttgcaaatcaaatcatatctgctttttgtgctacattgtcctcaaaatcttctgattggtttggttatagacatccctatatcagctttcctgttctctttcagtttaaatatctgtatgctgtagcaaattgcattatgaaatcctctcacatttatcgctgtttagtgcatggaaatggcatttcctcattaccagtcaaagataaactctaaatgtttctttttttttttttcctgaagtatcaaattatgtattcaaaaaacttttctctatagcattatttctctgagctgtttcttttttccctcctgaatgctgacaccagatgcagtctgcatggacattagtcccagggaaatcttgtcttctacccaggacaaggagattataggaagcaatgctgactcttgttgtagattcacaatgtgctgacacgataataggacatgaatgggcttttggaatgccttttcctttgagctgggctgagagggggacagaggcagacagctccatggcctgaatttcgttagctgtgtgacaatgggagagataagtagatgtgacagttatgaatgatcctctgtcatgcactttcacgttcagattcagataaactgacactgctgtcaaacacaagctatggagagctgagacctctgatgaaccttctaatatggtaaatgggagtcttaattcttcattaactgaaaaaaggagatttggccatgtaattttctccttgctgcctgttttaaagattccaataacccagcatttacagttgactaggcagggattgcttttccccccctacacttgcaacatgcagactgtgaaatctgaggaaacgctgcttaaacccagacttattgccttggttatctttaatgactttgaaatgtattggcctcattatggaacagtgcagttatcaattcctctaattaggtgatgtgctcccataagaaatttaacattaaagcacaaaaatgaactcgttagaggcatctattgctgggaacttcagtatcaatggtgaattgaagatactgtgtttcgttaccaactcttctgcaccatacatctgactcctccttgaagactagagcatgggcatttttttctttttccttaagggtttaatcctcatatagcacctctaacacctttgatgacattttagtgcttctggatagtaaactgtgtgcctttgactaaatcgactaggagtctagggaagggaggaggtgagcagtttacatttaaatgctccacatatcagcccatctttctttcttggaatttaacccatggctatttactctttcttatgtaagtccaataaacttcctttctataagtagcttagtacagtctttgtttttatcacgatagggaccattatttgtttattaaatagtgatgctgtttcactcataaatatttcagctgtatttctagagaagtaggatggggtttctgggtttaggcttcagtgaagggactttaagtctcttaacccttctttacctcaatcatccatctgaacaaaaaaaatcattatagcctcccctttggggaaactacatagtttaattagtgttttctaataacttacaaatccttagagaaaagttatagtagaagcataagaaattatctttggggttagtttattattattgctattattatcattattactatatgggactagttgtttttttaaattggctacttgaaaatgtgtttcagatctcatggagtgaaatttacctttcatttaccttagggctcaaataagagtatactgaatataaaaatatggaacactaatttctttaaaatacctgaacctattaatagccaggagtgttaacttcgtcacctggaagaagatcctgtcctaacttgaaaatgttagaatgaaaaccttaatcgtctcctctcaaagggtcattgaggaagctgggcttgagtctgtgcagctgttcttcaataatgttatatcattctgaaccaattatcatccttaacccagatttgctttgaatctctgtggcatcttgactactgtctataacaacggtgattgccagacactgcctgatgctcaggtttctatcaatcctcttcttctcctcacagcaggtaggagcttcttggtgttccgctccttacccaggcttgaggaatagtcctactttttgccatgatgccttgctgcagttctggctcttcccttgtgctgttgttctctttgtcatgcaggtttcccagtatcttagtagaagccttgaacaattcctattaccttttcagaccttccttccaagaactgggggatgggggtgttctggtcttgtcacaggtgggtgccacatgtaaggacccactggttcatgggattctttgagagagtctgacgctcacttgtctgggttaaaagtctggtgctgacacctgctttctgaatgactttaagcaagttatttgacttctctttgcctcagtttcctgcctacaaaatgaagataatagcgcctgtcttatcaaggttcttagagaagattagatgcattaacacatgtaaagcacttagaacgctttaagtcacatagtaagcattaataaatatcagttgctaacagcttttgcttctgctctgttaccattttactatctcacctctctcatagcccataacagcaaaccaaactctttggctcttggtagatatattattcttaatgtttgagccctactatttgctattgcttccttttttactcctataatgtgtgaaattgaaataaaaaacagaattgaggccaggcacagcagcttgttcctataattccagtgctttgggaggccaaagtggaaggatcgcttaagcataggagtttgaggctgcagtgggctatgatagcaccactgtactccagcttaggtgacagagcgggaccttgtctcaaaaaaaacaaacaaaaacagaattggtcaccatgatattaaagagccatgaaatatattagcatgtcttttttctgcctatcccctctatcctaaacattccatgtagtcttgggaaataaattctttaaggtaggccagttattatgaatataacatgattatctattgtgttatgtttactgggttgatgccaaggaaaaatgaatatggcaggtcccagcaaataacaacaacaacaaaaatagtattgtctactatttcacagagggtgtggagttagtattgggttttgaaggatgaataggagtttatcagatgaggaggattgagaagagcattcagggcaaaggtatgtggaaaaattggtgtggtagtacacgccaatcctgggaccttcaagttgaacatttaggagtgtagtgtttatgtttcagaagcagaggatgagtggagagggcagcaatagaatggcattaagacccttgtacagtatactaaggagtttggacttaatcctgtgggcatgcaggaccctttgaaagatttgcagtgggaaagtgatcggatctgatttgctaactcattgcaatggctctgtggaagaatatcttggagaggggttcaagacttgagccaggggacatatcaagtagtgtttcaaatgctaactaccccctcctgcttctcacattgctaaatagagtgcagcagaatgaggtgtacttctgaagacaggtttttgaatcagctttccagcagtcccttgagtacattgagagggtgcatggagggaagacatatcatctttaccctgccctctccccatgttaatctattaaaagagatgggagcaaagctgctatcacattgggcttgactgaagacagaagtccttgagcatccttcccctgagtgcgggcaagcctcgtgcttgcagaggagaggagattagaataacatcttcactcttcggtgagagggcaggcagaccctcacactagatggttccaccccggagttcaggcttctcctgacaagtgttgcgagcatctgatgtccttggcctctcttctgcactgcttaccttacagcagttaagcatgagggcattctgtgtcttcctttctttcccttcagttgcttaaagaagatgagaatttgctttaaagaaaaatattaataaatctttataaaatggcattaaatagaaaatctcacactcttttcttcagaatgcttttcttcaattgccattgtatctttttgccccttccaaagtcttaccaattattattaatatatattatcataattacttgtagaaaatcaatagaattgcttgtctttatcagcagtgctacctttctacctctctctcccttttcatcctctcttcgtctcttgcgaattgttgtttctgggggtattattattgtaattacggaaattgataaaaataccatgacaatttcatgcctcagaattattacacagggtttataaaaaaagattattatacatcaatgcagtatttgttattcctaaatgattattccagaaatactaatcaaaaacatctccctgcagaatagtactgtggctttaatatcagctgctgtttctttgaatggggttgcccaatctttcatcaaagaaacacatcacccatatccctgtctttaaaaacagcaattatgtgtaaatgcctcctgatttatttgagccagggccactggccagtatgagtcaccacaatttattgctaaccgtcacttttacatgataggtctgtaacaaatatctgccgcatattgttaaattaatcttccatttaaaattaatggagttagactccccaggttcaatgtaatttcatgttcacgggcagggagggatgtgtgctgcatacaaaatgagacaaggcccaacgccctaatctttcatcaccttgaacctggagactaggacgcgtctcagcaccaactaatgagattgagcctgcgtctctcctgaggatgccggctcaaagaggcttttctgctcagaaatagcaggctctgtcttattttaataattcctcagatatgacaagtctgatgttatgtatgaaagagccaggcttgaaaaagagataaaatgaattttatatcattacttcaaaaccaaaccaagggaagtgtgttgtagttaaattaaaaaaaaaaaaagataggacacattttagtcatgaaatatactgactgtaaaccaggagtcatcctttcatttattttaatgcacaatcaccttagatttctcttctgtaatttttaaacctattcatgcgttaatcaaaataatgtggatgaaagcaggagcttgttcaataaacatttagatgaaaatatcagaggggacatgtaattcctgatggggtatgtcatactgaacctctgaagtcccatcgcttcttttggtggcatcttttgaaaatgcatcttttttctgtgtaccactaacctattactgtttagtctcttagactttaaaaatgcctaagccaaattactcaggggtattgggttctctcgtttttttttctgtctttttcacaaaccaggtaactattttgcatccatggaaaagaaggttttacagaacagatttcggctctcatacatctatagtacttctggcaaatggttgctgtttttttgtttgtttgtttgtttgttttaattcttagggaggactgagccccagagacaatgggacccttttcctaggtaaagaaaacgtctctagaaagacactaagttaagagccaggcaaggtggtgcacacttgtagtcccagctacttggaaggctgtgacagagaattgcttgagcctaggagttcaagaccaatctagacaaacatagcaagacctccagataaggtaaacttcctggtttttaaaaattctgtgagttgagttctgcttcctcagaggggaattctaagtatctgcactttgtgtctgatttatttattttatttttttgagacagggtctcactctgtctcccagtctggagtgcagtggcacgatcttggctcactgcaacctccacctcctaggctcaaacaatcctcccacctcaggagggagctgggactacaggtgcctgccacaacacctggctaattttatatgtttttgtagagacaggatttcatcatgttgcccaggctggtcttgaattcctgggttcaagcaatctgccggcctcagccactgtgcctggcctgtgtctgatttataatacaacatatgattgattttaaagctcttttttgtgatttgttgtaatttgggaccacaataattttttttccaaccccttcttcagacatacataataaaatttctaaagaagtagtattggtattatactacctatagcttttattattattattattattattttactggcattctataacttagaattctattttcttacaatctttgtatatttaaatgaacattagggatagaaaaaatgtaaactctaatacaagaatcaagtatagtcacttaattgacacgtgcagttttaaaaattatagtcaccccttggtatactgagggaattggttccagtaccccctcaccttcacccccatatatattcaagtcctgcagtgggtcctgcagagccctgtgtatgaaaagtcggccctctgtatgtgtgggttttgcatcttttgaatactgtattttaaatctgcatttggttgaaaaaagtctgcatgtaagtggatcaaaacccatgtggttcaagggtcaactgtgtatcactttgataggctatttataagagaagattttaaaaatattgctccatgtctgtacttgaataagatttagaaaatcttaggggtattttagaaccagataaattagtaaaaataatgatactgtaaattggaaaataaatgaataatagtagggcatctttctccatgaacctgaattgctttgctttcctctcttttgatgtctgtaagctgttgcgttttgtacagtgggcctcagggtgcttcgtgagtcccaaataccagatttctttttctctcttctacttatagtatatttgccttaagttcttgatattttcttctgccctcttttcttcttttaatatcttcagcatttttcttcttttttctttctctccctctttccttcccttaaaagggcttctttattttatatagaaactcatctttttttgttttgagacagggtcttgctttgttgctcaggctagagtgcagtagtatgaatcatgactctactgcagtctaaacctccctggctcaagcgatcctcccacctcagcctccaaagtagcctggacctcaggcatgcaccaccatgcccagctaacttttgtatttttttagagacagggttttgccatattgcccaggctggtcttgaactgagctcaagcaatctgcctgcctcagcctcccaaagggctggggttacaggaataagacactgtgcccagccttcaatttttttgttattgttgtgagtgagtgagtgagaaagagagagagagcgcaggttgatatgctcaagcttaaggtctgtaatgggtttaaagctccaagttttataatcggaatggtagagacggaaaggatctctgatctaatccatcctccatttcataggtaatgccatggaggcctgaaaaggttaaggttctcaaagatcaaaaatgtatccttttggaaagtattatagtggttcctcaaaaaaatttaacagataattaccatatatgattcagcagtcacacttctgggtatataatcggaattaaaaacagggacttggacagatacttatattccaatgttcatagaagcattattcataatagctaaaaagtggaaacagtccacatgtatatcagtttgtaaatgaataaataaaatgtggtatatccatagaacagaatattgttgttacttttgtttttgagttgcattttattctgtcactggggctgaagtacagtggcacaatcacacctcgctgcagcctcaaactatggggctcaagaagtcctcctgcctggtactacagacatgagctaccatgctcagcctggaacattattacctagccttaaaaaggatgataattctgacagtctgcaatacgaatgaatcaatgtaatttgaaaacattatgctgattgaaataaactacacacaaaaggataaatattgtgggatttcactgctatgaggtacctagagtagtcaaactcacagagacaaaaagtcaccaggaactgggaagaacagtgggatagggagttacccattcatgggcacaaggtttcattttgggatgatgaaaaagttctgcaaatgaatgttggtgatgattaataatgtgaatactcttaatgccactgaccatatacttaaaaatggttagaatggtaaaaaaaaatttgtatatttgccacaataaaatacacagacactggtatgatttggctctgtccccacccaagtcttatctcaaattttagttcccataatccccatgtgttgtgggagggatctggtggagagaattgaatcatgggggcagtttcccccattctgttcttgtgatagtgagtactcacaaggtctaatcattttataaggggcttttttcttctctgggcactcattcttctctctcctgccaccttgtaaaaaaggatgtgtttgcttccccttctgccatgatcgtaagtttcctgaggcctccccagccatgcagaactgtgagtcacttaagcctctttcctttataaattacccagtcttgggcagttctttatagcagcatgagaacgtattaatacagacacgcacacattcttttattacctgagaaaatttctggcaattagtatgtctgtcctcctctgcctccatctctgtagctaacatttggacattcctctgtttcagtttcagatttgctctcataatgtttttgaatgttacatctttccctttcttatttcagttttctttttttctgacattgagtacgtgctttgtgatagtcactagagatacaaatagctcagaatcaaagaaagagtgtacatgaagtattttcaagaatatgcctataaaatattcaacgatttctcagaaaatatcaattgtaaaataaataaaatacaacaaaactttcttatttgcacaaatgcgtaaagtacatgtagtctaatttaagtagtttttattttttttctctaaagtaaattttgtgactttttttttttttttgagatggagtcttgctctgtcacccaggctggagtgcaatggtgtgtgtgatttcggctcactgcaacctctgcctcccgggttcaagtgattctcccacctcagcctcccgagtagctgggattagaggtcccagctaccacacccaactaatttttgtatttttagtagagatagggttttgccatgttggccaggctggtccctaactcctgaattcaggtgacctgcctgcctcagcctgccaaggtgctgggattacaggtgtgagccactgtgcctggcccaattttgtgaccatttcatataatattataagtattcctttactaaggcaacctgttaatataggtctctcagttgcaggcttttcttattctatggattgactaagaagcccccaaaaatccttatgaggaaagatagagtcatgtgtcataagagaaggctagtaataggcttgagtttcaaagaaaagagtttatcagactgaggagtaaagaacgttggtaactggccttcaaaagatagttaagattgcatccggaaagatgtggggaaggggatgtaaaatggatagcaaggcaggatagcaacagggcattcttggaatagacaaccatccatttgttctcagtgtgaaatatacatggttttgtaatgggaattaaggccgaaatggcatgtcaaggccagtagttgagagctttgtaggtcacattgaagagtttgtatttggagtttgatggactcctaggatggatctgtccagtggacaactggatttcagacctaggagagcctctatagaggtattaattgaagcctttggatgatcgagattgtgaagatagaatataagacagagcctcttgagcatttctcccttagtgagaagaaggtggtgatacacagaaggaaccttcagcaaggtgagaatgatagataaaggatggactttccccaagaaacctggcaagggagtgatcaggagtgttaatactgtcacagagactttaaagaggatcacaaatgaggggaaaccttggattttaatcttgactcttagtactcaaggaaactgcatgttaagatgtggtaattaaagtattaaaatattctaagggtcccttgcactctccctttctgtgcccattgtgacagcatggtcacatcattgcttgaggcatgcaagagtgctttattgaagatagtattacggggggagattttattttgatagagagtaacaaatagactaataatctatcttaaagtaagtatcttaaagtcagtaggcaaaggagaaaaaaagatattgataaggaaagcatctgcaggacagattctagatttctgttttttgttgttgtgtatgtcagggcccagactatgtaaatgatagggcaaaatgtgagtagcaacatagtcttattagaaacctaaatatctacaaagagagcaaaaaactatcaagtcaagaatatgttacccattttagtaaaaaggttagatttcatttgccttgtgtatttgtgtgtgtgtgtgtgtgtgtgtatgtatgtatgtgtgtgtgtgtgtgtgtgtgtgtatgacagtactgtattaggaatgcttagtaggcatttggagaagttttgggtgattggtaacatgaaccattcttccctttaatctggtgcatctgaacatattcctgggcagaaggtatacctgtgcacattacagacgtttgtgggtacttttatttcattatcctcaagcaagaatacgagattgctatattctacattagaccaacttgttcttagcaagcacagaataataacctttcagtgtgaatgtttgtacataatagtagtaggatgtattttgtggtattttttaaatgaggattcattttaggcttggcacagtggctcacgcctataatcccagcactttgggaggctgaggcaggaggatcgcttgattgagcccaggagtttgaagccagcctgggcaacatagtaaaacttcatctctacgaaaagtacaaaaattagctgggtgtagtggcacatacctgtggtcccagctacttgggaggctgaggtgggaggcttgagcctgggtggtggaggctgagtgagtgagagtgtgtcactgcactccagcctgggtgacagagtaagacagtctctcaaaaacatacatacatacatacatacatacatacatacatacatacatatgtacatgcatacatacatgcatacaaatgaggattcactttaaaaagcattgaaatgtaaatatcagctatacctgaatgtttataatttaaaggtaagattgtcattaaaggaaaccttaggaatttctcagacatactgaaaatcagcccgaaagtgttttctgttgtttggttgttgtcgttcttttaggattttatggagtactctcattacttatcacttagaccaaaagagaatgtcaaactgccaacaaagttgttttttctacatttctactaaataatgttaagtagtcaggttcatctttggaaggaagattcttaagtgctttggcctccagtagtttagatgagacttcttaaaactcaaaatcattttattggaaaatgctttattttctgtctttgtgaattatatttataataatgcatttaatttaggccttgggattttgtatacctttgggtgggcctcttcctcttctccccctgcatctctaataagcactgaatatcaaattgaaaccatgatattctgaaatcggaaagtttctgccttttgcagcttatttgatgggaataaaaatgactgatggcactctctcttggacccttttgttcaactcacctatgattatggagcctattagctggagttacaacctatttaagagcagtgcttaccagtaatgggggccaaatgattttggaaagttcagatgtactggactccctgcagaaatgaattcagcactgaacatattgatgcagaacccgaacgaggctactccagtgggacaaagagaattgtgagctctgcaagaaatgagtgggtagtagaattaaagatcagatagatgttcggctcaagggcagtctcagctcttaagttcatcacagcaatttaatcaggcccaaatgagcgttgcccagaaaggaatcagccttcggtgtgacaggaaatggagtttatttaaaagattctttgtttctagtaattgtgtgttaaggttttccaagtctacactaaaattacggaactactacatttgataggtgatagcactttggtttaccttggttcagaagatgtactgttgagaagatttatacaagtcatgatcttgtccagaaggagcctgccacctcaaaagttccagctctatcgtcttttggattaagtaggccagagtgcatctttggctatagctatctgatgcccccttccattgtaaaattattttcacaaaaatatatttgtctacagtaagagttatataatatagcagtaaagaccacaaactttagaatgaggcacacctgggttggaatcccacctcctccacttgttagctatatgaccttgagcaaattacaactgtagttgaacacatagttctttacttacgaaatgagaataataattcctgcctcacaagattatggggagaggtcaattaaatgatgtagtatgtatcagttgcttcacaatgtctgcacataataagggctcaataaatagtagttacagctctagagctctctcatcttgtccctcacctcatttgcccactcctctactctcttcatgagccagagtgttcactgctttaggaataagtgagggaaactttttttttcttttttctttctttcttttttttttttttttccgagacagagtctcgctctgtccccaggctggagtgcagtggcacgatgtcagctcactgcaacttctgcctcccgggttcaagcgattctcatgcctcagcctcctgagtagctgggattataggtgcccgccaccatgcccggctgatttttttttttttttttttgtatttttagcagagacagggtttcaccatgttggtcaggctagtctcgatcttttgaccttgtgatccacctgcctcggcctcgtaaagtgctgggattacaggcgtgagccactgtgcccggccaaataagggaaactttttagaggatctttggcttcagtcatggagaaaaagaagaaactataaacacttggaggtctgaacagttcattgattgttaagaacccaaacaaaaacactccgtccccaaccccgacacaacaatacagtggggtattttggattgacacattattagcctggaaacctatattgacagccaggttatgattttacacatgtaataagaagagtctattggtttttcttctttgttgctcactagttcttaagtttgctcactaatgtataggtatttttgtctaacactgacaaaatttgaaaagaagtataataaatttattaggattttacttctctccttcatggacctggcaaatagtgtatctatgtctccatacccatatccacgttcttattttttttatctgtatctattatctgtctctgtgtgtgtggaaagtgataatgaatgaatgaatgaatgataaaagatccaaactatgaactttatggatatcggggtaaacatccaacaatcccttaaatttggtgcactcaagtaaaagctgaactggagagagttgaccagatcctcttaaagttaagctttttatccctctgcccataatttgtaccttgagatcctatagggatgtgcctaggcctgtgtgaatggcagcctcatctatgctgtacctgcagtacagaccagcctcatctgtgctttacctgtaatacagagcgaaacatatctagagaaagagattagtttgcaattagggggatcccacccattccacagcttggcccagtggaggttccctgctttgatcgtctcttggtgaagagaagaagagacagcaagtgctgtagaaagttttcttctttgtagttaaagtgatagggtggaaacaggagcatagaaaagacattcagagaatagaaagtgaccaaccatttgaaaacctaaaggaagacctgggttcaaacatttgttaacatacagagaagaaaaatatgatctgtttggggtattacaatccagtgtgtattttctatcatacttaccaaatgtacttacttgttgtaaacatttaatatttgtttagtgctttgaagattcggagtaatgtttcagatctacatattgtatcaataagcaaataacatatgctaagcacttaaaggctattgtcattctccagctagtacagagcaaatgtgaaagggtaaagactatgtaatttcaggtgcggtttcagtgaggaagccagaacagcagtctactcttatctgctgctttcttccaccccaaccccctgacccataacaacaaaaatcaaacccagaacaaaccgcatagattgatcaaagagcataacatgcattgttaggatttcagatatgtagacagaaagtcagattaagctttaatgataattttgagttcttggagcaatgctcattgattacaatgtgtgtgtgctggggagcaatatttggggtacccataccttccctgggcatgttaaccttgtggggcttgccttgtttcagaacatgtttcctattaaaaaaagatgactgtaaaatcgtaggccttttctagcatgcacctcaaaactcttccagcctctacccatcacccagttccaaagccacttctgcttccacattttagttatttgttacagcagtaccctcccttcttggtaccagtttttgtcttagtccactcaggctgctataacaaaataccaaaaactaggtagcttataaacaacagaaatttatttctgacagttgtggaggctgggaattacaagatcaagatgctggcaggttcactgtcttgtgaggcctagtttctggttgtagatggcaccttctagctgtgtcctttacatggtagaaggggtacacgagctcctagggccttttttctaaaggcactaattcactcatgaaggcttcaccctcatgacctaaccacctccactaaaggcccacctcctaataccatcaccttggtagttaggatttcaacatgtagattttgagtggacataaacattcagaccacagtccctgtgaagaaggtatttgttattctggcagtgcaggagcaagctagcacacttgccatatttagctgatagaagtaatgtgaaatgaaccgttaggaggagggattttgtggaagaaggaatggcggactgagcaagataaaatatggagaattgctccctcttcaagaaacgcctccatcctgatgtatatcagctttcatatccccatggatattttacaggcattgctacctctttaaacatttatgctattaaaaaaatcagaccaattgttgacataaagctaacatagcagcttctatatagacagaatatgaattttttatgctgttgatgagaagtttatgtcatttatatactatagtagggtagaagatggatttggaatcctgaaaaagctactgtttgtaccattcagaatattagcttgtgctttgaatcgaaatattaagatacctgtattgtcaatgtgagtgtttctgtgcaaagtggcttacatatgggtggaatgggagaaattgctctacctggagaaaatagcaatagttttctttcgtttatgttttgttttgtgaaaggaagggttaatagcatttaatacctgatttatctgtgcttctctgcaccattaaaagaatgaactgttgtggtaataaaaccatatttcattgaattaaaagtgccatcacttgcaagatgcaacattattttatgtacctctaaaaaactacactaacaaactgacatgtcaaactgacatgccattgatgttaagatgcattccaatttcagagatgtaaatatactttaaaatgtatatcttggaatcaatgaaatactgcatatagttcttttgtggtatgtgtatatatgtatgtatacacacacatatatacatatgccacaagagaataaagtatacttctatttggttatagtctataatattttgaatcattttactgagttaggttttacttattttttaaagttgctgttgacatctgtttgataccattcatttaacatggcatgaatttagaatctctacttagaatagtcctttggaagccctagtttgttgagttttcaaaagaaaaaagagtctggtgcaaggaggcagactgacattcaagtcagatcattttttaaaaaaggaaagaaaggagggagggaggaaggaagaaaggaaggaagaggttcatcctgtcagttaggaaccagctatcttacttttcaaagacaaaatcagatcatactagtatatcacaatcccgtagtttatctaattgcatatttataattcttcttggatggtgtctctcatcttggattacctctctcacccaaaatcatattttattttgttttgtcattataaaatttactatatgatcattgcaaaacaaaaacaaaaaattaccagtacatataacaatactggatgtcatatattaagttcacaataaattatggcgatttttccacatcaataccttatcttcatgtttcacatcaatacataatcttaatttttagtgactgcatattatatcattgtatagtaaaacataatttttaaccatttccctattgatggacatttagattggttgcagtttatcactttaatggcatggctgccatgtactttctttttgtcacacttacccagtgatcattttaggatcaattcctagcaatttctggattgctggatcaaaggctctgtcttcatgttattatgtgttgggaagggaccatttcctcatctgttcaccaatacaggatatcagccatctcccaccccaccccatctttacctacttgattggttaaaaaaaaaatctatttttgtttttattagcatttttaaaattgtagttgaggttgaacaccttttcatatgttttggccttttcagagtggttcttgataatagaaagcacagcaggtcagagagcaaaaggtcttaatgaacttccattctgcttcacagaagcctatgaggttttgaggtaactttctcaagttcgttataaagaagatgaaactgatagaaaataactgtgatgtagagatggggtctggcccactttcagctggtctactctccagcactggaaaggaagactgagcatcagaaagccagggaagatccctccagaggtccaggattgttctgaggaatactgaaatcaaaaactctagactccttcctgctttctgagatgcagggatttgacagagaggtcaaaaaagggcccctttcctctgcatgtgcagcttttatttactattgtttcctttttgttgtattgaaatgtcttcattgcttgcctttatggatacaaataaccggatactgtaatttgaaagtagttaacaatgaaactgcatagtatgagccatgctgatttttttttttagtgggcaaatggggtgatttctctatgagcctctctgctgtcagaagctcttaacatttgagtcaacatgggaattatatttggaataaattagtaaattcccattcagcatgcctataccatgtaatcttcaggaaccgtaatgactgtgtagtagagtatatttccaacttggtatttataaaacacatttgctctgagaaacccttcagtatttgttcctcaaggcccagccctcatgctgcctcctttgttagtcagtgtttattttgtaatagttgggacagtgttgtacagtggaaacccatttgtctttggagttagcccagacataaatggactcttaggcctgctatttactagcagtattctcatgtttggaaatcaggagcaatgtaattgttgagacaatttattttaatgagagtaagtcatgcagtaagcatcaatcttagcacatatacatgttgtctttttttgtctccctgaaatcttcttcagctgcttccatgtactgatatcttcttccaaattccttaagagccttcatctgggtcatacattgacatttatttgatacttaatattgatagttatctcttgatgtttgtgtatgtctttgtatccataggatcctccattagcacatgtattcattcatcaaatatttattgagccacttctgtatattaggcatagagtaagatgctggaatatgttaatgaacaggagatgtggtcactgtgccctcctaatgcttacatcccagcaggcaagacctatatgaaacaaagtttgaattactaaatgaaagacatggcagttgctattagcaatgttgtaaggggctgtgaatgtagactagcttgtacatgacatttgagctgatatctattggctgagtaagagttagccaggtagaggtgggagtgataagtctttaggcagagaaagcagcacgttcaaagactctgaaacaggaaaggacttgtttcagtggtgcaatagaggatgagcaaaatgttctcagagaatggagtgcagaaagcaggccttcagagaggtcattggcagcgtaaaaatggggtaagaacggcaaccttgtgcagggtcttgaaggccaggtgtaggttccagtctgtcacctgagagcaacaggaagatactgaagggttaaaggtttacctgtggaagagtatcagtaaaacataaatggatagattctaagtgagtctactttaagctggagtttggagtcgcagggtcctgcgtgtgtaccaccatactctctacacttttaaaactaaaacagaaagtattctaaaacataaaacaaaactggattgtattttcaactgttccttcaactctgaaatactatgattatgctagagtatgagaaattttattttccaaacaaatataaagatgtatttctgatgaaaaacattttcaacctaagctaaaaggaaatctaatgaaaactttaaggatcctttaaaatactaatattgtgtttaaagagaaaatgatacttgtctttaaaatgttttaaaacatttaaaatatgctactgaatataagtgaagagtggtagatcctaaagtagtatttcttagaagagtagaataggttatttccaaaatctttttcatggaattttagtgaaagctaccatagggatcatgttgtccagcctctttgtccttataaaaacatcaatatcttcataaatcaagaaaatgagtcccaaaattggacacatgagctacccattttctaagattttgctgaacggaactttgatcataggggtctctttctaaggcaacgtattagaaactcccagcatcactgtattccttataagaatcatattttttacattaatctccagaatcaaactacaagacaattaagttgttgcttttaccaggttgaaacttgccttgatttactatgaatgttggttgccttgatttcttctactttttgtctcagttctacatgttgttgttcttctggttttgctccttatgagattcgctggatctctgtatctcttcaactgtggtgagtttcatggacagggtcagaacttagggaaatgttgagaatagggtgtggtcctatgatgggtcctcctcttcttacaccttcgactgttgtaccactctttgatgttacaaagatgaatgacttgtggtccttggcccagagtttcatattctggataaattattatttatttgtagtgtacttctatatttttacatgctgtcagaatattagaaatacagtgtttcctgtcagaaatgccagctgagcaaaagccagtaagtcagatactaatgaatggattagcaaattatagggactaatgaaattaaataaagattattcaactaaactagtggctcctcccagtagtttagagcgttgctgaccaccttctttttgtccactcacatattagaattaaaaatgtcaaagtaaaattaaaataacattctcacctacaagaggtagggagaaggaaagtaatatttatctttaatgttattttcagttgtgcatttattatgtatatttttgcataaaataacttgtagtttttgtttggacaagccaatcaaatgagtctttaagatgaagaaggagagcgaacccacaagagatgagtttcgtatgtcttctcaaaaaaaaaaaaaaatttttttttagctcaccaaaaaatgttatgaaatgagaattttgaaaccttacctgtggaaatcacagtggtaatacttatatttcagcccttagatattcccagtggtgttttgatcttagatattcccccaaaggtgttgattagattctggctacagctgaaggaagagaatttttgctttttagctgaatagtaaaacaagcctctaaagatatgaggcatgggggaaaaaaactaaaggcttcttcaaggtggtgtaagggcataatttttgtcatctttattttaagagctctaccaggccagacgcggtgactcacgcctgtaatcccagcactttgggaggccgaggcgagtggatcacgaggtcaggatattgagaccacggtgaaaccccatctctactaaaaatacaaaaaaaattagccaggcatggtggcgggtgcctgtagtcccagctactcaggaggctgaggcaggaaaatggcgtgaacccgggaggcggaggttgcagtgagcccagatcgtgccactgcactccagcctgggcgacagagcaagactccgtctcaaaaaacaaaaaaaaagctttgccaaaggtttccccttagtaaagaatttaatacttgaagtcatcagattagatttcagacttcatttacccgctctatgcatttttttcgtcttcctgggtttggtctgcctgtgcttcttagtctacaggtgtcttttctctgtactgccaacctctaattggagatttattaggtgctcttaagtaagagaggaggaaggccaaaggagacagaaaatggagaagcaagaagaaactgatcaaggcaggagagggaggaactggagaggatggagataaaagatgtataaatgaagacaaatggaagaacaatgagatagagaggcctgaatggtagaaaaattctaaaactgagctagtgagaatgcatataaaataggggtctggtagaagaacttcagcaaaagtggtgtaaatcaatgatgagtaaattaatagggcaattgtgcaaatgggactcactcatttatactaagcgtaatacatcatgaatgatttagagataatgcaacccgtagggcataccttttaatctacccaggacccggtagagaatgctgtcacttcaagagtaaaaaggcagaggatcagaatattgggtgtgtctcttcattctaacagtgttaatgagatagattctgagcaacatgaaaattaaccagactcacaagcttagtttgtgatttatagattgaaaagaagcttaatatattccaaacatcttcctacaaacccaaaatatttaagtgttttgaaagtattcatttgaataggttaacatgtgtgattgccatggatggaaatgaaagtaaaatgagtcactgcacatatgatccaaggaacatctgagtgttaagtgggttgtaactgcataagaatccagtgctattggaagatgcatcagagtattctgagaccagggaataaaattctcttccatgtgctcccttctctttcattcgtgtgcctattcactcaccattcaataggtgtctatcgacagccttctgtgtggaaggtactgaggaatgtcctatgggttgctgcttctacctgaaacagaaacataagatttacatccctcaggccctcttaccagtatttttatgggaggatattgaggaagggaagggagaaagtgaatataagaagtggagagaagtcttggtttatagagctgttagggttccaagtctgctgttctttcttgattcagaaatggaagctcacaaaggttgtgtctggaccaaagacccaagatagttggagtgttgaggattagatgattttgggcttcccttctagttcattcttagaatttattcccagtttttgtgtttatgaaagttagagatacagtcttcaaccattaggagttagaggtgaaaataatagtaattggatgttaccaagtatgtaaacacttgtagggaagggaaatacataaataactaaattctctattaaattctgattctgaaaacttcaaaacagacctaatttagtaagaggggctgcatttttatatgtgatcccacagaatgcttctagacttctgtcactgatggggaaaaatcaaattattcaaagtcttgcaccatataacaaaaaagctaaactaagacgagatttcagggagtatagaaaccagcaatttgtgaaaaatcttgtgtatgaagagtcatgatgtagaacattcaaacaaatggatcacaagagatttctcaaagcatgtcttagaggtgagcaggcaggcatcaattttaaaattctctgttataaatgatcataagcttatgtttttctgtgtaaaggagaaataatttcccaattttataaaacaaattaccaatgatgtaaaaaaaacatttagcacagtattatatcagagggcatttaacattcttttgaatcatttgagattttcatgtttccatttcagagatcagggaagatgtgccttggagaggaagcatgtcttaaatctggaaatgatatgaagagggatgtcagcaacacttcatcctgggccagtaatagggagagtttcttttctctcgtcaaattgcttaaaggattctagttccgtttggtgtggtcactcacatttgaattctaatactctatgtgatatagattctgttgactactgttagcgtgaccccaatgagaaattaaacacttccctccttttcatttgcagtgtgttttagtttaaccttcatttgtttctcttttctccattcctcatcccaattcaggtatcagatcctttgacaattgttaacctgcccagctgggatttttggcattaagctatgactgtaacgtttctactaataaattagattttttaaaagagtgctgcttgccaagaagcaaagtcattacatagtgtgtatatgttcaatgtatggctataaaagtctccttagccaaacataatcgacagttaaaataaatttaaaataaccgtgctacctctagattttaaaattgttaaggtgaagataggtggtctaattttactctatttccatttttcttattcacagggtatatttgttctgtaaaaccacatatgtatcttatagtctgcagctgatgtatttatctgcctaaatacacatttctccaatggaatattctgtaatatcaagcatttcttttttagatggaaattaattttataacagttgaacatcatctttgtcaatcagcagctttatctaccataaagaacaaaaacgtacttggcgtggcctgctttaacttttgtagttcctatgtttaaactgaacagaggaatattatgtgaacaaattggaaaattatataaagaaataaaaatctttttactattatagttatctttaccccatagctttcaaaaaggcatttgaagcaatttaataaaataggaataacagtaagtactagatgtgagaggtgagaaaacaactttgtaaatcacccatctcacgaagttgcacagaggttcctgatagcccagacaatgaaataatgtgataattcctattttcagaaaagataactagctccttattttgttttgggtgtagaatgggggaagtggtatatttttgctaagttctaaattcttaggaaaatgttcacatgggttttgagagtcactgtataactgacaatgtccccagttacagatttccagaaaattcagacatggaattcatgttactcattttagttctaacctttgatgaaagattagggcattagattgaagcttaagtaagcaaaggcattcttcaggtgatgtggttcattctaatcagtaattttatgatggtgttcatattccattccaatgatcaaatggactagtaagcttgagaaataagacaaactagagagagagattattttataaatatgaaggaggctagtgaaattttggtccagatggaaagccacccactctcccaggtcaggactgcatagatgaagtataagcaaaaccgtcattcacactttgaaggtgctgctttagagagatgtcattatatgtggtgtcagatttttcaccctgttcagtactgggcactgatttttaaaaccacttatctatattttttaaatgtcttctgactcattggattgattttgtggacctactggtagtctttggatatcccccagttaatctttgcttccatgatgagcatttattgaattctattcttatgccaggcactgtactagattttaggagtacagtagtcaggttttccttgccttcatggagtctctggtcaaatactttggttcttatatagcggttcatgttccgacacgtggttacccacacaggctttagttaacatctgcatcacctgctgcacattctcatctaaaatgcgtatgtgaaagtacagttgtagccactcagtgtcactcaccagtggggctttaggcctgagactttccgatagcctctaattatgtaaaaccatgcctgtattcaggagtcagaagtgatcaaaatgttttaggaagcacaccgtcagcatagatgtgtcaactcagcagcaagatttttcattcttttaaagttacacatttcataaagaagaagggtatcagtgtaaacttctaaatgcaggacaaaatgcatgattggggatggagattggagtggacttgttcaaagagcagcagcaaatgagacattaaaggaatacataggaagccacttccaagtacttccatttttctttagttgtgattgtgagatggttccctactagttagagaaggaaaattttaaaatgctttgctaaacagatgatccttaaattggtcactgtataccgtgatgcagcctaatcaaaatggtattcctttgagtgagtgagccacagagactctcgccaaccccttgtgcagctttctattaacagtataaatactccattgttgtaaagcagtttatggttaacaaagcgctgtcacagacacgttatcttagttttgcagattgcctttgtacatgttattctcatttcctagcatgccctctatccctgctttgcctgcttagcaagctcattcttatccttcaggacataacaccaactctgcaaagtcctcttgagacccttctgagcaggtagatggtcccttccccgtacttacacaagccctgatctcatctctgttgtcatttgttcacatcactgtttctccctggagactgagtctctcaagggtaaggacactgtgtgctcttcatttttcttcccagtgcctttgtaaccagtcttcctgggggatactttgtaagtaaaggtgaatactgtatggtgtgcagcttaggagagcttaagccacttcctaagttaagatactaagtagtagataagagtaaaacttaagtgtcttaactcctgtttttatcggtttttctggtttatcagtttattgctcatctgaaaacaagctgtccacatcatactcatgctgttctacctgtcagagatatattacatggtaaatgtgagtgataaaggaggataagttctttgtcagaatgaggacatttcggttctgtcatcatgcctgaaatgcatgatttcacatgatttccatgtgaaataaaacattggtataaaagggatatggacaaatttgtggatgttagaaccacacctttttctctgaatttattttcttctcactcctacttggcatattccctgtcattgtttgagagtgtgcaccaatgtcctcgtctcagggacaccatttctttcccgctattagagtgtctggatgatgccgtacccttagtgcactgtcctgttgaaaatttggtacattagttattttaaggtttaaaaacattgctgcctacataatattccacctctttggagcatttgcattggagtgaccagtggcttgaagctctgtatggtggagtgactgatggtagttgaagactgcaaaagtaggtatctgagggctggaaggcattcctggcacccctaaaactaccccactgggggccatccaagcctgtgattaacaaaccctagttatttgctaggtagtttccacatggcatagtaggatatatatatgtgaggcacaatacagtgtttatgtgagaataatatagattatttgaatctaggctgcagaacctacctgaaaatgggttttacagttttgtgtaattgccttttctttgtgtttgcatagaaggcattgcatagctggaagatgatggcaattataatttattatgctgtaattgttacctaaatgtttttgaataagcaaaaatcacatctgtttaggaataagttgcacagcaagagaattccctttgaaatgaataccgtgttctcatattctgtaactgtacacataaaacaacatatttatttccccactgagtccattacattcccaagtcaaactgcatcctctcttcctttcccatattaaaccctttgatttaatggaggttttaactactggttctttagggaattttcagtaggctttgcacagattaggttattggaaagtatagttatttgcttgtaaagtggcagttctgtgtcaaaattgcttttctctggagctgcaacagtaaaaacgataagcttctgctttgcatccaaaatgccctgatgttcctagcatgatcgtttttcctttgcttcttgctcagcaccattcggtcacaggctggtttggacaggcgaatatgagcacatgtagcccagaggactttgatatccagtggtgataatagacaaggcctgtcttccattctggttgccactggtctgtgacaaccagtgttccgggcatggtgagcatagtgctgcttcccttctccgttaaataggaaatgcataagcctggagtcgttttgtttgttccacagaaacgtagcagttgaaataattgccttgccatgcccaggctaacaggatttatcttccattatagatcatgaagacataggcaagaatagtttactcctctaaatttactaggctactcacttcgaaatgatttcactgtgtaaaagagaacagtcctagctgtggcttagcctagaaaggctttgatacctagaaagatgaagggcagaagtgtattctctatttttctgctcccagctcataaaatagaattggagtttatgtaaatagcagatagcctgattttattttttatgccccagttgcaagttagtgtctccttaagatgggtcttaatcactgacgttgtgtgcttccattcagcacctatctgtctattaagtggcattctagtggcctccaagagttgagtactttattctgatcagagtcagcctgggtgaccaagatgggctgtatcaatctgttacacctcagacccactggaggccacaatctttgagtgtcttttggaagatactgtcctatgttgttctagaatgctgactcctactgcttaaacctccgttctctctctgtttttatcttaggccagatgtcctttataaattttgattttttgttttttgggttttgtttttggagtttggatctcttagttttcatcctgaatactgttccacactgcatatttaatcagttaaatcttggtctcctggctttgaccatcaaatgttactctattgcctcaactctattgagttactccaactcaactgctcccacctcagggtctttcactacccattcataggcagtagccccttgtttctcttcttcgtgaaacctgagttttccttattgtacttatctcaggcattaatggatctgtgaagaagtatgacgttaagcttaaaggatcaaaaactgggcttccctatgtatgtttcaagtttcatttgtgtgaccaagagagttcatagtatagatttgaagagttcaatcaagaagctaagatattaactcatcttagtaatagccttttgtctacttcatccatctgcccatctgtctgtcaatctgtatacattattgataacttccaatgttgtaaacactgggaataccaaaaaaaaaagaatgagccatgcacctttccttcgtaatgactacattaaagccccaagacatgaagctacttgctgagccttgcagctgacctgtggcatagtggagactagaacccatttctagagggatcttcctcatacttcccaaggtcagttctctttaggcctttggtattcctgtcttagttgttgtaagagtagatttcgactcatcaaacatttgtgatttggaagtatcgcatagttgaagaattgaagaaagctgatgggaacaaagtcattttcaagtttacttgagcacatagatatcatgttgactactttgctgaatattcagaatcatttatatttagtatagtaaaagtgaaaagtatctgtttttaaaatttggaaaacacacgaaatacaatgaagaaaactaaagtaacaaccattttactactctttttatgtatttcctttgagtagatatcaaatatatcagcattttcagcatatacgtacagttttgtgtcctgcctttttcccttcaactatataatcagcatcttcccacatcgtgagatgtgaattttttgaaaacatgataattaatgcaatatgttatttcaaagtaaaaactttttatttaactattattgtgtgtgtaactttattttctgtgtttaggttgtttctgatttttcacccttatcaaccatgctgaggcatgaacttcctattaataaatcattgtgtacatctgtcagtatttccttaggataaatttcttttagttctattactgcatctgaggaaattaacatatcaaagctattgatatgtatttccctgggtatacatttttttttttttttttttgagacagtgtcttgctctgtcacccaggctggagttcagtggtgttatcacagctcgctgcagcctggactgcttgggctcaagtgattctcccaccttagcctcctgagtagctgggaccacaggtgtgcaccataatgcctgactttttttttttttttttttcaatttatagagacaaggtctcactatgttgcccaggctggtttcgaacttttggactcaagccatcctcccaccttgacctcccaaacttctgggattacagatgtaagctgctatgctaggcctcccagggtatacttttaaccctgccttacaccacccagaattcaaagcatggaatccttgacccagtagccagagtatttcttatcttaagtttaggaaagactactctgtggtcaaatgtagtcacagaatttctttccaacaaagctgtctacgtagttaactgagaaccgtctccaaagggttgttcctcttgagggaggtttcagagaagagatggcattgatgtaagtcttgaagaagttagagctcaaaatattgtgaagaggaagataatttttttttttttttttttatcgagacagagtctcgctctgtcacccagactggagtgcagtgacgcatctcggcccactgcaagctctgcctcccgggttcacgccattctcctgccccagcctcccaagtagctgggactacaggcgcctgccaccacacccgggtaatttttttttttatatttgtagtagagatggggtttcaccgtgttagccaggatagtctcgatctcctgacctcgtgatcctcccgcctcagcctcccaaagtgttgggattacaggcgtgagccaccacacctgaacgatgaatttttctaccaggacaaacaggatgttcagaaggaagacattgttagaactgtacataatcttagacatcatctatcccagtggtttatcaaatattttcacagacaaaacattttttcaagccaaatcttgtctagagtactacaaactgattgaagtgaaatgtctccagttaaatcacagtggatgggagagctcggaattgagggtagaacctcctttgctcagctttcttagagcttcctatgcacctgaaaaacccaaagcctctttttttggttttttttgggttttttttgttttgttttttgagacggaatctcacttttttgctgaggctggagtgcagtggcactgtgtcagctcactgcaacctctgtctcctggattcaagcaattcttctgcctcagcctcccgagtagctgggattacaggcggccaccaccacgcccagctagtttttatatttttagtagagatggggtttcaccatgttggccagactggtctcgaactcctgaccttaggtgatccacccacctcagccccgcaaagtgctgggattccaggtgtaagccactgcacctggcccaaagtctctttaaaaaacaaattttaagtcactccagtttgaagtttaggacacagagacaaactgtgactttcctcaaggtcagtcagaagtgattctgaaaccacctttcagtactttaaccctgtccaaaagcagccattttagtgcttttatcactagatgttcccatgcaggttgagagagattatttctgttctgttaggttatgcattgttgcagtgtcccaagagataaagtcccaagatattaatgtaagtattagcttctgtaagatgttaccccaatccatattaaccatgtctggctgaggcatgaaggatctattaaattatatccaggttcctattaaatcactacactggcagtaatacctgggctcaccttctccttaacccaaattaacacatgctgttagtggtctcaagtctaaggcaagttcctgagatgaacaagtgactgggaaaacaggagaggagaaaattaaaataaatgataggctgaccttctcacaccacttgtggtttctcaattaaccaaaagccagacagctccacgttgctgttctctcagtaataggtttcaccctcccatttaatgccagcccacacgggtgcacacacagacacacactttgctaatcagattggcagcaaatagaattaaaccattaaggcaattaagcaattcttagataacatttgatcagttcaatgaaaatgcaaattcattcttcttttggagaaataagttgatggaaagtcatttcgtgttctataatcataattaactcttttccaaataaagattgcaatgttttgggcttggagctacacagatggaaatgatttttttcattttttgcttcactctgttcatccttttgtaatgcaccatgtttttctgcctccagactctttgggacatttaggtcatcttacctacaatctcttccttgtgcctcaaggcaaactctgttatttactctcacacatgatgactcatgcattaaacacctccttagaccctgagttcggaatagatcctacagcattctggaatgattttggtcggatattcatgtgttgtagatgcactacttggctgcttctcatttctctctattccccacacttacggtttctcctctctcacaagctggtggggaagagaatgttgcacccaaaaataggtgcttgaaaatgagcgtgtggtgtctgcattttcatttctagattggtatcattgaagcctacgttccattctgccaccacagcctgaactttcagcaagaaaatgatgagcaccttgcagcccgtgcttccctcacctgccaaggtgcctttgtgctctagctcagggtttccaaacctggtacatcatcagctggggacatttggaaatatttatagtccacagggttttaatccagacctatagaatcggtatgtcccaggtttggcttagggattttcttttgcttttgtttttttcctttaaaaaaaaaaaaatctttctgtttgataatagggatcagccagtcttaagtctagatgccattttttttctacattggagaccataacatgtagtctgatgcatgatctgtcaatgacacagaaatcacttggatccaaagaattttatgatagccttgcttataaagaaaaataacaccttatgtggcaggtcattttatagatacacacatatgaatagtccactgcatcatgcgtgtgtatatgtgtatatcaagtgtctttagaggtaggtaaaacataagaggcagctgttatcacctagggcaggggtgtccaatcttttggcttccttgggctacattggaagaagaattgtcttaggccacgcataaaatacagtaacactaacgatagctgatgagctagaaaaataataataataatggcagaaacatctcaaaatgttttaacaaagtttacaaatttgttgggccacattcagagctgtcctgagccacgtgcgggctgcgggttccacaagcttggcctagctagatattatatttaatgtatctccttttcagtcttaataaagtattgcagccaactcccatccagcaggacacatggacttagtgtgcctacctgcaggtttttgagcatgaatgtaaatattaatagaaaaattgtgaatgcttctcaggaatgtcaccagtgatttttttcccccaaagaaacctttagttttgctaatccctttactagtacatgtttgtagaacacatctttttgagaattttttggggatactgatcagctactattaaagccatcaagccagcggtgccaccagtgtcacaaggaagaacgatgttttgggaagggattgagctcagcattccaggaaatattttttacctattcattactgcatgcataggcttacattttctcaatttaaaaatacttctaaagggtgggcttttgggatgtagacacataatgttctcagcaatactgtaaagcctcattaatttgctaaacaaataagtgagatggtaaaggatattgcatagattgtaagggcacatttaatcatctgaggtttaactggctctaaaggcaacaccttttcaagctcttaagagtctatatttacatggatagtaggtcttcttccttcattaaacttgccctctaagaccttttagctgttagttagaattacattttgaacttcaggataattctatatttctttcttaaaataaattctttatatgagcatttagaccataattcaaactgaggtttcctataagttctgtgttatattttatttgcgtgcatagtgatattcataccacatctgttaaagtatgaagggaggaaaatgtcagcaagtgtattgtgtctctgctcacaataattttccaatgaaagttcacttaaatgagggattcatatatattaaggactgttgttggtgattagtacataaaaatgtgggtttttctcataagtggttttaaaacttcagactgagtacctcttttgtttaatttttgcacttcttggaggcataaggtattttagtatgtgtggatcttttttattgagtttgcatagtttaggagttttttggcttaaaataaaatagggaaaaaaagctctcttaaaatagtatcctttcttgaacccataaagtagggctttgaagacgtgcaacatttgtgaggttctaaagaggggattttgtggtgttctttccagtgcttccttccttccgtcctcaccaccctgctgtaatctgataacaaataactttccagtcagtcaatttaaattatatgtaggctgcaattttttaaaatttcataatggatgctatttaaacacaaacatacatttaaaaaaaatgccatactaaagtccaaaaggaatggtgacagacattttatttatttagagacaagttctcgccctgtcacccaggatacagtggtgtgatcttggctcactgcaacttctgcctcccaggctcaagcaatcctcccacctcagcctcccaagtagctgggaccacaagtgtgcaccacgatgcctgtgttttgttttttgtggtttttttttttggtattttttgtagaggcgcattctcgccatattgcccaggcttatctggaactcctgagctcaagctgtctgcccaccgcacccagctgacattttaaatatttatttatagagcttcattatttgtacagtgcccttaaagccaaaggcattgattaggcttatagaaattgcaattaggccatgcacagtggctcatgcttgtaatcccagcactttgggaggccaacgtgggaggatcgcttgagctgaggagttcgagactagcctgggcaacatagcaagaccttgtctctagtaaaaattcagtttaaaaaagtgggcatggtggtgcaggctggtattcccaggaggctagggtgagaggattgcttaagctggggagattgaggctgcagtgagctatgattgtgccactgcacttctgcctaggtgacagcaagaccttgtctcaaaaaaaaaacaatgtagtgagtcatagttatactaaatgggcttgaatactataactagttttagtgttatagtcattaaaaaacaccataattccaaatggatataccaattactgcttgcttatcttatgcatccttttcctctcctctctatcccccaaaaccactcttgaaatcttcctgtccttttgctcttatcctacctggccatctatccaccatttatctagtataatttccataataaaaccaccagcttgcattagtgtgttggttacttcaaaggtggctaaattagagactttggttaaggacaccaaattcttaccaatttgatggtcttgaggggcaggctgtctggctcatctcttttctatctgctgcccaccttttactgcctgccccactaagcacttctcatcatgtccgaggagagagtaagtgggtgcgtgcatgcgtgctgcaagtatctgcatggcattctttttcctgaaagatcttctttttttttttttttttggccatcatttccattctgtcctaatatatcctttctctttaaaaaccagcatctagccaaggcattgatgaaaagttttctttgagctcccttgtggctgtgcagaagagtttattcctgaggttgctctcatttagggttggaatctttgaagataaaatacttcttcctacctctcacttgagatcaaggaaacctacataagactcccagagcaaaaggaccctgtaacacttgtgccttggcattgccatatgctctgttgcgcaggaatggggaggaacggccatccacatgccacccccacttccactcggaaataatagggggtgacaaatggctgctgcattctattctgttttaccaggctgtttctttcctgccctcaagaggtttctgactttctgacagcagggagctgaggttgatctagcaactgggaggattgcacctggatttgcagaaatacacatgcacatgtgtgcacgcacacacacacgcgcgcgcgcgcacatacacacacacacacacacacacacacacacacacagtgctgctgcaactcccagagtatcacataatcactcttctggctttagtggttttcctttggccacactctgctcttgtttggcttgctagcacagtaatcagaggaaagacagagactctttgcactctaatccccttgtgggttacagtagtttcagatagaagacactccagagggtgctatacaatttggaggtttataaaggccatcttctggcccccatttccctttaagaaatgagcccctcaatctgcattatacatgttcccttactgctagaagggttttactggtgccctgacactcttctcttcctcacccctcccagagcaagaactacaaaaacatagtttttttctcattttcttttagatgtatctgctgccatttattttctctctggtgattgtgtgatataggaaggggaagcatcaatggcttctttatatcctaaccacattccttgactgggccctgtttcacatctctgactcctctagagattactcagccaacatgctgcccctcctcagcgcatcaccttcttgggtctcagggcttggcattttcattcagccttgcagttccatgctcatcaccaacactgcagacatctgctgccactttcctgcctaaagcaagggaattcctgtgattcacaccgtgagcagaagcaggggtcctcttctactcagcattatcccagtttgtctcactcctttagccaatatcatgaaactctgaaactttatagcaggatgaaaacttaagcctgtagtctaaagacccagaattatgagtgaggaaactgaggccaggagagccatgaatgatagtgtttacttgattgctgtttcagatttcaccagcttttattgatacttcagcattttacttagtcgatatatctcttcgtgtgactcaaagtatcccagtggagcacagttaactgccctggatccgaattgccactggaggccgtggcagtgtcggcatcaatagggatcacccatgaccttttatttgggatgtagtagggggtctgaagttgggaaagtctgaggtggtactcagttctgggttgaatgtcttgtgaaaatcctgtgaatacatcttgcggagaaacacagaggggaaaacttcctgttgtgagagcagggctggttcccttttaaaaaggtataggatgaatattccatatttgaaatacttgagaccagaagtgttttggatttttaacttttttttttttttttttttttggaaatgctctggtgaacatttccttagagtgtcatgtgacactcaaatagtttcagattttggagcatttcggatttgggatgctcaacctataatacccaaaggctctatttcagtagaatttattggtttgctgattatagcagtgacatagttgcattctagagaccttagaaaatgcagaaaatttcaagaaaaacatttaaattgtgctcatagtgaaactgagaggtgaccactcttaatattttgtggcataagcattccagtcttttatctttctcaaagtttcacataaactttctcaaaggccattaaatacttttccatagcctgattttttgtgaccacatagtatcctattatattgataataccataatttacctaacccatttttatatatttggattttttccaattcatcattattatgaataatggtgtatctcagtggttattactttgcactgcatttcttatgaaagtattgagtaaaaggaagtaaagccctctcagagtgttttgtaggctgtcacatttcactccataatgtcctagtgtttgttgccaccagtgatatatgaaggtacccactgaaatgtcacacctttttggttttcctttttaaaataaaaaataaaaaagacatttaaccatataatattgttcttatatatgatttattataatgtagattcacatctttgagttcataaaaatattgaatttggattctctccaatttcccttttagtagaaaggctaaagttcggtaagaaattctacttggaattttattgaattgagaaacatacttggatttctgtaactcatgacaagtaacaaataaacaattagccaattaattaaaatatctgttaaaaccttgagtaatgcagagatttagttaggcagtgtagtttaaaaaaatcaaacaaaccagacctatgctgatctccttggagatgaccatcaacaggaaagatagactttaaacagtgtatgttgacatagagcaagtttctaattttccatcatttcaaggtgctggaaattatatggacataaatgcctttataatatgtgtacatctggtgagtataaattctcagatttgaggacatttccaataaaagactcacatacaaagtataaaaccagtaagcaatggaatgctaatcaagtaatgaaggattcaggaaagaaaataaaattatgccaaaccatgtaggccaagaaatgcaagtgggaaaaaaaaaaacttaagctgatgtcaaagtcaaaataaaatgtagagacaaatctctaaatttaatgttttatttgggaatcatagaatcacatttggggcatgcaaacagactgggtggtcttcagcatgtccaaagaacaaaggaaagattgggggttttattagaaagggaaatgttacttacagttttgaaagaaagctcattgaccctagagaagcttgtgggagctgcccgggtctgattggtgagtgatggtagtagataaaactagtcttaaagtcatagcaggttgtttcagcagctgctaagtaaaactggtcttatggttacagcaggctgtttcaacagctgggcttggagaaaactcaattcttggagcatgtgctgtgtcttgagtactttttcccgctgctctgtcaactcttctttagttgggcatgacaagaatgatgcaatttgcataatcaactttcacactgagtttcctgtagcctatacaaaacataaatattagtgtttttttacctttttacagtttttattgtattgtctattgaagtgaaacattaaagttatcagaatagagaaacatttgcctatcactacacattgagaagatactgtaaagagacttgaacaaacactgggcagtatgatgcgtagaactttcagtctagtttttacaagaaaaagaaaagaactgtgctaaccattttgttcatcaatataaactcaagtaatgaggttaaattgtagttctttgcagagtgcctggccaccaggtccgtaatcgctggaggtttgattagatattgagaaagaaatctgcaaaccttggcaaaatttgctgcataattccaagactgctggttcttaaatttatctccatcaaaacacagatgtcctgtgagctggactaagccatctcactatctataatcaaattattgctttcttttttttcccactgaaagatcgaaaaagaaaaaatgggtaaaaattcttagataactgtttttgtaatgtgtatttttgttgaaccttgcctcattgtataatcaagtaacaaatatgaatagaaaatactattgactatggatggtacttagctcaacagcttattttgaagaggaaaccatcatgtttttaaatatgaaacataatcatgtactttacgaataaaattcttcctatttcttacaacaaaattgaacatttcaggatttaatggtgttccatagccactagcacgcagtagctcataatttcaaggtgtttgaccacatcggtcagtttgaaaatcatacctgaccatcactattgaacacctgaagtgcaagcatccatgatggagactggagctgtccattggctactgcctttcagactaggggtggcaaacctgaccctttgttataaaaatgaaagccctcaaacgtgttcttgtcctcacgaagatttttgtctctactgaaatgcctgtaggccatttttggaaattatagctagtgtgctcactaaagtttttcttatgtgccagacacatgctctagctttacatacaatagctgtaaacctcacacaaccttgtaaggtagagagcattattatctgtattttattggtagggaaactgagaggctaagtgccttggccaagatcaccaagttatgaaatcacacgaaaggagagcctagatccctctaccagcactccttcctctatatgcactgccttgcagtaatcaagacttcactaaaagcaatttcagatctctgcaaatgtttgaacaagagctctgttgaaatgccataaaatataggatataaccttagctttgaaacattttgaggggagttaccaacttaaaaaaaaaaatgtttacctttgagcataaccacatccgaaagagtcacagagctagtcacagaatgtacccctcgataagtaaacaacataacctgttgaataagtaagtagtttagtcttctctgcctgcatgttgctaaaaataacttttgctttggtatagaagttttgaaagttgtgtagttcaatgaatatttgttgacagtgattgaaacttacattgtttctctcatgctaatcttgccaagctttggtggtcttcaagtatttgaaacaagaaagggccaggccagagccctcgttttcagatatgggacaacaaccaggctttctccatttgaaggaagaggaaagagataagggaattgttgcagtgaatcctgtgggccccaggagttataacaattgttttctaggacatacccatttcactcttcttaattttctgccatcagcatttctggggatgtactaggaaaatggaaggaacatacccagcttccagggtttcagtagtaaagtatagactagtttaagagcaaattgattagatcacttctactcctatgatgtccatttctcatataaagataagctgagaaaggtttattttaaaattaaagctagttgtttaaaagtgcggctgaagttaactcatggattgccctaaagtattgagctgtgattataaaaaaatgtttaccaaatattgtcactatggctcttatgtagtgaagagaagaatttagccttaaattagttaaaatgtgcaaaccgtttagaacagtgcttaacatatagtaagtgctccataggtattacctatgctttagaacagtagttctcaactggtgtaccacacggcacaagtatatctttatcctttctcagacatgtgccgaaacatctatacacatattaatttttttttgtatagccaaatatgtaggtgaagtgcacactgatgtttcacttggctgaataaaataagaggtgagagacacagtgtaatgtcaagtctttgcttaccagagtgaaatggggcatcgcctttcgggtctataggggtgcactgagcagtcccgttaaaaaggcacatgttcaaaaagactaaccaggtgagcagcatgttaattaccactgcttttaagaacactggaaaggcaagtggttgtatggtagtagcaattacattgtaattactgtgacttagttagaagtttttgaaccccttttgtatttcaaattgccctgtacatacaaagtgggtcagaaccatcagttaagaattagtggggtcagttcctgtctgtagctattaaagtgatttatttattgtcttataacattatactatattaatttacacatagccttggaaaaactctttctcagacttctaggccagagtctaaatacatttatgaaacttctcaggaccaggttttgatagtgcggagatcagggagagcctaaaatcataagacttctctaatagagttaggtcattaaagaatatgaatatatgaagagtagggcattagagacaacattctatacctaacattttggtccaaatcctataaaggtttctcacatagaaagctgcctttttgcatgtactacagcttgtgtctctaatatcctttctgtaccaatacacaccacatatctgattattgttcaaatactcctcttaacttaccaatgaaagcttcagatcacttaaagagattgcagatactatagtgaacatagtagaaaatcattattctattgtatagtaaaacccatgagttacatctaaaatgttactactgtttttatgtagtctttaaaaaaagagattatgaaggtttacaattatagtaaaacttattaagtagatgcatcaataggaaaagaaaccattatcctttcaacccagtcctatttcataaatagcacatcagcgcttcagtgattaagaaacatggctcatctttgcagcatgttgcttttattactttttgcccacggacctaagaggggagaggtaaagtgatagaggaaaaagctccaaggcaaatcaagttcacatatttttatttaaggattctaggaactcgaagactgaatcaaacttgttacttagtttttcactggaataatggctctatttctatagtagagtgagtagaaggttaatggtatctgccattgatggtttactaactggttaaataactgattgaaatgtggtaaagggagatgaaaacaaactaaatctttttttttttttttggcccagattttcacgtttagatgccatgaagcttttgattgtgggtctaaagacaaactgtgacagtgattggaggcttcttttaggggtcgggagatatatggaaggacaaggaggacagaggaattcaatctcctatgcagtctctgcacctgttcactaagaaataagtcagctgaggccggacgcggtggctcacgcctgtaatcccagcactttgggaggccaaggtgggcggatcatgaggtcaggaaatcgcgaccatcctggctaacatggtgaaaccccgtctctactaaaaaaatacaaaaaaattagctgggcgtggtggtgggcgcctgtagtcccagctacttgggaggctgaggcaggagaatggcgtgaacccaggaggcggagcttgcagtgagcagaggtcgagccactgcactccagcctgggcgactgagcgagactctgtcttaaaaaaaaaaaaaagaaagaagtcagctcagtccaggcagtagactttggggtgggccttgatggaccataagacctttgctgccctgtgacttctcccttagttctcagtctgttcagaaaacaatttgcaacaacatcagagagaaatagaatgcaaaacacagctcccttttgatgaattggctcctggctcggcctgcaaaagataacatggtttttcccttagaatacttgtcatgccaaaatgatggtatcgtcctactggggtttttaaatgttaatacaagtaaaataagatggatttttttaaaaaatggcaagcgtttcttagtttggctctcttggcttttgtttaaaactgaagatcactaagcctagatttttgtgtctccagtttaaaaaaaagtaaatttcaaaagcagttcctagaactctccctctccataggcctgttgtgagatgcctatgtccctataagtgtgcttcaatctaccagctttcctaaaacaggttgatggcttagtggataaagatgggacttacaaagcctattgattctcttattgtactcatctgtagaatgggaatagcaatggtacatgctgatcttacatgatgtgaggatgtgatgaaataatacatggaaggtattgagactactgtctgggtcatagcaagcagttttgccattattatatttgtcatgacagttttgccattattattaacccaataataatgtcgtgtcccctttctccattcttgtctcccaaagatgtcacacattcattattgccaaaaaacatttttaaagctttctgtttttctggtacttgcagtgtggctgacgccagtagggtataactcctctgagaatgggtgctgaattctgttcccaaggcctatggggaaatctctttttgttgttgttttttgttttgttttgttttgttttgttttttgttacagtctcgttctgtcacccggggtggagtgcagtgatgcaatcttggctcactgcaacctctgcctcccgcattcaagcgattcttgtgcctcagcctccctaatagctgggattacaggtgcccgccaccacacttagcgaatttttttttttgagacggagtctcgctctgttgcccaggctggagtgcagtggcgccatctctgctcactgcaagctccgcctcccgggttcacactgttctcgtgcctcagcttcccaagtagctgggactacagcacccaccaccacgcctggctaatttttgtatttttagtagagacggggtttcaccgtgttagccaggatggtcttgatctcttgacctcgtgatccgcccgccttggcctcccaaagtgctgagattataggcatgagccaccgcgcccggccacacttggccgatttttgtatttttaatagagatgaagtttcaccacattggctaggctggtcttgaactcctgacttcaggtgatccacctgcctcagcctcccacagtgctgggattacaagcgtgagccaccacaccccgctgggaaatatcttaaaagaatcaaaataagaaagttactctacttaaatcgtgtgctttttctgtgtgtgatttatggtaatcttaccatggggtatctgattactttagaaagatccatttagcttatttttttcttctttgggttatttttttcttccttccatttgcacagcctccccccaaataaaaaataaagatataaagtctatcttctccctcttgtcagtttaagtaaaaagaacttttgcttccattttaataatagaatttgtgtgtatataatataggcagtgatttggcctcaagctgagtttagatttgaaaagatgagaatattaaagcttgtcagccagcccacaaaccacttaagtatttctgatctgacaggatgtggggtggagttctttttcttttctccaccaacacccctcacaattaaaataaatcagataaaatagacactgtgaaggtgggactgaaagtaggtgataggaaagggtggccccacaccaggaccagtacatatgcagaaattccgtccaaagtacttcaagggtctaggacagtgctgtccagtacaactttctgtcacattgaaaatgttctgcatggcccaacagagtagccacaagtcacacggggctgaaggcagatagtgtaactaggatttgaatttttaattttatgtcattttaatttaaatagccacaggtagctaatgtcttgaacagtgtaggactagaaaaaatagattttgacacacattctcatgtatgaaaaactgccaaagagcatcagattgctctagttgtggaagattgatttgggagtaaaagaacgtctaaactgctatcctgtggaagagaaatagatttctattttgttgttccatagggaagaaacaggactacttgggagaaactgcagagcaacacatttaggctcaggctaaaaaaacttcctcagaattagtcatacaaaattctactcagatctcttcgagtttaaggacgacccccaattctgagagtactcagggttagacttgatggcagtttgacgaggacctgcagttccccatttataacacttgtcccacacagagtcactagttgtgctaagtattagctgaaacattgttttcataagtgctctgaagctaccaagaccattggtatcattttattagacatgactattatttagctaaagacaatgtactttgagtcactgtaaggccatttgttctaaaagaaacaaaaagattctccttgggatcccaagcggaaccctgttgttctaacagtaaacatgctccccatgactacgataggtggcactggtcattcagttgttaatcttaaacttttcagtgattatttcacctggaggggatgctgacattggcacaatagcctttccaaatacccagaaaatttctgataataagcaaatggatgaactcacagtagttcagctgtggtagatgctctcgttgctggttagtacttgtagcatccatcagccacggacccgccggttcctactgttggatgtaacagattcatggaaaagaagccttgtaggtaatgtcacagcagtggtcttaaattgcaaagaatttctaccagcctcacgaaccagggcatggcatggaattcattggccctgcttatccccccgtggagacgtgggaatggcaggactgtgaatgtggagctcagttacccagcagaggggtaacgctctcataaagaactcccacagaattaattagccgcattttagcactggagactgcacctcttacatagtaggagcgatggttcagaaagataatgaaggcccttaggttattattgatagaccctgccttctttttaagcaggaggacatttcctcgttctttctcttgttaaaatgataagtgcagagcactctcattaggatgtagccccttggctcccaaggacacagtgagatttcctttccttccgtgcatgttgtctctctctctttccctgccatctcattctgacatttcaagtaaacaggcatacatttacctgttggtaggtgattacatactaataaaaactacaagtaaggaacactaggcagcccccattttacaaattggcatttagtccctctataatctcttctctggagaggagtaatatccacctggatgtaaggctgggtggaattataatgcagccctgttacacagatggctgtcttcgtctgtgacatgtgtgcacacgtagacattcttgcatgtgcttttctgtcagcccagattgatgtgtgcataggttaaattgctagagaaatcagctttctacaccagttgcatctgatacaaatttctacctctggctgggccctggtgccaagtgtttgctcattttgacagtcctcaaatttgttgctttagatttttttcctctcatcttaaaccctctagtccagactttcgtatcacactttattatgtgtagatagctctaccaagaatatcaagggtatctagtaaaatcaccctcaacttccatctccgccatttaacatgaaaacattgttattcatgtttatgtcactccctctggagaaaaacatgttcttcattcccaaggtcaaagccatgttcttcaaccaacgcttacagtctcctccatggttttgtcacatcagtcattcctttccctttgccttgtacctgctgtctttttcaccacttccctctcagctcatgaactctagcgagtttcctccaatctttaaaaatctaaaggagaaaccacctccatcttgtgtgtctccatccctcaaggtcaaagaacttttatgcttgctgtcacccttcataacccgtggatgaatagttactgtatcctattgtgctaataaaatagtttcttaatacccaccaatgactttctaataaaatagcttcttaatgcccaccagtgaccgcattctgcctagttgacaagctgttccactttggatctctctcatcccatggactgcctgactttgccactccttgttcccatccttttctgtatctttgtcaggctctcttctctttctccttaaatattcgtcagtatcccaaagtttatagagaatgttacttaacagcatggatatgaggaacaggtaggcctgaattcaaatccttgctccactacttatatggctatggaaacttgagtaaattagtttttctgagtatgttttctcatactgacttcagatggttgtgaggatgaaattagcaaatacatgccatgtgcttagcagagtgccttaggtcactgcccctggcctgtctttcccctcttcccactgttcatgctcttacctgccattgttattctttctgttcctggcctccttcgggaacccaaaagccacattgtcaaccacctgccagacacctttctcaaatagaaataactatccctttttcccaaagtaaatttctccttccccaacttggcttgatagtctctctcaagtaggaagcacagatgtccatttgacctcctccctctctcttaccctcatatccggtcgacaatccatgtctatcctagcccctggattcttgagtctagacctttctttgattcttaataccaccatcttggctaaggcttctcctacctccagcttagattattgttctggcatcccaagtcgttccccatctctattctattgtaagcattctccctgaaattgtacatatattatttagttgccttctcaagttgttctcctttgtactttccaatcccttattaacttttggctgaaggtttcatagccaatctgtagctcaggggtagaaaggcaaaaatggttgatgccctgcatagagttagaactcattaaatgctgaattaatgcagtataaaataaagcaaaataggaagtgtagtaagtcataatgtaataagaagtggggataagtggttgattaaccaaaagttagctttccattgataaatactacagaattagttgtagaaaaaagagatttataacttgatcttcatttctcacctgagcctatgacaagagggtaatggattggacaaacaagtggaaaatctcagctggcatcaatgggctgtcttctgctcccacccagtgggtgtgaagtcactctctggctctctgtatacctctccttccagccattgctgatggagccaggtctctattttttttttttttttttttttttgagacagagtcactctgttgcccaggctggagtgcaatggcatgatctcagctcactgcaacacccaccttccagattcaagcgactctcctgcctcagccacccgagcagctgggattacccgccaccacatctggttaaattttttgtatttttagtagagctgagttttgctgtgttggccaggctggtctcgaactcctggcctcaagtgatccacccaccttggcctcccaaagtgcttggattacaggtgtgagccaccacacccagcctggatctccattcttgatataggtgttttgatcctaaggagacaatcgttggtgaatttgaaacagattcttcaggaaatatagtgcaagaccaaaattgggtcccaggaaaaatcatgtgatacttcgtaatgcaggtctcttgtagacacaagaaggcacacttgctcgtttccctgggtttggtttttgttttgttttcttccccctatgtctcacatcctctcctgcaaccccaaccctccgtaccgcaggcaagaaaacattgatgtttctgcatctggcagcatgtctctgggagaagaggccggcggaagggagtttgatgtgtgagtgacagatccccaggtaacaccactggggaacacttgatctgacctgtttgaaggtgaaaactcaccaggtcacactggaaacagttgctgctgggcatggctttgatccttgtttatctttttctcttttttttaaccttcttgaaaaaaatgttttgtacaaatggatactttttcctgtgtatattttgtctgctggagcatttgtatattttgtgtgtgtgttccttgtcactgcagggcggggttttgtaaccttttgatgcagattgtgaatcttaatgaatttgtcatttgccatggaaagatgtttgttcaaatagagcagagacattttcgtccaacaatattacaggaatattgtgtagaaaataatgactaatactttgagcattccatgttggctcccattttaaacacttcatgtattaacttgtttaatcttcagaagaattcatttttcctggttttcctgttgacatttgatgaaactaaagcagagggaagttaagtagtttgcctgaggtcacacatttagtaagtgagagacccaggactcaaactcaggcaggggttctagtaccagcagtgtttatcaactgctttccaaccctgacaagcatgagtgggcacaagcatggagcactagggcttacaaaaagctccctcaggctggcacattgcctgacttaaaggtaccgaaggcatggccctgccttcaaggtcattattgcatgctggttagaggagaaatctgtctgtctcatttgcggacgtgtctccgttgctaagtagtgtcaggcatgtaggagatgcttagtacaatctttttggattgtatcaatgtaggttttgaaaggttattagagcttgtgaatcatcaaggttgaaccataatcaattaacaagaaaggggaatctgagacttctaaaatgtaatggtcatgacttgctacctttagaaacaccagcgaaaaaaacctgtggtgtcggttggatcatggctcttattcactgcggcgtttttaaagctttttcaaggattatgtggggatcccaggctcctttatgatttataaatctattatgcatgtcacgtagagattttcatgacagaatcgtcagatgaactcattcagggtataatattgtaggagaagggttggcgaggttgagggggatgccataagaaaatgcctaattcataggtagagtgtaggacagaaatggatggggactggaggccagttaggacgacactgtagaggccagtgtgaggagcaaggacgtgggctagaggaggaggagatgagcatggggaggaaagtccagggagagttaacaggacctaccgactagacaagaggatccagggaaagagaatgaagcattgttaggaaagtttcacagtatagcggcccaccgataaccttaagaacctacaaacctaacagttttaaaacgatgagcttgaggctcagaaggaaaggcatgttaagctgtcatatcaggttgattgaatagattgggtaagtctttcagacatcctaccaccaccttctgccccatgctgttaattctttaagcattgggaccatgagttctgtctagcagtgtgggtgttgagaccacatgaatcaaggaagagggcttctagaggcccaagggctgtttgctgtagaggaggcagaggagggttccaagaatttcagaaggcactgtatagctctgccaggaagtgtttagagaactgaggtgcagcccccacttctcattacaacattttactaccatcaacctctcagcagaactgctgcattaggtacctagtgtttgatttgaactttgtatttattctccatgaaaaggcaccgtgcccattgatgtcactttggtgctgctgagacagaaagtgagtattttatgtgctgtctcttttcaagcaagatggaagggtcttgtaaaagtggtttctaaggaataacctaacattttaaagatttatagaacaagcatccacttaccagttcatttaagttttacaaaacatctctgcttctgccttgccatgtcagcaaaagattctgacatttaaataaataaaatatggtgggatataataaagtgcaaaaaaaatgatgcatcaagttactactgaaaggaatattgaggcctgagtcatctccctgctgctgtctcccaaacagaagatagctttaatcttcaggctctgtgttatttaaataagctgagggatttgcgagttgggggatgctgccaaatgtatccactgaagataatgatcccatttcagatctgcaggtctattttaatgaaaggagacaggtgagggtgcagaacagaaatgttcatagcacctgaccctccttctttccttaggagtttctcaacccagcgaaattggtgagatttttaaaaataaatactttggagtatatcatgaggtaggattactgtagtgagacagggagcagtaatggcagtcaggaaaacctgtgtatgttaaaaagtgtttgctaagtctctcctgtgtgtttagtgttgtgggggttttagtcgaaacaaattagggtctcagccaacctcaaagggtgtattttctcagtctttattgattcctcttggtttcctcagggctcagaacatccaacaccttaggagcaaatgtcctttgaatgaataggtttgggatgaggttctggaagacactaacacaaacaaccttgataaattacatggtagtgacttcatcacattcttccatctagtcggagtagctggcctttgaaaattacccttatgaagcttacattttactggagaagccagacaaaagaatacgtaaatgaatgaatgaatgagtgaatgaacaaaacaaaattatctctcgttcatagatcaaattgtcctaaacttgctcattaagacttacttagctatgcattttataccactgtccctgagcactttaatcatttattaattattcaacctctacattgctttaggtgaactggaggcatgagacaagtttgggatgcagactttttctttttattgtccttaagaactataatatatgcagttagttagaaaccctgtcctattggtacttttgtttcagtgaacttgagtttaaactttaaggcacagaggttattacagtatcatcttcaggaagctactggtactgaaaagagcattcttcatgccaccccagtatcatctttgtactcttacctttgtgttgagaagggatacatgtcacttataaaacctgggtatgactacgcaagccaccttcacatttgggatagaagattctacaaaagtaaaattcacaatctttgtacatacacagaagccagacttaccagcatgtattaaatctgtctttattttggatcatggcatttatggagatcactaagcaggcagctcatttgaagtgagattcagaacacttacttattttatccatttagcaaacatttacttaactcctactgtgtgtactacatcactggggaagacaattaggacccagtccttgttttcaaggagtaagtactctagtccaacatgaaacaactaatgaaactgagcagggataggcaaggcagaggtaagtgtgccttggaagaaaaggggaagaagaaatggtggatgttgaccaaggctggcactaggtaggctccaggttcccctgggatgctagttttagaggtggaagggcagttttgaagtctcatttcaggagcagggagaggctgtgcgttgatggttccagtaggatggggaaaggaggaggagtcagtgcagttggaccaggctcttgtctgtccatctcatctctccccagggataggatgacaaggaccccagaaatcaacagtgacaccagctgagtgaccacaggcagtaaacaccttacaatagctgctttgatttgtatccttgctggcgtatcttaacaacatgacgacatttaccaaatgaatgactgcttaccaagcaccagtctaagtgcttcacccatgttatcatgtttaatcttcccaattttgtgagataggtagtattattcccatttgaaaggttggaaatctgaggagtgaagaggtcacccagctagtaaaaggtagagatgatgcaacagacatacatgtccatgcttgtttgactgtaacacgtttactcttaacctctaagcaatggtgctttccttaatatagaatgtccttcgaaacatcccaatgccaaaattcagcatattttcatattagaatagctttgcgttaggtctctttttccctgaacatttcttttctctgttttgcagaatcttgttggcctcctttaaatatcattataaatgttggcagtgttgttttaaataattgtgaacagaaagtaaggaagcatatgcactctgatctttttaaagcgatttcattattgtaaaaaattctggttacaactcactaaattggtagtttggagcacctttgggtgtactcccagatactctctactcccctctcctccctcccacaaaaaaacagcatttctaaccacagtgactaagtcatgcacttctaagttagaaaatttatagatgggggaaaaatgtagttgaccagataaatatgcagatagttgggacatgtctaaagtgaaacactggtttcctgacacatattcattaaacatacagtcatgtcacaaaaagagattatggtcaggtgaatttattattatatgtccctcccgccccgagaatagtaccctatagtttatgaagcatgttgataatgaagttatctgtttcatatactctttatgaaaataatattttcccaagaagcctgaaaaacttacttggtcagtccaagtgagaaaaaattgaattattttgtatttagcattttaatccccaagttagaagggacatttaacaactgtactaaattcaaaaggttacttagagacagaattcctctttagatctaatatgattgtctggttttaacagtttggctttacaggaagacttggaagaccagcaaaactgccctttatttgtataaactctgcttgcatttgtgactttttttaaagggaaaaaataaaattctttataggcataatttttataaattaaaatacattatagtatatttatgtgggtgaagcttaggaaattctttataaaatgaactgtattttgaattggtcaactgctacattgtccaaaaatgggaatggtgattctgtggatgaagtggaagaacaaggctattctttactgtcaaaaagggcctttatgctatggtttaaaatctttctgcaaagcccttggatgttataccacacatcctgtagctcctacatgccaaactcccagctttttttatgtggagccccaggaaaaggtgatcacttacctgttagcctcatgcctggtggtgataagaaagatggctttggtgatactaactgaatgcctactagaagtcaaatgtgttgttgtttcaattttatggcctctctgctggtgagtatttaaaatgagaatcgagcaagtgaaagtgtgtcatagttttttgtttgtttgttttttaattaagaggaccaaaccaaagaaataggcccattttgttgagagaggcagtccaacacagtggctcaaagttccagagcttgcctgcaagctcaggcagatgctggtaccaggaatgccctgtacggataccaattcattcgtgggagatagtacaggggcaggtaatgctgaatcccagctccacttatgtccagagcacaagtgatggcacaaagccctagctctcttcatccttccactctcagcactttacatgtgttgccttcctctgatttgattccaagctcaggccccagatgggggcctcccagcaacatgtccctctccctttcctggcttaaaccaattagagtgggttctgaaactggagctggagtttatcccacagaaattgaaagtacagcagggatatttcccaaaggaaagttaggatactattttactaagaagattgagaggaggaggtgacaaaaacaacagatgtctgtacatatgtgagggtggagctgaaattgcttggtttctacagttagcattcgctcaaaacaggcagacctaagtttgcaggtgaggccagtccacaacccaactcagaggctgagacaagcaaagtaagtggaaaggagacggatggtagaaagaaataatatctattgggtgtctgttctgtgccaggatctttatgtttgtggcccagtgtacgccttgtcaccctcatgaagtggtattggaaggtttaaagggtttggagataagggtaaagatagatgtagagtcagggtcagccactgtagccaagagctttgggtagttccagggcaaactgaggaagcagacctcttagagggtaaaatgggttatgattttctaaagaggaaattcttctgtttgacctagatgtgaactgaataatcacttctgttgtttggaaagccataaagccagccaaccatgccacaatcctgatctcgcaactcacatatcttatttttcaacaaggaaaatcctttcaaagagataaatgtgaattctgtgtgccatgtatatatttgtaccacatttaatttcattagctataatatcatgtagctgtgcttatttaactgcttagcccagatggtaatgccttctgaagaaaaatggctacacagtgtaattgaacatgtcctattgacagagttacaacaacccattttccccattaaatataggtgattcaataaaatgaacacagagtctattactctgccaccatttctagctgaaaatgcaaggaggaaatgttctacaaggtgaagaaatggcacagttatgttgcatgcagtgggaggacaggcgtaaaggcaggcctcctcctcccgccttggacaaaagaggagctatttgttgacactcagatttggttgggaaccaaggggagaaccttggcgtcatcagctaagacctgtctgaaagtgatgatgatagcagatgtgaacatgaaaactaggccgtacattttggaaaatgatgtaaaaggatttggcttctaaatggaatcaagtggtagaaacagttgtgttggctctcagcagatgagggtcttgggtcttatgaatgttgtcaatcactagtataaaaatattctggccaaattagtatatgagaacaactatctgatgaagctatcactgcaaatatttttgtattcattgaaaaaaaattgccaaggcagaaggattgcttgagcccaggagttcaagaccagcctgggcaacatagcaagaccctatctctacaaaaaattttaaaattgactgggtggggtgatggtgtgcatctgtggtcccaaccactcgggaggctgaggtgggaggattgcttgagcctagcggttcaaggctacagtaaactgtgaccataccactgcactccagcctgggcaacagagcaagaccctgtctcaaaaaaaataataattacagggttggcctccctgatcctgtatatattgtctatgaaattgacaggtttggtgtggtctaagaaagtaagtcatactcgacactgaaactttcctaggaagagcactagagatgatgtgagaagatgttattgaggaaaagtttgggaatggcaccttgccatgtggcgggacttattgcagttgctatgtgtatattttttcttagttttcttcatgttttatgagtaaagacttacagtcgttctctgtctttgcttatggggaagttgagaattttagagtcaaaaagacccaaaagcccactctggcttaccctctcattttcctgaagaggaaagtgaggcccagtgaaaacccacacaactcaggagagatgagccagggtccaattgtcccttctctcattactgcattttgcccttattccagtgctaagggacttttggggatgaaaggagagaagtgggaggctggaaggagtgaggtttcttgtcctcacagctagtcacccagagaagcttaagaaatcattacaggcattgtggctcacacctgtaatcccagctctttgagagactgaggcgggagcatcgcttgagaacaggagtttgaggctgcagggagctgtgatggtaccacttcactccagccggagtgacagagcaagcccctgtctctcaaacaaatataaaaataaaactgaaaaaaagaaattacttaaaatatttttcttatgtaaagaagtacaaaatttgaaacccactctcctaaacaataggaattcgtacgaagagtgatgggcatatattatgcctccctcttcttcactcctgtccagtgtgtcctagatatgggcgtcacaatggctagtatatacctaaatgaaatgacaaaaagtgaagctgaaccttgtcttcttatggagaatatattcagaaggtagaataaaaagatattttagggtgattgagtttaaacaagtagaacctggtcactccaaccccacccccgatcagattctcaaaaattagacttagaaatcatagtcctggatgttagtcaccctttctgcaagggaattgctatctgaccttgcatattgcatgtggacaagttcagagccatcagatccacctgagaaaggaggcaggaaaagagggcaagccttatcaagctgctgtggggatgaatccagtccggtggaagaaactatcccacctctgagccctgccagcacaagccatctgtctgcatctaacaacaccatgggcctcagctctgaagcccctcccttggtgactcagcaatcaaactgttcattttgcacatgttttgtgtttgattcatttagtcactgagtcttcagtttctctgcctgctttttgccctgctgatggggaccagcctccaggtcagcacagcaggttgagcctagagaggcaatcacagtcccaggatgaacttttttttttgtccctgaaaggggcctttccaggagactccccaggggctgctgatatgctcttccaaggctttcctgattgtctgtccacccatacccaaggggaactgatgtttctatcctctcccataggccttttctaggctttttacccacttccagcctgtctcctaggggcctgattggccctctccacttctcccaaggcagcctttcttcacttgcctcagccacctaatctctgtcccaccagttttggggttttccttactccatgcgtttacctttccacacttgcacatgcacacagcaccgcatgaaaactcctaggaatctctccttcaacatggcttaatagtccttcttacctaatttcccagtgacctctgactcacagttacacaaaggaaatggacgtacacctggagcccagctgacttgggctaaggttggtcatggctctaggtttggtttaccttattggctagaagacagtagaggcccaggcactgtgtgctttatggatcgtctttctaatttacttgaacctgggatccatggtcacttctaagagatcaagtctattttactctaagtagtttctttgagtaaggttggacatttatttcccttgacataaggtaaacaagtgtgcctatgagtgtggcaacaatgaggagacattgaatcctcaagtcacattggcatgcttgttgaggcttttaaacgatctcagtatcacagttcttggtaataactgtaaaaacataatcacaggtggcacttggcatgaaaggtatgcttggttcttttttttttttttttttgtgacggaatttcgctctgtcgcccaggctggagagcagtggcatgatcttggctcactgcaacctccaccttctgggttcaagtgattctcctgcctcagcctcccaggtagctgggattacaggtgcctgccactgcgcctggctaatttttatatttttagtagagacagcattttgccatgtttgccaggctggtctcaaactcctgacctcaggtgatctgcccgccttggcatcccaaagtgctgggattacaggtgtaagccaccgcgcccggccgctcagttcttacataatgagggcatccatggatttttaaatggaggtctttatgtttccagttccgtgtcttcccaccttcagaaagcactattttgctgaatttgtctaaagggcagtagcttctagagtaaccccaggagcaggtcttctcaaaatgcctatttatcagcctttgcatgagttttgtgggagctggatagaatggaaaaagaaatgaggaatgttcttcagatatgacattgtacagatctattcttccaaagaaatttgccttgagaatagtactccagacatggaaggggctctaggtatttaggctatggcagaaggtaacttgtaacatcttttcagaatttttgcaacctctgattctttatttgacatttttctttcttaataagatgcacagctagtacagcagcatcctgtaatccatggatttggatgttctgggcgtaatcatccctcaaaatgcaatacaggtgtggttagtctaagccatcttcctgcaaaaactttctattcctcatcccctccttagactccctgtttttgtaatatgttgtcaactgaaccacatttatcataaaatttatcattttctttgtatttctactgagatctagatagtcatcaacatgggacatctttccagcttgaagcaaaaattcttggtacttaggtatctcctgtagccttggtagaggcatgtgtggttaggcctttctgaatattgaaaagagctcccttatcccccagttggatccatggaactcctggtcccaaccactgaattcagcactgccttgtttttgcctcaataccacaatgatggagagaagctctactttaggattcttatctgacaaattagacagcaggaccccttctaccttctaatatattagatttaataaaataggcatatactctctactccagagaaccaaatgcctttcagcttgggaaactaaaatacaggggtgtttgatttgtgtgtggttttgcttgtttgttttgagactgagtctaggtttgtctcccaggctggagtatggtggaatgatcatagctcactgtagccttgaactcccaggctcaagcagtcttcccacctcagcctccctagcagctgggactacagatatgcaacaccacacctggtttattattttttttttaatagagacaaggtcttgctttgttgcctaggctggtcttgaacccctgacctcaaatgatcttcccacctttgtctcccaaaatgctgagagtgcaggtgtaagccgccatgcccagcagagtgagttgttttttaagatcacactgcaagtttatgtaagaatcacttgaataactttttgttcctgttgggttaagctggtgggctagatgcttggaagttgtagaccttactctcaagaagtttctgtgcaagagagcaaataagcaataagtaaaattaaccacattcagcagtaaagaatgattttaagccaacagtttatgatgcaagatttaagagaatggaaaagaagttatttcttttaaaaaaatcgtttgagatgaaattcacgtaatataaaattaacaattttaaagtgaacagttcagtaggatttagtatatccacagtgttttacaaccactgcttctatcttgttcccaaatattttcatcactccagagtaaaaccccttacccattaagtagtctgtacctatcccttcctccccattgcccttagtccccagtaaacctctgatctgtgttctgcctcttcagatttatctattttggaatcatacactctgtgaccttttttgtctggcttctttcacttagcataatgttttggaggttcagccatgtatgtgtgtataattactccactcctttttatagctgaataatactccagtatttgtatataacatgatttgtttatctgtacatgcactgatggatgtttgggctgtttataccttttggctattgtgaacagtactgccatgaacatgtgtcacatatacttgtttatgtacctcgttttggttcttctgcatatatacctaggagtggcattgcaggacgatatgatacttctacattaaactttttgaagattgccgaactattttctagaatggctgaaccatttcaagttcctaccagcaatatatgagggttccagtgactccacatcacttccaacacttgatattttcctttttcttaaaatagccactcttatgggtatgaagtggtacctcattgtaaatttgatatgcattttcttgaccaatgatgttgagcatcttttcatgttttttggccatttttatatttttttttagagaaatgtctactcaggttttttgctcatttttcaatttggttatttgtctttttgtcattgaattgtaagcattctttatgtattctggatactagatacatatgatttgcaaatattttcactctctaggttgtcttttcactttcttgataataaatgccttttgatgcacaaggtttttaatttgatgaagtcttagcctgtttattctgttgtaacaaactacttgacactagagaatttataaacaaaggaaatttatttcttacagttatggaggctgggaaatccaagaccaagatgccagtagatttgctgttgggtgtggggtgctcgctctgtttcaagattacaccttgttgctgtgtccaagtggtggaaaagcaaaaatgccaaactctgtgtgaagcctcttgtataaaggccttagtcccattcaagaggaaggagccctcatgacccagcctcctcctgaaggcctcacctttaaaactattgcattggagattaaatttcaacatgaattttgagaaacatattgagaacatagcaaagtccagtttatctgttttttcttttgttgttaatgcatttgatatcacatctaggaatttatggccaaatccaagatcatgaagatttaccactttactttcttctaagagttttatggctttagtttttatatttaggctgttgatccacgttgaattaatttttgtacatggtatgaggtaggggtccaatttcattgttttgtatgtggatatccagttgtctcagcatcatctgttgaaaagattattcttttcctgttaaatagcttaggcatcttgttgaaaataagttggccataggcatatgggtttatttctcaactctcaattctatttcattggtctgcgtgtctatccttatgccagtagtacactggtttgattactataggtttgtaattaagttttgaaatcaggaagtataagtcttccaacttttttctccttttacaagactattttggcgattgagggtccattgcaattccatacaaatctgtggatcagcttttgcatttctgcaaaaagatcactagaattttgatagagattgcattggatctgtacattaccttgggtagtactgacatcttaacaatactgtctcccaacccatgaacacagggtgtccgtctatttattcaagtcttttaaaatttcttttagtaatgtttattttataattttcagcatataagtctttcacctttttggtgaaattgtttcctagatatttcattctttttggatactagtgtaattgtattattttcttaatttcctttttagattgttcattgctgatgtgtagaaaaacagctggttgagaatttttgcatcaatgttcatcgcagatattggcctgaaattttctttttttgttgtgtctctgccaggttttggtatcaggatgatgctggccttataaaatgagttagggaggagtccctttttttctattgtttgtaatagtttcagaagagatggtaccagctcctctttgtacctctggtagaattcagctgtgaatccgtctggtcctgggctttttttggttgttaggctattaattgctgcttcaatttcagaatttgttattggtctattcaggaatttgacttcttcctggtttagtcttaggagggtgtatgtgtccagaatttatccatttcttctagattttctagtttatttgcatagaggtatttatagcattctctgatggtagtttttattactgtgggttcagtggtgatatcccctttatcattttttattgtgtccatttaattcttctctcttttcttatttattagtctggctagtggtctatctatttttgttaatcttttcaaaaaaactagctcctggactcattgattttttttttttttgaagggtttttcatgtctctatctccttcagttctgttctgatctatactggcaaaccaaatccagcagcacataaaaagcttatccaccataatcaagtcggcttcatccctgggatgcaaggctggttcaacatatgcaaatcaataaacataatcgatcatataaacagaacaaatgacaaaaaccacatgattatctcaatagatgcagaaaaggccttcgataaaattcgacaccccttcatgctgaaaactctcaataaactaggtattgatttaacgtatattgaaataataaaagctatttatgacagacccacagacatactgaatgggcaaaagctgaaagcattccctttgaaaactggcacaagataaggatgccctctctcaccactcctattccacacagtattggaagttctggctaggcagtcaggcaagagaaagaaataaaggcattcaaataggaagagaggaagtcaaattgtctctttttgcagatgacatgattgtatatttagaaaaccccattgtctcagcccaaaatctccttaagcagataagcaacttcagcaaaatcccaggatacaaaatcaatgtgcaaaaaccacaagcattcctatacaccaataatagacaaacagagagccaaatcatgagtgaactcccattcacaattgctacaaagagaataaaatacctaggaatacagcttacaagggatgtgaaggacctcttcaaggagaactacaaaccactgttcatagaaataagagaggacacaaacagatggaaaaatagtccatgctcatggataggaagaatcaatatcatgaaaatggccatactgcccaaagtaatttatagattcaatgttatccctatcaagctaccattgactttcttcacagaattagaaaaaactactttaaatttcatatggaaccaaaaaagagcctgtatagccaagacaatcataaggaaaaagaacaaagctggaggcgtcatgctacctgacttcaaactatactacaaggctacagtaaccacaacagcatggtactggtaccaaaacgtagatatagaccaatggaacagaacggtggcctcagaaataacaccacacaactacaaccatctgatctttgacaaacctgacaaaaacaagcaatgagagaaaagattccctacttaataaatggtgttgggaagacctgctagccatatgcagaaaactgaaactggaccccttccttatactttatacaaaaattaactcaggatggattaaagacttaaacataagacctagaaccataaaaagtctagaagaaaacctaagcaataccattcaggacatagacatgggcaaagacttcatgactaaaacaccaaaagcaatggcaacaaaagccaaaattgacaaatgggatctaattaactaaagagcttccgcacagcaaaagaaactatcattagagtgaacaggcaacctacagaatgggagaaaatttttgcaatctatccatctgacaaagagctactatccagaatctacaaagaacttaaacaaatttacaagaaagaaacaaccccgtcaaaaagtgggcgaaggatctgaacagacacttctcaaaagaagacatttatgcggccaagaaacatgaaaaaaactcatcatcactggtcattagagaaatgcaaatcaaaactgcaatgagatacgatttcatgccatttagaatggcaatcattaaaaagtcaggaaacaacagatgctggagaggatgtggagaaataggaatgcttttacactgttggtgggagtgtaacttagttcaaccattgtggaagacagtgtggtgattcctcaaggatctagaaccagaaatagcatttgacccagcaatcttattaccggatatatacctaaaggattataaatccttctactataaagacacatgcacacatatgtttattgcagcactgttcacaatagcaaagacttggaaccaacccaaatgcccatcaatgctagactggataaagaaaatgtggcatatatataccacagaatactatgcagccataaaaagggatgagttcatgtcctctacggagacatggatgaagctggaaaccatcattctcagcaaactaacacaagaacagaaaaccaaacaccgcatgttctcactcctaagtgggagatgaacaatgagaacacatggacacagggaggggaacatcacacaccagggcctgttggggggtggagggctaggggagggatagcattagcagaaataccttatgtagatgatgggttgatgggtgcagcaaactaccatggcatgtgtatacttatgtaacaaacctgcaggttctgcaaatgtatcccagaatttaaagtgtaataataataaaaaaagaaatacagctgatttttgtgtgttgatcttgcaattttgctgaattaattttattagctttggattttctgtacatagaataatgtctgcaaatagagaggccatttctttctttttcttgtctaattgccctgggtagaacttccagtgcaatgttgaatagctatagataaaagcaggcatcttcatcttgttcatgatcttaggaagaaaagctttgtctttttccactgagtacaatgttagctgcaggtttttcataaatattctttatcatgttgaggcaattcccttctatttctagttttgtgagtatttccagcatgaatgggtgttgaattttgtcaaaggctttcttgcatcatttgagatggtcctgtggtaagtaaaatcttaaagagtaggactgataacagatacagagaaatgcgattctggagaagtaagtaactaacttacagtggtaggtgcatgactagtatctgcagagattagtgcacaatctaaatcactgtgtagagtattgggggcagaggactgaatgcagtacaggcaagggcagattctgagtagatcagggaggacttgattgacagattgccttcatcttgtctccattctggagatccttatggtttctgagcccagtcaaactaggaattgtacgccttgctcattgttctctccttctgtgtcttcacttctcttccttctattgactttcatgtccctctaacaatctttcctttttaattttggtagaaaagtgtcatgtaaaacaaagaaaaaatggagttttttggtactgtgtgataaatcttatgattttttagaatttaggagtacacataaaattgagaggtgagccaacttttttgttggtttatttctagttatgtatggagatagacctgctaaccagccaacagctagtgtcagggctgtaaattagactggaggaaagaatgaactgcacatttctagctcctgggccaaggttcctgagatttttgccagccctcttctagacagcagcttggtacctcagctgtccttctcatcagggagacagatggaacctctgaggtttcctgttgaggcgtctcagaattcaaagttgttatgatgtgtgggctttgaaaatgccacacgtcagggaagctgagtttttgtttctcaggctttcttatattgagcatgtgttcctttctgtctttgtggcattaagtttcattatgtgtgtccccaagccttttcctggaatctcaacagaggatgggttttagctctgttggaagttacattccattaagtgtgctcaaagatctgctttactacacactctctcctgcccaattcttaggccagccccttttcctctccctactcttgtctaattagtcctctccttcaaaaggcagccctttcatgggattctgctccccgaagtagtgggccctgacttaagggccagcccatctttgtccatggccatacttatcagggatgtgactatttagctctttaaccaggagtctgtcctttctagagaccttccagcatactattaacctaagtgcataggcagaggagaccaggagcacttggtacaaatgttaatggctttttcattagcgtacttcatcacagaattccagctgttggtggcaggaggtgacagtgaggcgtctcttggataagaaggacgtggagatctacggagatgaaaactgaaaagatgcatatgattagtcatcagaaagatgtttgacttctaagttttttccaacagcaggtatggctgcatggaaaatgcatacatccattgttgcaaggcctttatttccttatcaccatcatcaagcagtattaatgaagaagccaattgtgcatgacatagtgcaggtctctgtatgtagttatggaaaacgcttccacagttaaattgagtatggatatgtaaagtgattaaccaagacttgacagctcacacaattctttaattgcagcaagcatctcaagtaaatacataacttttaagaaaatccagaactataaagtcttaatttttgaaacaaatcatgatctttcacgttacaaacagatctttctttctaaaaagatgattcacaatcttttatgctggaacatcaaacatagattttactttacttctttttaaaataattggtttgttaacagttaggaaagccatacgtgttatttgttaaaaaaataaaaataaaatggaacaataaagaaaatgtatccaaactataaaaagcaaaagtcaccaacttgtcccagctgcaccccctccaccccacccatgtttctgttcccacaggacaaccattgctagcatttctctctgtagttcatctcttttgaaagtacatatgtaagtgtgtgttaaatgattatttcagaatttatattgataaatgcctatgttttctattatttcaatttgcccacatggagggtgattgttttttagtgtgttcccttagcttctggaatacaaaagctgatgcctgtataccttgactttgctgacggcagtggtagtgagtttagtgctttctacttttagctttatgttttgcactatttttgaattatatcaattagctatgatgtatacacattcaggattctttaattttgggtaaaaataattcttcactctgtgcctacttagctaagaatatctttaacagaggcagagctgtgaaaccaccgagcaccaacactgcctctctggcttttgcagggacgcttgggtttcaggctgtaactcttagttgcattagcctctgataacttttttgttaattgataagtatgtgtatgactcatcaagatgctggttgctcagtaagataaaattatattctctaacactacttctcctttagaagcttacttacctgccttggtgtcttctgtctcggtcttactttgttttttagtttgtagtttgttcttcagcttactaaacctctttcattgactgtggtattggctaccgatttaaaaatccttgaagacttaaaactcagcagacacgtacagggtggacccctgctttttctcaagtctcccttcatctccaggaactgaatttttcatgcagtaattaaaatttgtaggtcaagcctcccatggcaccgtttgctgctaatatgggaaagcagtgatcagattcgcttatgctgctcttcactgagctgagacttaaaggatgaagggtgacattttcccccattttgtaaattaatgccattgatctgcctaacaagaacaaagttaggcttcaaaataccaaatgataaagagattaagactttaaatggctttccaaaaggcaacctctattgtaaggctccgagctgactattgaactttcaattagaatttctaataggctattgacttaaatggacaaaatgttacaagtgatagctttcaagatgacaaagattgcttcttacgttctggaatattactttatgtagcgtgcactgttctggagggtgaataataataaactgccctccccctgtagagtgtcttctgcatctgtgctatagttttctcaaaggtgaataaatgcattttttaaaggcatttttgaaatacttgctttttcatgtgtttgctgaacacaggttttatgaaacctttcatggcagggaagtcccattagtctttagcactgtggcactattcttcttttatgaaaaatagcccatgtggtatgtatttctctgcacacatgtgtgttcatgcatgttaacatgtgtgttcacagttgggacaccagcagatctgttgtctatcattgccatgaggatcagtccctgaggccttgctctctgcctcagtttactgttgttggaagctatgattcttttccacaatgggcttgcagtgtagtgtgactcaatttaggccttgttgtgaaacactagctctaatacatttttaaatactaattttacaaagaccagctacctcttctaggataaagggttaatattatgcttatgttacagtgcattaaaaactctaattaaaacagcattacattcccatctgccaatctccagtaatcttctttaattgcagtaattaaactatatttacatgttcagaatacttgtaatttagcaaattgcactctctgctctacatttaatcaaacaaccagttccagtatatttagtgtggaaagaagtaatttcaatgttttgattactatagcagatttgacagagtaagtgcccctctagtagagggcttgaaagggaaggcaaacatgaaatatagtcatggttttgattgtcatgtgaatgcctaattacatgttggaggattaactattaaagggtatcatggttgcagttgatgtttagaaacagccggtattacagatagcatagactgtcttttaggaaaatttcacaagaagttttctctttaaaggttgtgagatcataggaaaatttagtgaaaagatcgcctacattgtataattgttattatgtcttctacctgtgatcccaaagcctgctatacaagatggttattttagtcttcccagttaaagcccagaagaaattcaatgataaacaaccaagagaaattgcaatgattatatcaattcagggatgagtattccctcatttcggtatcttttggcaagtctggttgactctggagaggacatgtggtttcctggaaaggactcatcagtagaagtcaggctttttttattttaccttttgctgctgttgttgttttaaaccatgactctctactaggctgttccacctaacccatctccagcctcatctcttatttatttatttatttatttatttatttatttatttatttattttgagacagagtctcactctgttgcccaggctggagtgcagtggcgtgatctcggctcactgcaagctccgcctcccgggttcacgccattctcctgcctcagcctcccaagtagctaggactacaggcgcccgccagcacgcccagctaattttttttgtatttttagtagagacaggtttcaccatgttggccaggatggtttcgatctcctgacctcgtgatccgcccgcctcagcctcccaaagtgctgggattacaggggtgagccaccgcgcccggcctggcctcatctctttttttcttggttttctcattttaaaaacaagtaacagtgttgtgaatattgattagattcaaaggaacaatgtcttagtcatctcaaagctatttttaaaattcttattgttattatctctttgcaccagtatgaaagtttctgtttctttatctagataaatttgactgggatattgggtattgccatcaaatctctgttatccaaaacaacgtgctaatttattcaacacagaaatataagtaatactctctttttcagtagcttctttttaattatttgatgttaacagtatttctgagaatttttctctctctccacttcggggtcatctattgtattaataaggattatgaattaatgaaaacaaaaagctagtctagcgtacctgtttaaaccaatgtgaaaccttgcttcttgaccatatgaaagagcaaagctactgaattgttaaaatgatatgcaggagtgaggatccaagattttcttcatgggtcagctagtaacttactgtgatactgagagcaacatgtttgactgatttaagtctcagattgttcaaggtggggtagagaatagggcctggatttttttggttcatgaagagtcttgacataaagtaagtattagactttagactgtcacaggaataaccattcagttcaaatctacactcatttctgtgttagattagtgagaatttaacttctgaaaaaagttcaggcaaaataccgctgatgtactgcactaaggagatttgagagtgccagagatactttgaaaggaaaagagatgtaatttgaagtggaggacagggctagccagggttaaaattgcagctcttttacttagctatttaataccaagcaaattaccttatcctctgaggtcttgtctgtaaaaatggggataataatacatacatagtactacactattagtttttctctcctatgacttgccatctgtgtccatgtatggagagaaacacacacacacacacacacacacacacacaccccgtaataagttaagagtctttggaatggtaaatgatttgaacataaataccagtacacattttttttaataatgcagcataaatgtcaagatatatatgcataagggatgaggtgtgcctagaagctgtaatatctagaattttcgcaaaccttatttataaccatttgtttctgaaccctaacaattcttttctgaaactgttaactgaaagatctgaatctcactatttatttcacactcttcacatagaggtgctaatgagcagcagaataaccccaaaaatggtccttaatccaaacaccgagaagtcaagttataagtaattaagaatacactggatggaacatacctacatggcagctagcatctgtgctttccagaggttgctggggacggttagttcagttctcatttttgatcctctttggaaactcaggagttaaggtcagcatcctcagtacaaaggtacttgaacatgtatgaatctttgccttcttgaaaactttttatcttgggaataaggaacctgatacaaagagaatctctagtatttcattccatcgagagaagttttgacatttacaattctgctaatttcacacatcatttcgcagcatgcaggattttggcgcctgccaaggggactgcaaattctttttggaaaaagtacttttttgggtgttggaagagttttgagttacagacacatttctttaatagtgttcttgaaatgtccatgtggtcttaatatgtaaatcatatgaaactcaaaacccactcctgaacttactcttccaagaaagctttaaaacagccctcattctaatagtaaggctgttttcctcttttccaatgtttatgtatactgtataatgtttactgtataatgagtttattgtataataagggactctgatttattagctcttcattattctcattctgtcagcttcccaataaatgctacaacccttggcagagacatgagtctcaatcaggtgatatcattgctttttaatgaactcttcttaccggagtaacagcattacatgtgaaataccttatcctgcattattaacggaccgcagcataaaaggcacaaaggcactgagaaggttgcactgaaaaatggggcagaattcattaccaattcgatatactgtcagctaacagtctttgattatcatatttacccttctgaaactgtgaaaaatcatgggcggagccgctgtgaacaatagcatgtgtaggcattttgtaaatgttgccttagttgtttaatgcccaggctgactgctggaatttaacacagtgacaactttctcagatggggcatgaaaaaaactgtgatattttactacctgagaagttaagcactgagatagttaggacccagctctcattagctgaatggtagatttttctaattagttctttctagtgcaattagcacgaaaagagtctaatcacctcatgtgaaaccaatctaatgctcagaaaagaattcccttggcctctctttcagattggatcttaggattttcagtctgcctccttaaagaatggaatctgttagtgactgattatttgaacggtaaggacagatctgtagaaaaggcaagaaatggacaacttattgacttgcagtgcaagtttggctggagaaggtgtttagaaatattcattaattggcagttatcacttcaactataggttctggttttcttgatttctttcattttgaaatgggagacttgggcccgggacagctatagttcagcatggctgcctctctggagggcatgaaacatactgcacattagaatcaaatgcattcggggcctgggactactgggcttgctttcttagcctctgcagtgcccagattcccccatcagtttttgctaatctgtgtgttcagggctttgcctgtcctctctctctccctgccttgcagtcatctgtaggcaccacattcatttttgaactgttctctaatttctagtgcccatccatcacttcacatttcttaagtaagccaactctgggcatctcagttgatattgttcatttttaactggaaaggaaactataatgacagcatttctggcacataattttttctttttttttttttgcgggggggaagtcgcttgccagaagatcgatgagaaaatgctgagtatgtgtgtatttattatcaactatgcagaaaatgggcatccttgctcatcaggctacagagggtgacaatattgaatttccattgttcatcccatcactgcccagtagaacttcccatgatgttggaagtgttctgtacctgcactgtccaatacaggaggcactagcgacatgtggctgttgagcacttgaaatgtggctagtgagactaaggagctaaattttaaaatttcatttaattttaatgagtttaaatttaaatagacccatgtggctaatggctaccatactgaacagggcagatgtagatctcttccacctcctaaccactgtaccccaccttacacatagctgcatccttaacagagaatacactgccctccgcagcctcttgctatccattctcttcagctttgccttaaaagcaatcagactttttccagtgctgtctggagtttgacacaaggcattcccttggcttgtgctatctgtagatcattctgtatttcaccgtggcagtgttttgttctaaagttggaaaagaccttgtagttttttaaagagccaaaatacaggattgtttctaagaaaggaggtggccagaatcagtaaatttaagctcatttgtggaagcttccaaatctcaaacctagggcagtattgaacacctctccaaaaagtcagattaagtatttgcaaatggcttcaacaaactccctctctatgaaattttaattatagttgattaaatattcactttaatcatcttaattaatgatatttgacaaatattttagctttgcttatgatattcacttgctctgtcagaactctccagttcacactgaaagggtaaagttaacaacctggacagacaggcccatcatgtgtgttatgacctatctggtttcctactcgcatggttagaaggctcattttattgctttgaactctggaattaatcctgcttaaaggagaatagtaagaatactgtggttttctgctcaacagaatgcatgttcatttattccacagacactaattgaaggcccattgtgtgctagtaattgtggtagtcactgagaacgcatggatggaaagacactatctatcccactggattgtaacctcaagccactggaacataaacagttaaaagtactatatgataaatcttctggaagacgggtgatggaatgtaagggaagaaacactaagtggtggtttcaaaacagaaagacttttaagatgtaacatgtaagggaaattttatggatataagggaatacaagggagagtcttaaggggattacaggattttgcccgggataaagagaaggtggggcatttgtgaaggggattatgttttcctaattaactgtattcttgaatgtctttgaagaaaggagtctctcctttcttcattttgtaaagcaacagtgtgtgttagaggaattgctgttaggaaaggaatgaggatatttggtgtgtaactgtgagtgctgggaaatgaaacaaaaggcagccctacctcaggtcctggaaaggcacatagtggtgtgagtgttgcagcccattgaagctacatcctcaattctggaaactaacaagaacagcattagggtgaggccagagatccacctaaggtgcaaaatgtaagggggcactcactttgagggtcgtgcaggttcaggatcagtactgacacaaccctgagaatgagtgtctcctaaaattgtgtgccctagacaccttacttacgccctgaaacatcccagccctgggtttttgtgcagtgaatgggcttgaaaagcaagtagataagaatctgaaccatggaaatatggcagacatggcagaatagaaatcaatgagacctatttgcaaggtaaagtcaagagaacctagggcagaaaaaaatacgaggcatgagagaggggaccctaattgtcctgtcactgaattctggggatcttttctattgcctgatactgacttttctccaatttctcatattcctcagctcctgccctgtcctgaaggtcatgcccagttcaaattcagcccttacctctttgctaagtcccatgccctcaaccttgttttcagagaaggccatgagaactggagtttttaaaatgtccaactctagatagatctgctttactgagtggtcttaacacattcagagaactgcattcttcttggctctctaaattcagtgaccttattttaaaagatgatcaacatgggttagaaccttttgaggattaggagacattttagcaagtttatcaagaataagcaaagatgacatttggctagcagtatgtctcccccaccccatcctgcaaaaccattttttttggagtgaagcttttccatttgacaagtttagaattaccaatactgcttgcaactccttccttactccaaactctgggatgttttcaggagggactcttttcttcaaaggcatccaagaatatagttaattaggaaaacatgcaagaaaagacatcttggctcctctggccgcctgttgtactcttccagcatatgctattacttgtctcagataagtagacaggtggctgtttgcaaagcagggtccaatgtgcctttgactcagagaagtttggaaacaaagccctctgtataataagcttctcactgtatgctgacgtcttctgatcttgcctattccccattacctacagtctgaaagaattttgtagggagtgtgtggtattctgcagaaggctattgtagcataacttagacttagccggcatttattgggcttagaatcacaaaatctcaagattgggtgactactggatggttatctaatccaacttccctccagaaagtctcccatacagtttttcccgcaaagtggccctcgagccataacttcctatgacagagtgcttactgcctctttgttcaacgctggtgaaacctcagtgatacttataagttaactttcattccttcagcattcttctctttagtgttaatttctttgatggtggtaccactttccaacttttatatgtggcctcttaaaatcagcttacccagagaaacttcctgcctagctcctgatttatgtagcttctcaccaccatgccctttctcccttcttataggggcagtttcacaattttgaagctccttgattcccttgagccattgtcctttccaaaacttgtcactatgaaaagtagactatgttttagcctttgaactataaaatctgcctttcagtaagcttagctccatattttgaggtctctagatccccccttagtatgcatcatgagacttgtattactcgccaagactctcatgactttcttcaagcattcagttttgtctaagaagccatcgtttgatccagaatggagtagacctaattatatctcctgtttttttggacttgaaatttacttcaagcctgatgataacctgttggtcagatgctctgccattaactaaatgacaccatcagcaaatatccagatagttgaggtcccagtgtcctgaatctgtggttttataatctatgtcagaagtctatcattttttttttcacctggctgtcatctggtatattctcaaaaggatatcacttttcttcttatccaggtacgtgccagtgtgcttcatctctcatgctcatggatctccatgcaaattgatctgcttttccaaaaactatttattaagcattattatgtgtctggtactatgtcaggtggtagagctacagtggtgagcaatggaaatctacgtgttttttgacatatgacactgcttttccacaatacctttcccaccttaaatcctatcccatgagcctgggtgatactcaggagattatttttatcatgtctctaaaaatctctgcttattttataactgatgatacatagacatctaaagagatgagggcctcacacagggattggccatgagagaagctttcagtgctgcgatctgaggccagtctgatctgacaccctcttaaaggctttcaagtataggccactgggttccacatcccatacctcttacctccattgtggctagtttctcatttgcggaggaggttagagatgttactctcttcccctccaccttcagtgtaaatttctcttaatcaggtcagctcacctccccaggcaagcaaacacatgtctctctgtcttcctgagctacccccgggaaagtctgcattattttagtaccatagacacagtctagaaatctgattcctatgggttgacaacatcctcatgacaaacccttcacctaccacatcatcttatttttataatcaccgaactttgttaggatgaagaactagagcactcaccaggcacccaactctgcgccaggctccatggtccccaaatgaagcttcctaggtctcttgtgtccaagccattcccctcacgtgaaacaacatgaataggtagagataagtggctttgtgacttggaacagacagtagcccaagaagaccacatgcctcccttctggccacgtgaactacatgaagcagtctcctttctgttcagccaagagtccgtgccatctcagtgcttgttttccttcctgtccctttatctggctctgtgcatgactgtttgagcagcctgtgtcttctccttccagccacacagagtactggtaacttctcacaggatattgcggtgtgcctccgtttacactgtctcttcttcctggatgctttcctctatcccctgcaatcacttcttacttacctgaaacttacttcttgtattactgcttaatgacagcttaacttccatgatacctccccacctccttctgctcaattctaggtttgagtatgtgccttcactaagtcctcccataatacctaagcaggtctctatcacagtccatacattgtttcctgtgtgtgtctgtttcttccattagactataatttccttgaggactgctcttgtgcctcactcatctttgtgagtacagtgccaagcatacagtagatgctatttaatgaaggtgggcatgtatgggtgaatattcccagtgtttcaggatgttttttctttctcctctggcttttctattctctgctcacctggaatgagagcggataaaataatacagacaggaaaccaggaagcagaagagaaccccagccacctacctacacttccccctcttagatgccctgcaacagagatctgtcctggggactccacctcatctttgccagcggtgtgcagctggcttcctaaaatccacccagagtaggggttagcttgtcagaaaaatacaaattggatgtcttctgcagggctttgcacagtcccctcagcacccacacttctgtgtcagggaggggatgcagggacacatctccttctaccctctgggagacttgtagtctacggctccaggagatgactccctggcctagaggactgtatccttaaaccactctctgctctgctggcttatgtcatcctcctgctcctttgggtagaagttctagagtcttatccacaaattgtcaccagttataggcttgagtaggcactaaatatgaaacatgaataatgacatgagccagcagagcagagagtggtttaagagtggtttaagggtcagagggaagggaaatgaaagccttggaggatttcagattcactcactcttctttaccttatagcctgtgctgcaaagtcagagtaaagaaacttctgttctgcctcattgcatccccaccacaacaggctgtaagcaggagctactccatgttttaatataaggaaactgaggccccaaaaattaaaaataactttatagtaccagctagccattggcaaaacacgattatacattcagatttgtccaattgtttccccatgtaaatgagaccacagattaaaattattattgtcaattaagaaaaaataaaagaaacccctgaaaagaggatctgatatgtgtctaactacctttaaatctccttgagataaattataaggtgttgtttctattgagccacccccatcaccagtttctcacaattcagtgctcagcaggcagtggctactcaagaattccagctggctgggcacggtggctcacgcctgtaatcccagcactttgggaggccgaggcgggtggatcacaaggtcaggagatcgagaccatcctggctaacacggtgaaaccccgtctctactaaaaaatacaaaaaaaaaaattagccaggcgaggtggcgggcgcctgtagtcccagctgctagggaggctgaggcaggagaatggcgtgaaccccgggaggcgttgcttgcagtgagccgagatcatgccactgcactccagcctgggcgacagagcgagactccgtctcaaaaaaacaaaaaacaaaaaaagaattccagctaagtggcagtgaactaatgagatttcatcacagagcatggtgaacgcttttctaaggtctaaatatgtgctctatagttgtcatggagggccaaagaaatgaagaaaataaagaacaatattagtcttaagaacttttttaaataacaaaaatgactgagttactaaggtcaggaactattctaatgcttttatactcatctcatctaattgctccaaaccccatatgaagtagacactactactactatcatgacccattttacaaatgaacaaactgagtcttgaagaagctaagtaacttgccaaagcacatcccagacttacaggcagtctggctcagagacctctgctcacagacactcctcttcctgggtctaattcaagaggggtgacgtgcgacttagagcagcctgtgggcttagtgattctgctgcttggtgcacagcaagacagaccataatcagcactagaataatagaatttttataagtgattaaagtaaaaccaggatttagagattgagagttgattgttaaaggataaatgatatttggaacatcttactggatttgattaaagtgaaattcaaaaaccatcacaaagagaatgattatttaccagtggtacttgaaggactttttttgtggcttaagtcattggcactccaatgcttaaaatctctgtgctcaaaaccagaatgtaattgatccttagaaaatcagaggttagcgccttctttggcaagctacttctgagctttgttacactgtaacataatcatcctttgaagactgagatctggttttccaggcttttttttttttcttcacatggtgcctggtatcttctcttgaacataatagatactttgagatgggtggacaaaccgaagtcattttatattgctttaggggctctgaatttaagaaagagttgatttctgaaagaaacataatagcaaagattacttaaacacaaaaatctcatttctgttcttaatcagctggacgtcaatacccaggttccagtccaagtgtcacactgtgcctctataagttaatcttttctggaagggaaaccaaatatgaaatagtatcaagaactgggacagtgttggaacaccctgcatgtcctctgttggccactacaaaaggttaaacaacaggagaggctggattagggtttgtgtttggaagtgcatttgaggcaagcttgacagttaagctcatggccagtactacatgccacagcaagaggacaataggagatttaaaagtgtgagcaggctgtggccaaatgctggaattcatgggctaagtagatgaagagtggatggagttaactagtaaacaagtttcatggtccttgaagagacctatttttttttatggtatgaatttaagatgtacaacataatgttttgatatacatacaattagtgaaatagcgataatttgatatttcatatatataccaaaatgattactctgggtgtattatttccttctcatgctgctaataaacaaatacctgagactgggtaatttataaagaaaaagaggtttaatggactcagttgcacatggctggggaggcctcacaatcatggcacaaggtgcgaaggaggtgcaaaagtacgtcttacatggtggcaggcaagggaccatgtgcagagtttataaaaccatcagctctcctgagacttattcactatcacgagagcagcacaggaaaaacccaccctcatgattcagttacctcccacctggtccctcccatgacacatgggagctacaattcaagatgagatttgggtggggacacagccaaaccatatcaacagggaagcaatttaacatatctgtcaccttccatatttaccctttttatgtggcaagaccacctaaaatttactctcctggcaaattttcagtctacaatattattaactagagtcctcctgccctacattagatctctagacttaactgcaagtttctgctctttgacctatatctgcccatttcctcctcctccctacccctggtaaccgccattgtgttttttgtttctatgtctttgactgttgttttttagatgccatatatgagtgagatcatgcagtactttttttttctgtgtctggcttatttcacttatcatcgtgttctccatgttgttgcaaatgacaggattttgtcttcttctttttttttttttttttagatggagtctcgctctgtcacccaggctggagtgcaatggcacaatctcggctcactgcaacctccgccttccaggctcaagcgattctccttcctcagcctcccgaatagctgggattacaggcgtgcgccaatacgcctggctaatttttgtattttttttagtagagatggggtttcaccatgtaggccaggctggtctcgaactcctgacctctggcgatccacccgcctcagcctcccaaagtgtctggattataggcgtgaggcaccgcgcccagccgatttccttcttttttaaggagatgtatatgtgtacacacacactacagcacattatcacattttctttatctattcatccattgatggacacttggttgatttcctatcttggttattgtgaatagtgctgcagtgaacatgggggtgcaggtatctcttcaagatgttaatttcattttctttggagggattgctgtgttgtatggtattctatttttaaattttggtggggtcttcatactggttttcacaatagctataccaacttacattcctcctaacagtatacaagtacctttttctccacaaccttaccacataagtgttgactttttctttttcttttttcttttttttcttttttgatacgaagtcttgctctgttgcccaggctggcgtgcagtggtgtgatctcggcttactgcaaactccgcctcccaggttcaggtgattcttgtgcctcagcctcccacgtagctgggattacaggtgcctgctagcacacccaactaatttttgtatttttagtagagacagtggtttcaccatgttagccaggctggtctcgaactcctgacctcaggtgatccacctgtttcggcctcccaaaatgctgggattacaggcatgagctaccaggcccagccttgaccattatttttaatagctaacaattattgagggcttaccatttctatgagtctaagcactttacaaatatttaatcttcataacaatctctgacatagatactactgttaatcccatcacacatactaaaaaactgaggcacaaggagtttaaggaactcgctcaaaatgtcacaattagtaagtcatgaagccagccagaacgcatgctcttaacccctgcactgttctgccaactctttggagtggtttgtttcagttgtcagtttttgtttgctgtctctgaaaatccttgctcttacagtgtcagccagagtcctgcattgatcacatggcctaacttgcctctctcagtacagtgactttttaatcttcggctgcaatcctttttttcctagactgtaaactccctgagggtagaaagtctgtctcattcatttgtgcccattttaatgaatgttgaaagggagcgtcaggaggggttatctagatgcctgtggatctagattattcatcatccactgggatctttattggtgttccttgtccccaaggagggagtcagcagcaacagaaggcagcagagatctcatcagtgttcatcaaacacatgttgagtgcctactacgaggtaaacagaacagacgttatcttctgtgccctctcagaacttaaggtacagcaaagaaacaaatgagataagcacaggtgtgataaatgcttgtttaaaaaacattttaaatgaaatgcttcgtttaaaaaaagcgaagaggctgaggtagagaataatggaggttgggtggggtaggacctactttaggtaggtaggcatgggaaattcctcatcgaagaagtgacattctaagcgaagatttaaccaacaagaatgacatagctaagaatgagaagactgctggggaagctccttgttggcaaagaaaacagcatctgcagaggctctgaggttggaaaggctttgtttcatctgtttaatagtggaattcagtgacactcattagttacctcttcacacattcccgccaaacacttgtccctgagtctgttctttttcattagtggttcctaatccagttttcaaaactgctcaatatttggagaggttttgaccagttgctctggaaacagaggcggttccaccatagccaacagagttcagaacataaattgtccatttatatccccatttgtatcttaagcttagcttgcataggactcagcaaagcaatatgtcaaattccttatatttgttatatctcttttttcactgactcaaagcatgaaaaatttgaaattaataaaacaattttttagatgatcagagattcttttttctaaaattttctaaatactatggttgtgtcccttaaccacaggcatggtggtttcactgcattttactcaagagaagattgcttacaaatatcacacaggagacctttctagtctcctgcaggagggtggctgacccagggaacctccaggcaagcaggacatatgccaagtatcctacatgtggacagtgtctaacttgatccgatctttctccttccccatgttttagttaagtcccctgaaagcccccattacccactgttcataaagggtctgtaaattatttaagagaaggaaacacagcctttatcccatcggatttttcctctcaatcacttgagtcttttctctgagcacacacacatggcccagactcactgtcaggggagatgtaatgccagcatctggtgttaatatctattgttgacattttgggaatgagaacatgagctgttagggaagatgtttgcttgtacctaattaatgtcccattgtatcctctcttgttgtcagctctgcctcaccatcctgccttggcattttcttttactggctaactttaaaagttaattatttctctgttgaatgttaaatgccaccggtttttaatgccgttccttggtgtgagttattagttatcaaaaatcaaaatgatctgtgcaattatcagctctttacctaaagccactgttcttgctaatcgcgtaaagtgtgatagcatttgctgatgtctggcaacatggatctttctagcagatttaagtttctcactcagtacattcctgtccctgtctggctttccttgtggagatcagatacaaagtcctggtacatcatctaatggaaacaattactgacagggccaagtcttcaaggcccattttgcttgaatctcaaatcactgttaaaattcatttggcaactccaataagtacagagagtaatgaggaacttcaaatagaatatttcctaatagctttcgtaaaacatgtcttggtaggagatcacaactctttctttacttgagattggtttataaaaataatagtacaagttccaactaacagctactaagtgcatactctgtgccaggctttgtcattagcttttcgcatggattatcttaatcctctcaacaatcctgtgaggtaaagtcttattattattcccaacttaaagatgagcaatttgaagactaaagacttgagtaattaatgcagcatcacatggctggtaagtcatgggccaggatccccagccagcagtcactgcagagctgcactgtcccaggcagtgactgtgactcacacgtggctactgagcacttgaaatggggtgagtccaaatgagatgggccataagtgtaaaacctacgccctgttcctaagctttagtcaataaaatagcgtaaaatgtctcgttaagaatgtgttcataccaattacatgttgaagtgataatattttggatgcattgagttacaggaaatatgttattaaaattaactttttgtttctttttcacttctttaatgtggctactagaaaattttaaatttcctgtactgcttgccttatatttctattagaaagggctgctgtgtgtgtgtgtgtgtgtatgtatgggtgtgtgtgtgtatgggtgtgtgtgtatgtatgtgtgtgtgtatgggtgtgtgtgtatgtatgtgtgtgtgtgtatgtatgggtgtgtgtgtatatatgtgtgcgtgtgtgtgtatgtatgggtgtgtgtgtgtgtgtgtgtatatatacggagagagatttctggagtttttcttgtcttaacgagtttccgatcctaaactattgaggaataggcacaaatttctgacccttcctcccctttctggttgtttcacttccagaaatccgacagaaagtacaaatttttacatctgagtctctaccaagagcccatctgttggctcttctcaagtatggaaagatgaaacactgacatgccaggcattaacgagatcaaaagcagggctaatgacagaaatgtggctgctgttaaagtgtctccagaggattatcggggaggactttttgttctccttacggcgaccccctcaaatgtcttccagagagtgcctctcagttccagttcctgaagtcctcctttgccttcctttccaatccttgtccaccactttcctggtccacctccctctctctcctggacgcccatctctggggtgtctgtgcagctgaggcggcccctctgttaagcacttctgacacgaggcaggtcttttttccctgccagtgagagcagagtgtataatggtgttgccctccaccggggatctttgagaagctttatggctctagcagacatgggggaaccaatcacaggcactgcagctgatatatgacactaatatagggttcacttttattctcaacctaaaaaaagatagattgttccaagtttagacaggctgtaaaatcatgtgcttctggaaccatgctgccttacccctgggaccactgtaattgctttacatctgtacaaaggttccttgtaatcgggctttctgccttcatttgtcttcttttcagcctcttagtaaagaccttaattggtcttagtggggcttttttcagttagtgcaactgtacctttagggctgaacaagtaccagacactacctgcggggagaagtgaggagatgggaaagacatcaatactcctttacctttaacagtttaattaatgtgctcagaacaaggagcagtttgaagaaattttggctcctctgggaccctgctacagatcagacataactagggttaggtggaattttctagatttctttcctgcttcagtctctgtgaacactcattagcctcataattgtctcacagtaaactgctgtatcaagtttcagtctgtctctttggaggatcaagttgctttatatcaatagactgaagtactaggggatgtgtgtgaagggaagtagcctctaatttcttctgtttcttagctactaattatttaataatacattttattgcctattaaaatgtggcataacttgcttgtcagcaaaactagatggaacctaatcatttgaggagaaggataattggcacttgtacagatggcttttattgccagttgggtttgttattgcagatagaattccttgccaggtttcttggttctgtttgtgggctggtcagtgttgtgagggggttacttactgtattacaacccaggcggttaaatgtggtattattgcaaatgcagtgtgtactcagttatagatcataaaggcttctgctgtgtaggtactttttttcttctcctccccccacctccccacccctggttttaaaggaccctagtgagttttgtaccacactgaaaattaccttatgtgctggaaaatgcatcagtggagactttgtttaaacaaagggcgtttttatgatggatagaagtggccaaaacttctggatttccatctagtaaaaatttgtgtaggaaaattggaccagtcccagttccttagtagaatttcacgaaggttttcctgttgcttcaaaatgaccccttgaggaatgttgtataaattccagaaaattgctcccaatgtttcctggagcacattaaaaaatgaaggagacacattgtgtgtgggatagtttggtaacagaattagttcactgggtagaacagaggggatcccaggtagttgggctctaagtgggaagcgttggccaacatttgtaactggaggcagatttggcaggcacttgggtaaggaacattttggtggtaatgaagtaggcaggaacaaaccgcgcaggggaagaatgcttcacactgccaggctttgtggcccagagcctagcattctcatccccaggtgcccagctcctctgccttcccaaggtgctcaagtttgctttctactcagatatggcccagtttcactggcaaccacctcccttatttgttgaaagtatggcttgtgttctgacccaagagagccatttaaaacctataatgatgtccatctttgtacgttttctgggtcccatcttcccatccattactactttgtcattgttcttatgtctcatagttgaactcctgaggtctaattgtgccagaacaacatgtctcccatctgtctggcaactctcttggcaactgcattcctcttcccttgaaagaggtacacactcttgacccctcccttccaaaagcctcagtgaagacctatgtgttttacctgtaaacgcacggcctttttaagtgtggaagggaatgtctagacttgatactttagaaaatcattatgaagtaagcttgacgtaggtagctttgtttcttaggggttgaacttgggaattactgtaatttaatacctacaataaatgtgttaaaatagggaagaaagccaattctgaggttttgtgtgttatatgaagggtgtgtgttatgcatcgtcattaaattttcttaagcaaaagctactagcaagtggaagccaatttaaaaggtgtatattggaaccagaacatgtagccagaaactggcttgggaggtgcaaatcctttagaccattgagagcatggaggttggcgagacctagaatgtctataaccttagtggtcacagtctacagtccactccggatgacgtggggctatggatgagcagatgggtgggtatgtgttggggacacgattttggacaacgttacatctgttgatttctttctgtcctgtagttgactcttctgagtttatttgtaaatcaccagttatgccaatagtattttcttatcagccctcaccctggtaacttttctcttgttgatctagatggacagacccaaatggagggaaaggattttaaacagtatgccattctttattaaatgaagcaccattaaaactacttccatctctgagtttcctttttccaggcccacgcctaacatttgcaaggcaagcatacacatggaggcccagcttacttctcttcacttctctttccagcaccatgaggagctttgctcctcacctcactcactccatacatccaagctccacccatactttttgccctcaccagcccagtaaacagctgcctgttgaccaccctcaagcctataggtgtgtgtaccaacagcatggcctgcccttgggaggatggcttccagggtaggaacctgcctatgcaggccctagaagcagcttaggccatctgggaagaggagtcctgtctccttggtgtgcaccacatggtcctaagggggaatgtgtcagctaggtgggcccatccccacgacttcatggattcttgccccatgtggagggacacagctggaggggccaagaaggatccccttatgcatggtctcaaggcaggggctggatctaacctgtattgcctctgccttttcatttcagtcttcataacctcacacttcatgtcctgcaaaaataaaatgaaataaaatggatccagctctccttcagaaaagctaaatggatgagctagttaactcatcagtgtctgcggacacaaggtgtgaaggcttagtctttagattcaatactggaaagtcagctggggtcttgtgcaaaagatgtgatgcattttgtgtaagaagtctgttttttccattagcatttaaagtatagcatactgctaaccagacacaaggaatgctctactatacagtgaaagaactatgcaagggaaaattgcagctgaaggaccaaattaggaatgttttcaatttcaagagtccagagaagaaacaaagcattatattgacatagtttgaacaaagtaaagcacttcgaaccttgctaacatttttaaatacacctttgttaaacctctttaaagaatgacgataattgcgttgttgttgttagtattcctaatgtccaaagggttgctgtaatttactctcccttcaaatttgaatatggttcataggcttctgtcttagtccatttcatgttgccataacagaatacctgacactgggtaatttataaataaaagaggttatttagtacaaggttctgcaggctaggaagttcaaggggcgtggcactggcatctgcttggcttctggtgagggccacatgctggtcaaaacatggcagagaaggtcaaaggggaagtggacacgggtgaagaaacccaaggggcgcccttgctttatctcagccggctcttgagggatctaatccattccctggagagtgagaacttactcacttccaaggagagtgttcatctattcttgagggatctgcttccaggacccaaaagcctcccactacaccccacctcccaacactgccacactggggattaaatttccacgtgagttttggtggagacaaaccacatccaaaacacagcagcttctaaaattaggttaagaggacacaaactctatccagaagccaatgtagtatgtgttttctattgtgctgctacccaaattttaacaatgagaattctgactttgatgtggcagtgatagtccttaaagtatttgaaggtctttgtcagttgccacttatttttgtgtagcagaagcacgggtttttatgattttgatcttcctttaaaaagatgtaggttaattattctgtcatctttatctgacagacaatggctaatattgtttattgtgtaaatgagacgctttactttcaaagaatgctaatattggctttgaaaggaaaaaataagcaagtatcttttttttaaagaaaaacagtctcactctgtcacccaggctggagtgcagtggtgcgatcatagctcactggagcctcaacctcctgggctcaggcaatcctctcacttcagcctcctgagtagctgggactaggtacatccaccatgcccagctaagttttaaactttttttctagggatgggagcctcacttgggatatagaaacccctagtgttgtccaggctggtctcaaactcctggcctcaagtgatctgtcgtctcccaaagtgctgggacttgaggcatgagccactaagctcggcctaagcaagtatctttaaatgggtccttgttagtcagcttttttcattatctcaagagaggagagtattaggagagcacattttcagacacactagaagacaacaataatacctgtgacaggtgtatgaccccggctcatggtggccttctcactcacctgactcaaagttgggcagcgggactaattttacataatcttaaatcttataaatgactttctgctctcttttccttacaccactgatttctcttccctggcacccttgctagtgagataaaacagggaacagagccaggaccagtgagctgccatgtggagtgctgcatctccctgaaggctgaccgtgagctgtgttcatgaaggactcattgtcacattctacccagaggcctctaagctgctcttttctggagtttaagcctcattcttaggacatgccgtgaatttgctctccaaaatgattccacacacaaaagtcctctctctataagccctaccagcattagccagagtcctcctggtattctttctcatctccacctgggttaaaaagtgagtgtgtagcagatttgtttaaaagggtcctcagctacacccagcctcccatataaaaatcgattcttggccaggcgcggtggctcacgcgtgtaatcccagcactttgggaggccgaggtgggcggatcatgaggtcaggagatcaaaaccacagtgaaaccctgtctctactaaaaatacaaaaaattagctgggcgtggtggcggacgcccgtagtcccagctactcgggaggctgaggcaggagaatggcgtgaacacgggaggcggagcttgcagtgagccgagatcgcgccactgcactccagcctgggtaacagagcgagactccgtctgaaaaaaaaaaaatcgattcttggaaaatcaagtcagataatgacgatagagcaaagtattttgctcgtgtcttttgtttggctcagtgttcatttgtcattacgcctcagcctccttttctttaagcacttgttgtgatctccgggcatgtgcttatgttcgtgactgttttccagagcattgctgggctgcttaacttttgatgctcccgtctaaataatgactaggttcctaagatgcctttacgcttcctagaagaatctgccaccatttgaattctctagcagcaccccaaaagtgctaaattatacagtccaaggaggacagtcatccaccaaagaaacaagggtaggatgaacagaaagggagaaagatgttgaattgagccaattcagggagtaagtaatacatgctctctggttgaactgatttttcatatggctaggtggctgggttctgcctgtgacttgttcaactctgcaagctactaaatagaataaaacttgctgaaatcagagaacttcaagaagataagttttatgtatatgtatatgtatataggcatatattcatatacatacccatgctctcacacactcatacacaaacttaaaggattctagtttagggtagacttaaccctttgacagttcaaagagagaagttagagtctacaaagtgattattatgtaaacccaacagggcctttcctggaaataccacaaaaatttcttagaattgaaaagatgacaaatgctgatttatgcagaactcgggacttcattgatagagcactgtcacttactacttccatcagcaggaatggttccttttaacatcagattgggtgtttacatggatgacaattagggctggtgaaatagttcaaataaaagaagaaccagaccggcatggggagtgaacctagttagttcccaagtattaaatacctgtcttccctcccttgtctctctcctcttcccttcctttctccactttgtttctcacttcactccctttccagactgttcttccctgtcagggaaggctgaacagagattgaaccacacaatacattgagattctgcagcagagaagacattcaaatcctgaaatactgtagtgggatctggttttcaaatgtttcttccccgggaaagtgaaacattccttgcagtcttataaaataagtatgttcgttgatatttcaagcaggagaaattcattttaagaagttggagtatttatatgtgacaggatagtagttcctctttctctcccccgtccctccctccctctctccttcctcccgtcctctcttccttcctccctccctttctctctcctctttgattttattttttaatcagaaagttctttttaaaggaagagaaatatcaacattgtacattctaacattccaaatgcttcatatagttccttgttttattgctttaaacattttttcaacagatacttaaggacatttttcaggagttgtgcaaggcatgaacacctggagatacgtaagctacagtggtgaacatggaggtgtccacagtaagcgggagagaggcaggtactctgcagtaagagacgggtgttaaagaaagataaattatctcaataactctggaatgacatcaaccccacttagaattaaaggaacagaagtctttgtgataaatattctctcagtctttccctctctgtgtgtgtataatatttttgttaatacacagatggtaatctaatgagatgcatttattcctcctgatatttgtaagtacagtgtatcttttcattgtattaactgttgttctacatctgtttggatccattctgtggattcaaaatcatgtagatcaccagtctctaatggttggacatttaggatttatctggtttctcatctgagtgtttattagatgactattggatttccttagacatattcttggaaatagaattgctatatcaaaaattatggaaaatctgaagctattgatatacctaatgctagatgacacattggtgggtgcagcgcaccagcatggcacatgtatacatatgtaactaacctgcacaatgtgcacatgtaccctaaaacttagagtataatataaaaaaaagaaaaaaaaaaaaaaaaaaatctgaagctattgatagtcttatttttaattgctctaaaataagtattaatttcttagaaagaattatttatttaaattaagatatttatgcagatgaaatacccaaatattctggtttgctgtttatttttatcccataactcaacgggtatttatataattaattatacttttcaagtttttcacccctatgttctacatatattgctacccatgtactccatactctattcttttatgcttctttgaattctgtaatttaaaaaatcaaagcaaactaaaaacaaaacaattcagctcaaataacattttttcctaaaaacctaagtctcccagcttctttgaactcctccttctatggactcttacagtcctcctctagcctatttatctcatttgttaattagctagctagcttttatgctatgttttattattagaatcctgtttcttttagtagattgcaaactactcagagccagagaccatgccttgtgttatttgtgtacacagctagcagagcaccttacacatcataggaatgggatctattttagtgattaatctgttctgtttttatttcagcagggtttgtggaagggcatggccaagttgatggtgatcatatgccttcaaatatcatgttgacaattatcacgttgatatggaaggaagggagactggcttactaaaaaagcattctagttgtctagattggaaaaaaatgcatttagtctttcaactgtctagcacctagtaggcagtcagtaaatagaagcttaaaaaaaaaaaattaggccgggcgcagtggctcacgcctgtaatcccagcactttgggaggccaagatgggcagatcacgaggtcaggagataagagaacatcctggccaacatggtgaaacccagtctctactaaaaatacaaaaaaaattagctgggcatggtggcacgtgcctgtagtcccagctacttgggaagctgaggcaggagaattgcttgaacctgggaggcagaggttgcggtgagccaggatcacgccactgcactccagcctggtgacaaagcaagactctgtctcaaaaataaataaataaataaataaataaataaataaataaataaataaataaaaattaaaaagggctcaaaagtccttttaaataagtatttcaatttaaataaatttattaacttctttttactccatttccttgtctaggaaaggtggatcagactcattcattataaagaactctttctgattgaaaacatttagttaactctctctggtcatgggcattcacatattggagacagaagcagaaccagttgtgtaaacactgaccaatgtgttcaatgtagttttaaggaaataaaatattttttatttatggataagtcttgatactaaaatgctaaaaacttttcagttagctggctggcacatatctctcagcagtaatactgctgtaggtaaagttggcgtgctacttcctttttcatcaggtacagtagctcagtttagacatcatatgtaaatggagaaaggtactgggaaagcctattaacaaaaaggattagtaggaattttaaaaattaactgtgaaaaaaattctttctgctctaagacatcatctctgcagaaaagatatttggtaaaggaataattggttcagattttctcccctagtatctttactatctgccctgaatttccctctttactcttcagaagagagggtcagttccatcaccaacccggatacaaagattctcatttcccgttaggtcatagcatttagaataatgtttattttggtatttttaaatattttgtggttttatgaggaaccaatacatgtggtcaagcattcccttattaagggaaataaagctcaagctcagaacagatggagaaacttgtccatacatttgcatgtgacgtgtggtgtagaccagaagtttaaagaatattatattccaatgacacatataaagcacctgcaattgacagagaacgtaaatggtattttttaaaggctagaagttcatagactccttccattcatgtctgacatcagcaagctcttaataatgcagtgtgtacttatctattgatcagaccatttaagtagtaagacatgagaaagtagacactattgtctggtaattgaccatattggagagttaagtgttctgacaaggaactaagtgtatttaaccttcagataagatcaattttaagataatgcctactttagtaatgaaccaaagctgttaagaaaactttgttcttctaaagcagtgctgttttgatgacaactatcatagttttaatgaccagatttgttcctgaccagattggtcttccagggcaacctggaaaggagttactaacattcatcctttacttaccataaaagctcaaatggaaagagacggtgggaagcagcactgcccaaagagccactgattggtttaggagacatcttttgggtacctaccataagccagtcatcatgctatattgtagggcttccaagtttagtaacatatctgacttcaagaaacttatgtttcagtaaaatggttttccagttgtattttatatgttaaatctctaaaaccaaagcttatgttagtccttcatttattaaagagagagagagaggaagttctcctatatttgcctctgagtcttttccctgtgacctaattgaacaccacttgaaacctccttctcttagagacagatccataagcaaataacacattataagttatataatacaaacatgaacaaaattgacaagagaacacaaagaaggacgtagctaaagcggctctgcatttaggaaaggcttcctagaggaagcaatgttgaactcttgtctcgttggatgagtaaagctccccagagagagagaaagtggaggcagtgtgagcaaagcaggtgaaggctgtggtatgtttgtggaagtaggtagccctacttatatgtctggaatagaggcttttgaaaagaaatagtgagagataaaacaggaaagtagattaggccccaaatcctccagaggtttttaagcagaagactaaaaatcagatttggatatcagtgaggtgatgctgataaactcggggaaatcacaggagctttttaagaagagagttgatattcacctagggcagcagtagtgacatttgagaagaaggaatgttccaaaggtattttagaggtgatagtggatagattaagtgactgaccaaatgtggagaacggagaaacaaaagaggagaggaggtaagggtaattctgagacacctaaccccaaagactgcatgggagagtatgtccaatacagggggaggattgagttgaagatgagaataaggaagaatcagttcattttggagatgttgagtttgaggtacctgtggaacatccaagtggagaactttggctaacaaagtttgggtcctgaagataaaggttaggattagaaatactgatttatgggctgggcatggtggctcacagctgtaattccagcactctgggtggctgagatgggcagatcacttaaggccaggagttttagaccagcctcaccaacatttgcgaaaccccgtctctactaaaagtataaaaattagccgggtgtggtctactcaggggctgaggcacgagaatcacttgcaccaggtggcgcaggttgcagtgagccaagatggtgccactgctctccagcctgggtaacagagcgagagtctgtctcaaaaaacaaaaaggccaggcacggtggctcatgcctgtgatcccagcactttggaaggccaaggtgagtggatcacgaggtcaggagatcgagaccatcctagttaacacggtgaaaccccatctctactaaaaatacaaaaaattagcccggcatggtgatgggcgcttgtagtcccaactacttgggaggctaaggcaggagaatggcgtgaacccatgaggcggagcttgcagtgagctgagaacgtgccacagcactccagcctgggagacagagcgagactctgtctcaaaaaaaaaaaaaattgtaaaaaataataataataataatactgatttatgaaatcactgatgaagaacgtagttttgggaatgttcactaatgatggctagaagaggaatattcatcaaaggaagcagtcagaggtattatttgatatctaggaagcagtagttttgcaaaagaagagagttctcagaaagtgcaaatagcaatatctgataccattgggagaacagaaagatatgaatcttctgaagaccactggctttgctagctattatagaaggccactgacctttagcaacaactttttcaggagaatgatgagagtagagactgggttagaatcattcgaaaagaatgaaataaagaaatggagacaatgaatgtgtgtattcagtgtttagggtgatgagaaatggagaactctggctgaaaagagaagcaaagtggagtgggtgtgtgtatgagagtgagttgaatatgtatataggctagggatacctgtatgtctctgggatagtaaggggtttggaatcacactcgtggaagatcaaacctctggcctactatttaatagatatggaccttgatcaagttcttctgtgagcctcaagttccttatgtataaaatgagattagtactacctacctcttggagttctttaaggatttaatgaaattatgacatagaaaacacctagaactcagaaggcactcagtaagtattagtaggattttttgtttgttcattcttgtgaggaagggagatattaaaggtgcaagagagggaaaggatgatgcctatgatgtcagagaaaagagatgagtagacatgggatttgagtagaggtagaggagtagtttcaaagtgagattggacctattttcctgggtaatagaagggaaggacagtgataaaatgaggcattgggcaggataatttaggttatgttgcagtaacaagtagccctaactctaagtctgttaatgcaacagaggttctctattcatactgtatggccaacattaattaggaagggtttctgttttatctctgcccctcagagacccagcctgatgggagctccatctcggtatttgcctctgcagtcatcatagagcagtcacatggctacctctgacctcaggaggccaagaaagtgcctggaattggggaagcacaggaaatatttggtgatcagtgctcaagaccagaacaatgagtagagctataggtataagtaaatagggaagggatggcagtggcttctctttttcccaatgaaggaggcagcaaaaatatgatccaccaagagcagcgtgaggggtcttacaagagtggtaaatgtttggaacagctgtttgttaaaataattaaacgggaacatagcagcaaaggaaaaggaagttgttctggttaaatatttatcattagggctccatgcagaatgaaatggtaatatagctgtgattcagtttcttagttcagcttaaaattagaagctgcccatcaataattttcccaagagagcgatttctactgtaacagcacatagcctagagaaaaggaaacgcacaaagaacaggctttcttggaatgggaagagaaaccattgcagggagagaatatgagagagaaattgattgtacatctatccctggaaataaaagtgagttcccttttatcagtcattctgtaaatacatctgctgctggcctagcactttggcactaggtgtaatcgagagaagtttaggactttattcatgttctcagagaatgtgttgtttggtcagtggggcaaaaaagctcatgccatgagtttgagggttgtttcatatatgtcttttattgccctaattgctataatttttggggaagagtttcatggaacagatgagattaaaccgaggccttgaagaatagattaaccttggagggtgtcaaaggaaggaaaggagggcaccagagtgatggtatcattcaagggccaatggtgggagtgaaaatggtttctaggggaggcaagaaggagagtggccagaaagaagaggagatgattagatcaagaaattatgggacatcaggttgaactgacaggttgcaaccttattataaggagttggtacaatatggaaggaaagcaggaattagttgttgcatgagagaatggcattgtgacaaggtacacttggtcagttgggaagaacataatgagaaggattagttaaaagacttcataataatccaggtatcttctcctcatctactccccatacgacttgaatgacttcctgttaccttcagaataaagtcccagtctttagtcctgcttgcccatccccattttgaagagactaccagatatgcaaagggtactagaatgaggaagactcggatatgttggaaccaggagccagaccatggatgtacaattagattccaacaatgctatcaacaggcaacatttaggagtgcagcctagcaccttgcaagggctgtgaccaagtcagacataaccctgccctagtaggatgttggaggttaggtgggctttccaacacaggcatcaaaggagaaacctctttattatttttttaaacagctttattgagttatagttcacataccacacaactcacccacttaaggtatacacttccatgttttttaataaatgcacagagttgtgcattcatcaccataatcaattttagaatcaatttcatgacccaaaaaagaaaccctgcactccctatccatacctccttccttgcccattccactgccccagctctcagccctaggtaaccaaccctctatttttcatctctatagatttgcctattctgggcatttcatacaaatggaatcatacaatatatggtccttgtggctgatttctttcacttatttttcactggttttaaaggtttatccatgttgtagtatatgtcagtacttcatctctttacattgcctcataatattacattacattgatacaccacattttgtttatccattcattaattgatagacattgggattgttgctactttttggctgtgatgaaaaatgctgttacaaacattcatgtgtaagttttttgtggatatgttttcatttctcttagacatatacacatcttatagtggaactgcagagtcactatcatttaaccatttgagtaattgccagaccatttgctacagtgcccgcattttacatttccatcagcagtgtatgagtgttctagtttctccatatccttgctaacacttgttgtctttttttttttattatagccattattctagtgggtgtgaagttgtatctcattgtggttttagtctgcatttccatgatcagaagttgtattttcaaaactaaggcataagtgaaagcatgtttgagggctttgacagaagactgagaaataaatattaagagattgatatggataggaggatttcaagcagttaaaggctaagaaggaattggacgcagccttttatagtatgcccagtccgtggtgttgccatgttccatggaaatgaataaccagaggttgctattctcattctaaccattctcagtccttggcaacacgaagttaggttcacctgaaaaataattttaaatataccagcgttcaggccctatccttggccaactgaataagaatgtttggggatatagcccaggtatctgtagtttttaaaatctcctcacatgattctgatgcacagtgagggttgaaagacaccattgtaaataattcagcaggattaaataatagaatgaatgtattgattgcatgcactgatcagataaccatctgcctttattttgacctgtaagcttttctgagacacctgctaactgaatttgatcaaacagatgtaagacataattgcagtgtgcagtcttctccaactaatgatagaggaaaacctagcgtgtggttcataaaatcaattaactatttctccccaattaaaccccgaatttaaaagttttgtcacagagttgagttccttcatttttttcccatttatattggctacacatgaggcatttgtttatttcaatgatttcaatctctttgagttcaacatacagtgatgcttttcaaggtaatgaattagttcattgattagtttatctattataagacagtaaattgatgtaatgagtcactgatagatatcctagtggttggctcatagatacaagcattttttatggttgtgttgatttgaacacgtgccatttctatgcaaaccttgacctttgtaattgacctgatgtgtacagatgacagcaaatagatcaatcagggtgatgtctcattaccatatggccagtgatttctctaggactaaagtatgttttttctctttagggattgagggccatttttgtcttctgttaaaattctaggtctagtcacaaaactggaaaggatgggaactaaagtgcaatactcttctgctagtttggcaccaagtttccaatgctgaaaagaatgattttccattgtccagactcttctttagaggggtcctatgtccccaacttaaaatttgagctacacagtttcagaaaatgaaaactgatattccagaaagaagaggtagataatgcagaaatgtcagtaattcaacatgttctgatgccaacctggccagagatggctttggtttcattgtagattgagatttcttatagaaggtttaaaatgcagggaaggtcaagttgagttttgtagaggaagatatcctagtacttttttagggaacccgtatttttgtcttaatggaactgctaaaaagatgtgcagtaatccaggccttctcttcctctcaaaaacaaactaggcactggttgtatttagtctcacattcgtttaatctagagtaaatggaagcctggcatatagatcattgatgtaaagagtatcatggaagaaattgaaatggaaacaaacagtagggggaagacctgtctggtagcacatcctctccatctggctagccgtcagatttcctggccatttctcattgtacacttcatctttgcttgcttcttacttcctttctttcttttttttttttttaaaatacaagtattttaaactgcaacctggaaagaaaacgagaggtatataacacatccttaaaaacaaagaggaaaaaaaaatcaaccctgttaataacttccactttgagagtttgggctggttgcaaggcccaggggactaatctgctgaatgtgggaggatatggagccatttgtcctaggagaagcactacattaaaaagaagaggaagaagtcatgggggaagggcgagggtctgctgatgaaagtagctgtcaaattagcaggtctggaagttgtagtgcatattgttatgagctgctcaagttcacaccagagcaaccagctccatccatctttctcagtttacattttaattggcttgtagttaagttttttaaacactgcgagattgctgacatacactgcaatatcacgtgaataatttatggaggttgctcaagacaagcttttttttttttttatgtgagaaaccaggggggagtgggggaagaaggatgagagggtctgtgggaggggccaggacagaagagcagacacaactgcatgtgctgtgctggatgttaaatgtttctgctggtgtaggcagcagcatttgggatttcagggaggtttgtacaatacgatcttattaataacaattctgtcaagagagcacccgattaaattgaattgggtttatgactccctcttggtttctgaaaatgtgtggatataaaacctctgcgatgtgaatattggataacaagggtaggtttctttatttatttatttttttggttggttttaatcattcctcctactactgagaatttgcttgtttataaatgcaggggtaggcatttttcccaaactatctttctgttttctgctctcaaaataatctagagaagatggaactggcatcagtgggcagttatcctaagaacgtgactgcttctaggcatggtttgctggacaactctgagtctagaatatcatctaattaacacctgtgggacaatcctcttcatctgctaaaatatactttttttctcattacaaaatgagtaaattatataaaatgtctagagtacaaagaggagaataaaaataacctgtaagtcctccccctgctaataaaattggtatggtttttgtttatatccttctagtcttttttctgttcatatttagtgaacataatttagtgaatcgtatatactgtttagaagtcatcttttttttttcactaaacattacatcacaagcatattcccatgaatggtctatacggaatgtcatttctaatgattgtagtgtgtatgtgtgaattaactatactttatataacctatctcctgcaactaaaatgcagtgttagtttataatttttatccattttagacaggcaagttataaatatattttttggtcaaatttcagtatacattcttgatcatttctttaggaaagctctgagaagtagaatttctacaagaagcagagtgagtctgagggaaaaaatcattaatgtctcaagaattttgtctcgaaaagagggataaagcacattttaaattaatgaaattaacagtttattctatttaaaaagaaaaatgatgataacattcaacatgaggttcttttaaattattgaattttttgccttgtggggtttcttaaccacaaaacctatctattaggattaatggaggctattttttctttaccaattgctatataactacttaagacttcatgtaatcagctgagatgctacaaatgtattgcctgtcaactccagtaaaaaagcgggcagttaattaaagggatgtcttgctgttaaacaaacttgcagtcaattgcttgtaagtaacatttagtttgatatgtagtcaaagggcaggaaaataagtgtttaggcaggactggctttttgcaacgtaaaaagagaagtgattatattggggtcaagatgagtaacctttcaactggcatattttccttctaaaaagtatattcacatatcagaagaaaggtgaaagacatataaggccttaaggttggtcagtttgagatcttttccacttacagtaactaagtcctcatcttcttgcatcccttgaagacactgttttaccctaatataaagcctggctttgaggtcagtgtgtgtgtgtttggacatgtgcgtgcacacagaccgtaagtagatgaggcaagaactccctaaaccaagtgccatactctgcagatgggaaactgccatccatagacccagtagaaaggctgcagtagcacagcagcacttgggacagctgctccaactcaggcccattacctgctcctcctaggagtgccccgatgctccctgcacctttgttcagctcttccttgataatccaggataggatcgcacagtttctggttggtgagcttgtagtcagaagcccttttcaagcttaacactttcagagggagggtttatccaaaagacaccatactgattcaatatgttaaatgttgaaatgcttgtgaaacaacgcatatatgatagagatttttttctatctcaaaatcacttggatatgagagaccagagctattagaagccccattgactttgctttgagattccattggaggtcattgaactttggagcctcactctgaagccaagaaatttcaactttgccagtaaccacattaaaatgtgtgtacctggcaatggtgaaccagcctcatttactggtttccattctttgtattggctattcattatttcatcaacaagaatttatttttttactgccaattttacgtccaactaggtagtatggaatgcaagagaaggtgtaagttatggccattcccctcatgggccttttaataaagcaaagtaaatatgtaatccacttacagtcagtcaagagcaatatttttatttgtaatgattccacattttagcttaagaaagtatttattattctgggaagaaaaacattggctgaattaatggcagattctgaatgggctttgagcaacatttggaatacaagtgtgtaaggtggggttggtgagatttgctttatttcctgaactgctatgaattagcaaattctaaaccagctgttttccaattacatacaataacttgtgcctacctaagtctgtctttctgccaagcttctacttgcaactcattttaaaacttattcctaaatacccccaaaccagtggaataatagtaggcatcaccttaaatcataatattttcacaagaacatgttcaatcttgaaataatggccaggttttagaaagtgggaggtgagaacggaggagtagtttgttttttgtcgttaaaaaaaaaaaaaagaagaagaagtgcttgaatgagcaagttgctcagatttctctgctgctttcttcccagatggccaaagggagagaacactttcactgaagaaagggataaatgaaaaggacacctctgtatccagttatttataggatgataattgatgatagggttggagttttaaaatgtttccgtgtgaacatcttgcagttcgctttacctgccttttctgtggtattaaacacattgcttaattcctattttcattttggattggcaaatttctttataaaaggtcagatagcacatattttagcctttttgaccacacaggtctctgacatatattctttgtttctctttttttttaaacaacactttaaaaatgcaaaaactcattttaatttacaggttgtataaaaatggactgtgggtgagatgtggccggcacaccgtagttggccagctcatgccttagagaaacatggggggatatcctgggtgggcatgagtatcagttaggtcagcaagatttccctcttactgctgcttgctttgttctcttctggtcactggccgtctcaggagctagtccctggagccctgctctcctgtgtgatgtaatggtgtgaaatggtgtttccagtggaaggcctgcaggggtaaatgctgtctctaattaacctgttcatttagtgctattatcctttatctcgaatgcagttctgctctgggaggataaggaaagtgcttaattatagtaacagtttcacattgtctttgtttgcatgatgaagtacaaaaagcccaggagatgaagctgtcagtcactaagtgtctttgggagcctcttggttttttgcatttaataatcatgctctgttattgcgtgttgttgaatgaaacctcaggtcacagtctttgtcaatgatctgacccaagacatctggcctatgtaagttatggctaatgtccacgaactggataatatcattggcaaattgtggcttcattgatgcctgtttatttgctttttgcctcaattagaatactttggattgttatttgtctttttactgtgttttctaactccctaattgcatgttaagtacctgtagtccagggaatgtgccccatgcttctttgaagcctaaagtcttttggaataccatcacaatatttttataggacttttttattaaccacaataaaaaatgtcctataaaaacattgcagagatcctcatactcaaactctgaggagccaaagtcagctgaatggtgtttgggtctcaaacaaacaaatataaatatatatatatatatatatatatatatatatatatatatatatatatagtgatatatatatcgcaataaaaatgttgtataaaatattgtaatggttaaaatggtaaaccatttatatatatttaaatagtttatatttaaactatttaaagccataaaatggcttaccattttaacaatttttaaatgtatagtttaatggcattaaatacattcgcattgtcgtacagccatcaccactgttcatctccggaacatttttcgtcttcccaaactgaaactccatgttcattaaacaataactctccattcttccttccccaaccctgccaaccagcattctacggtctgcctctatgaatttgactactctaggtatctcataaaagtagaaacaaatagtatttatccttttgtctggcttatttcgcttaggataatgtcttcttttttttttttttttgtgacagagtctcacttgtcgcccaggctggagtgcagtggcgcaatctcggctcactgcaagctccgcctcccgggttcatgccattctcctgcctcagcctcccaagtagctgggactacaagcgcccgccaccacggctggctaattttttttttttttgtatttttagtagagacggggtttcaccgtgttagccaatggtcttgatctcctgaccttgtgatccgcccatctcagcctcccaaagtgctggtattacaggcgtgagccaccgcgcccggccagcataatgtctttaaagttcatccatgttggcagcatgtgtcagaattgccttcctttttaaggctgaataatattccattgtatggatatgccacattttatctattcacttatgaatggacacttggttgctttcacattttctctattgtgaataatgctgctatgaacatgtctaagtcctgctttaatttcttttatgcatactcagaagtggctattgaaatatttttgcatctgccaatgtaacaacttttaagctctgtggaactttaaatattcttacggttctttcctatgttatctgcctatagtaaaataaattttataataaagaattcagttattagctatgatgcacaaaaagatctatgagaacaagcatgtattcatgctatgtaccaggcactgagattagctcttatgtgaattaatttacttaaggcccacagaatatgttatctgtgtgctacagaaaaggaaataaaggcttagagaggttgagaaacttgcttaagttcacacagctagtatgtggcagacagggttctacttcagagaccatgtttgtagataccatgaagccattcagaaaagtggattgcatctatattcctcattatattcccagcatggttagcagaaggcttatcattttccattgcatgatgtcacttttaaatttcaaaatcaaactacataaaataacatgtaaaattacttgaaagctttaaaagtgctatacatatgcagagtattaacagtaaatcctagtgatggacagatgttaaaagctataagtatatgattcagaaaccatctaagaattttaaactgtggtctaattattatggaagcttactggagcctatccttgtgatttgttagaacattgtttcatatgccattttattcgtatctcttccaattcttattaagactagcactgctgttatgaatttcatggctttttttttaagttgctggatataagccaggttatcatataatgccctttactacctgtagtcactttgggataggtactgtgccttcaaccatctttgaaatcctacaactcgtaggctaggtttagatgccaaatagctaaagagctatcatgttgaaaaactattattagggcgggcacggtggctcacgtctgtaatcccagcactttgggggagccgaggcaggtggatcacttgcagttaggagttcgagaccggcctggccaacatggtgaaaccccttctctattaaaagacacaaaaattagcagggcgtggtggtgtgcacctgtgatcccagtgactcagaaggctgaggtgggagaatcacttgaatctgggaagcagaggttgcagtgagctgagattgcacaactgcactccaccctgggtgacagagcgagcatccgtctcaaaaaaaaaaaaagaaagaaagaaaaactatcattagacttaatttgtgtcatttcagaggacagaattgaggccattctgtgtgtgtaggttctggaaggacacatttcagtgcagaataaaagatgtagttgtagcttggtagactggctgccttgaaaattagtaaactgtcaacagaaatattcaaatacaggctagaaaatcctctcaacaaggaagtaaaggggattcctacactaagagactgaatttattaatcttcagacttggtctattatgacatttacttgaagtgttctaagaacttcacctttaccattgtcttatgtggtattgttttcttcagcaaaagacaggagctaagaatttttggttggcttatttgctgtaccagaggcaaataactgtgctgtgttggaatgacttagaagtagaaaatatttcgatcaggtgcaaatcatggtcaggaagacaacaaggtcaactttttaaacccagattctccagggtgaggatgcatcatgtacaaaacatgactgacactaagcaaagagtctgaagtggtttgatcagtatatattgattatttgatttattgactttgctgcagtcttcttggagctcttcagcatccagtactataaaactcactttttcattgtaacatttgacttgagcaaggacttaggtatttggcacaaatgacattctctcctcttttctgattaatgtggctctgggatcaaacaaagttagtgcaaatactggaatatttgctcaaatagagaccaaaagggcttaaaattcagtgcaggtagaattgtttaagtatcagaagggcagactttggtaatttcagctgcatatgttggttcttatttcattttggtagaaattgagtactggagactgcctggaagccagcctccagcattgacgtctgacagtaaccgcaaaagcagtccccctttccgctggcagagccaggaccacgtccgtggctgtgatctcaggggagggctcccagtccacagcctgggcttatgactgggaagcctgcttcttgtaaggtggggaaaacagagccaaactgaccccacagaatttgaacttggagaaactgtcgaatccaaaggatccatcaaggccagggacaacgcctagtctgaactggcgaccatgggctttttcagagccaggtgtcagaaatgggtaaatatcaaattgtgtctgattaaaaacaggagggagcagagctccccttactcactgaggagccaaagtcagctgaatggtgtttggctccaaataattcaaaagccacagtctcatgacccaaccaaagaaatattcaaaactagcctgaaatagaacagcctgttttcagaaatatgctatcaaacacatttatctttggctaaaaaacgaattaagtagttttctcttaaaatggccagatatccattaacatagaagagtataggataaatacctcttatggagatggtcagattcatgatttcatttaagttaaaaatattggcaatgataccgtataaataatatttgctctcatccaacacttttggttgaattagtctattacctggggaaaacactgaaataggatgaaataatactaagaataacattagaattatatatttgaaaattactgattatatagctatttcaccaatgagatattcacaagataaagaagagggataatgatagcccaagtggacttcccaataatgcaatagtgaagaaatcaaaatccagccaacatggacatgtcttatatcttgattggaaggtagataacacagtacatacatttgtcaaaactcaaccaactgtacactttacagctgtgtgttttcctgtgtacaaactatacttcaaggaaaaagtcaaatcaacttatttatggagctacaatttatgagaaagtacaacattaagcaagccttgggagaaaaatttcccagcattcaggaaacttgcaaatcattcgttagccctagacacaaatgtaagaaaattttaataataaaaattaagtcaatgatgagggatttgaagattcttaatattgtggacctaaatggagcctctatgatcattaaccctccagttacaaatatggtaaaacagacattaagaaaattttagaaaattttccaaagaaaatcagagtcagaatttgactagatggcagaacgataagcttaaagctccttctcctttctcctttgtcacattgacttcctcctgctcctacctgctaaatattctcaagggtctgttttcagctctctttacctttatttttatattgcactcccgttgatcctttaatttcaaagttgttatttctttattcagtcagtaaacactttttgagtgtataccgtataccaagcactgttttataggtgggtgatacacagttaaaccagaaagactaaaagtcttcactcacagagcttactttctactaatgtctgtgtacctggaagccagatactgatttctggaacaagtattctcagcagtccagacaccattgccctacaacttcccttgcatatcacgacagtgtctcaagctcaacgtgtctgtaatctcctcttctctccaaatcatctcctcctatttcccccagcctgaagatcgtcattggctgtccttgttgaatctctaggtcaaccaatttgaaaaactctaaactcttccaaattgactttttcttagatcagttcagaatctccatgtttcctcacttctttgtaatgtccagtagctttctaactcatctctctactacaatccccaactctgatgtgtcctacacatcactgcctggctaattttcctaaagcacacctcctataccaactttttcccaaacacacacacacactctctcttgcttttcctttgatttcatctgcctttcaaattaaatggaaattcctctatctggcagtaaagactattgaaagcatggcgccaccctccctttcaaatctgacttctccactacaggtacctgtacctactccagctgaagtggatttttggctgctcctttggcaggccctagttctctaccactctgcctttgcccattgtgtttctatctggactcattatgcagctttgccccactccgtactcatcatcatcctctgtgtacaactcactcactgtcttttctaagactcctttctcattctgatcagcatgatttttccttcatttgagtgtagtcatcactcactgcattgcattatggtcattctcttccttttttattaaaacaacacgatggattttcataaaatgacacatccttattgaaaaaaagtatacagaagagtaatgaaagtaaaaaccacctgaagctgtatcacccagagatatctggttttgaacatccctctagatgtttctttgtgtgtatacacaatttatgaagtctatatatttttccagaactgagatcaaattctaccttttttcatgttgatatattctgatgctcttttaatgttgatcaatagaaaactaagctataatttgcagtggctgcaaggtatctcatcatttggctttaccataattttttgctttttgttgttgatttttttttttagcttgtgttcctcccagtagaagatgagaggaggaggtgcttagcatgtgttctgcccatgtgcttagcacagtcttgtaaaatgcaagtgagcagtctgtcatggtccttgacagggactgtttgtgacttatcactccatgcggtttgggacctgggaaaatgtttagagatcttgagaacaggttagagaggattgacctaaagtcccatagtaaaattttagcctttaaaaaaaacaattattactgctttgaacagccttatgcccccattgcctgtaagaaagccattcattatttcttgttacataatctgcagagagcttattcacttagaaagcagtgcattcatcatagcttctatcttatgagtagctaaaagcagaatctgttctgcatctttgaggcattcttcgcagcacagacctcatgctatcactaattagccagagcattcccagccaaaaatcccagtgcctgtccttgacaaaaaagtctgttttttccacagtaagggtgaaaagcctgcctctctgtctagggacatctccataagacaagcaaaaatagggtggtggtgagctctcagatcagccagcgcaatgaaacagactgcagcctcttaggagacttactgtttgctgcctccctttctctgcaaagtgggatctccattagacgatgcctttgtactctgacaaaatacctaaccaccatgagacaagccacttctgcattattctgtacattgttcctatccattccccatttttggcttcagaagtcatcccctagccaacttccagccacttgcattaatgatgaatgcgattagcagcctatgctagtccattagggaaaagaaagaaagaaagaaagaaaaaccatgagattgtttgcttgtcactgggaagtgaagcttgacgggaacatcctcactgtccctccccaccgcccctcctgccatgtgcctgtgatctgtgcgcatgtgctcatggttgcccgtgttccatggctctgccatttgctcagtggggggacgttttcttagctgagcagtgcaccactctgcctgagggattgagaacatattgcttggcaggtgggcctactcagacgcactgactgttgtttcagcactgacagggaacatacatcatgcaggcccattatgccagcataaatccatggtaacctgttcaaagggctgcaaccagcaaacaacgtgtttgggtcttaataggtgatatttttgaaacatataattgggatctgagaagtaattctggatgacaagccactccttctgccatcctaacagaagctgggcctacagcaaaataccactcctgtcatgctgcacaaagatgactgccattccagctcagctccaggctgctgtgcacggcgccaacggtgccaagagcttgtctgtgcagggaaaagagccctcaggtttgagggctttcctttgtgccttgttgctctggactgctggcaaaaggagctcctaggattgttgatagacaatgtcagagcctctttcttcagcctactattacaagtttgaaagggatctagagtttgtttggcgttgggtagtggacagataatcctcaaagcagagggttctgatcaaagctatctttcatatcccccactggcctccagtaggagaatgagatattaataaagtccttgaaccgagtgtgaaggggcttggtatcactagccttgctggctgcttccctacacagaagccagacatgtggtgccagcaccttggagatatagtgggtaaagtctggcacagccctggtcacaaaaaacactttttccctgcgtttctaggatgaggaggtgaatgattagtttacacgagtttccatccattggagtcatgatacagtttccttacaacacacttgctccatgactcatgttctgcattcctgttgtgcagactctcacaagatgcacctcaccgcacataatcatctgttgctttctgcttatccactaaactgttctccctaaagacaagtaccatactttatttgtacatagccaagtgctagtttcatgggagacacagaaggactgaagaaaggaagatgttcattcataaaaagaaaagccacaaggaggtcattgtggagttgttgacttttttatcttcttgatttctaagaatcataacatgggtatttcagtatgacttgccaattaaattacaactgggtggcaataatatattatttaactctcattctgccacacaattaaacaagtatcaacacaacccaatatgcatgctacacagcatctgcacttttctcttgctacaacagaagtagtttccttaaagcaaattagaaaatagtctcatgagaccaaggactttataaagtataaggaccaaggagggccaggtgtgcacctgcagtcccagctactttgggggctaaggtgggaagatcgcttgagcccaggagttggaggctgcagtgagcaatgctggcaccactgcactccagcctgggcaacactgtctctaaaaatagaaaataaaataaaattttccggaccaaagagaagactgttatgatgtgaacagtagcagtcaatatttagaaaagttgtgttcctggtagtctggcacagaatggtgattatgagagatatgggctgtatcacaccgcagcagtggcccagctaccactccaccagtttcaccactttcttgtttctactcaacagtatggttacttacaacacagagatttgccagcccaggtttcatagaaacatagacgttggtcctctgtccccagatattctagttataaggcctatacgggagcctgggattatactttgaaaatgcttttcaggtggcttagatgcagccagtctgtggactctggtttgggaagcactgattagaagcatacaatactgagaagcccagtagttccctcagtctttccactgccatgtgccctctatatgtcttccctgggccatctgtctaaaaatgcctgatgtcttagacagaggctctgaggagccttaagagctccttgcaagacataaaaccaagacgctttttggtatggaagggaaatatcatttagcacatctccatgtccatcatcagttctacttctgaaatattatttaaaaacacatttattgaaatacgattcacttatgaagttcatcctcataaagtatacaatttattgatttttggtatattgacagccatttagtaaattgtacaaccatcaccactatctaattctagaacattttcatcaactaaaaagaatccccaggctcattccctcctacccagaccctggcaatcactaatctactatctctgtggatttgcctattctgaacatttcatctctgaaatatcctaaagtgactgaacgtaagtccagttatatctgcaagtgtctctaaaaatgtttttttctaatattccattgggggttgctggttcttacatcttttatagtcagaaaggcttcacttatctctaacttttacctacattacccttctataacattaactcatattcccttgtcttctctgcctctctctcatcatttcaccaacactcaaattctttataaattcaaacatcattatcaagtcacctcccgacttttctgtaggatgaatgatctgaacagtcctatgccccttcccagatttacccaatatttcctcctatttcttcttatttaaataaccaagtgttcacccttttctctaaggtggatgccttcatttgtgccctcttttttattctctttctcctgttctagaacctggctttggactgcatcttcattttctttcttcaacctacagtaatactccacgttcacactttttaaaaaatacctctatcctgctgcctcctcaagctaccattctctttttctcattctcttcactgccaaaccttttgaaagcacagtttgctctctctgttggtgcttcttttccactcactcccacttcacttcttgcagccatgactctgctcccgttactttacagaaatgtctctccttgtagttcatggcatcaagcccagtacccttccctgaccccattccctgagacctctaggtaacctggagctcagttgactattcctccatcgtgaagcactctttttcctttggcttctctggcactccacattatccggctacttttggctccagtgtttagtgccttcccaaatatgggtgcccactcttttatctgtctattttctccctttccagcctcataacaccatctggctcctaactatgtggataacttccaaaactatcttcaccacttggatgtcctgccagctctttagactcattgctcaaaacagaactcaaaccctgacaggctttccgtctttcctaatgttggccataatgtgacccaaggttgcaaatttgacttttttctttctgtctctatcacctccttggttgccaagatgacaagccatcatgtatataatagcttttttattctattgaagctgtatttcttcatccatcgtctctacttctcaatgtcattgcccaggtccaggctttcattggctctcatttggactatcaccagaccattcgatctctgctcattccatcttctacgttacggccagatagcagtcctccttcaacacatatgtcatatccctaggcagcaatctttcaaattcttctaagcctactgaatacatcctaaacgccttatcctaaattacaaggccttctatattattttccattccttcatattctgtatgttctgtcctaagcaaagcactgatcattctttcacctccacaatttctcatttacaggacctttcttgtcctgtattcttttatctaaaatgatgtcctttatttctgccaacatgattctatgtgttgaaatcctctcatccttcaaattctttctcttccatgaaatcttagaacagtatttctctctcctttgattttccaaaattgtatgaggtggcgggggtgtggagggtaggaaaggacatttagcactttgtcttgtatttccattatttatgtgcttgtcttatccagtcccgccttggattttcattgttataactcctgtgactgctgataaagtatcttaaatatagtatatcctgaataaatgtttcttcagtgaatgaattttttaacttctataaaatatagaagatgtaaaaaactaaacttgtagatgacaggctttatgtcagtgtcaagagagttctcagtagtttccacactattattattttcagtcaatctaggtacaaggctgaggtgaaagaagcttgagagaattgtagcaaacctgccatcatcttcatattgtaatgcctttgcatttgcataatattttataccattataagatactttcacatcttatctgaccctctctatacttattttaggttagaaagagatagttatcctaatatccatttcataatgaggaaagtgtattctgggcagttttaatgacttaattaactaacgtcaggttattgattaggggcagacctggacaaggggacctgttggctgtctttaaatatttgaagaactatcatgtcaaagaaaattaaatctttttttttattctttatttcctcagaggactagaacaaacacaagtgaattcaaactcaatgaggagataaatagtttaactatcagatccacttcaagatgatattggctgcctctgttgttcaagaggagctcagggagagcaagctggccaaccaggtagaggacagtttgttggaaagagcctcccaaaaagtataggttaaccaagctcccttctaattttgcaattttgactttctttttaggtcagcactgtgttactaccctgcataatctaagttttgatttctgtcttttttttagaactcaaccttaagcaaatttagccacagtgtggtccaggtcctagattttttatgagatggccactccaccttatcctacctactccttgcaactgatattggaccacctacaggtgggaatctaaaagaatgtatttccacccaatccttcagtgcctagagctgccagcccaatggggaaaaaaaacacgaagttttcagaaaatctcacaggtgccatcatcacatgtagccggcccaatctggcaactccagaaacctgtctggtattatggccatggtaggcaagcctagtgttctctcagaatgccactctctcattctgttggaaggaggtgggtgactctaatgagctccaaacttttccttgaaatggggagttgcctaaaaaggcaactgcctccaaacagccaaatggaaattatgatatttcactgaactcagaaccaaatctgccttttttttttctttatagaaacattttatgtgccatgtgccttgggagccaaaaagaaatcatactttggctccctgttccactttgctaagctcagatactgtaaataccctcctctcctctcataacgttaaatttttcatgaattcatcataaaggagccactttgtagatttggctggtaccagtgaaagacttcattttctatttcacaggaacttttcagtgcaaaaaaaattacgggtgcaatgttgaaagactagaattattcatcaagtcttcactgcctgcaaatgaagagaatttttctaaagcctatctgggagaatgcagacacagacatgcatattttagatggtgcttcatcttcaccgtagccaccttatctttctcagaagagtcaggagtaagagaggatatgtgctttcttattgttttgtggattcattcaagagttcacaacagctcacacatttcccccttaccttccagtgtacctggaactcaccaatgcaccgaagaagagaatatttccttgaattacgcattgatagaagtaccaatagctttgtatgataaaatgcagtggttctcagactttgacatgcatccgaatcctctggtgggcttattcaaacacatgcaaggcctcatgccaagattttctgattcagtagatgtgggttgaggcccgggaatgtgtctttttagaaaggtgatggtgctaatgctgcctgtacaaggacaacactctgaggaacactaacataatgaaaagaatttagaaatcaggaaaccttggttttagtcctgagtcatctaccaatgatggatctgtggccaagtccctgggcctcaagagtagtgactcctgcactatgtgaactagtgttactttgagaataaaacctgagggtgtgcaaaagaacactcagcactcagggctctagagggacttgaaatgttataattacaggcatgaggagagttgaaggaaaacaaatggaagaagttttaagatgcattcattctgtcaagtccaagcagagaatggccggcactcaactgctatgctaagaaggggccagcgaagatgggaagagttaggtagttcccccattctgtgacctggctctgaaaaagtcagatactctgctttattcatgttctatatgatatagccaggccgtgttagagcagtggtcctcaaactttcctgtgattcagaattaacctgggacattaggtaaatacacaaaggcccaagctctttcctacttcaaggagcctgggccttggggtgattctgatacactccaaagtttgagaatgaccgaatctgtgctgataactgtaaaaccatatcctgataacctgtgaaggaactgaatgccctagacagttttctcagccttgtctgcacattggaatcccctgcagagcttttaaatcccacacgtacaggccaccatccagtcctgttgtatctgaatctctgggggtgaggccctggtatcagtaccttcttacagcgcctcagtaattcacatttgcagccaaggctgagaagcaagcactgatttagaaagagtcccctgtcactgtcctcagcaaatatgttttgtttgtgttttgttggcttgtctctttcccatatcatgtggtgagaatattgaggccatttctttgtgcccagaaaccaacacagtgcctcactctgtgttttagatgctcagaacatgttggttatttgaatgaatatttcaaggtatttgaatgttgaattaatgaatatgcaaataaaatacaacaaaactcaccgcagaagtcccctacattgaactgttttgtgtaagcacaacccgttgtggagttcaggccctcacaataagagagtatttattgaataatttgcagaatcacaatcacggagtatctgttgaataatctgtaaaactgttatcaaccccaactataacttactcttccaggtgagatgaggagtcggggaaacatttgcctggcagagtgttaagaatgctaaaaaataataacaataaaaataaaaaaataaaaagcagcaaattaagacatatttgacacctactacgtggcatacattttcatttgttctcactgaatcttcacagcaaacttgcattctctctgtttttttctgagggaagaaatggcaaaagcaaatcgcctgtgttgggaagcacaggggagtttgttggaccccagagcttgagttcttttccagtatttattttgctgccattcagagcttccctagccacccctgctgcttccctgacctgctcctgcatggctcaccaatggatcctagtcacaccagcccccacagagtgcttcctgacttctccagtgaagtttcccccgggaaattctcactggcccatgatttgattgcctgaccaccttcaaaacgggttagataactcatagtatgctatgctaaccatgttaaaaagcttattctcatagctttgcaatggcttctttgtatgactgttcctcgccctagacagaaggcttcttgagggcaagaatggtttcttgcctatctttatattccctttgcctagtgtacttcctagcccattggagagactcagttttttctaaggaatgaatgacagcagaaactcatccatgatgagcaaggacctcctgaaacatttcagcatgtgtgcatgtgttgtgcttcagaatattttagaaacattttccagatttaattgaggcttctgggaagccttgctgtgttcttccttgcaaaaaatagaaggtcgttaccaggaagtctcagtgtaccatatttatctggtgagttttgaaaatactgagtaatgggactaatgactcaacatagtattttccaaactgtgaggtaatctttggactttgcaagattattatattaagtgtactttttagtctgtcagtaaaaaataaaaagcctgtattttcacattagaattcaaagaacatctgctgcgtattgtaaataacatattttgaaaaccaactgatgcatactcagcctgcctccgcttgctaactatagcaggtccttaagataagattcagtttgccattggtaccgctcttgctttgacattccactgtttggtgaaccaccgttttccagaaatctttagacaccattcaaccctctaaacaaactgagtacagtgaggttttcagcttcctgttttctagtgggattagaaagggaccctattcctagatgatgatgtgtttttcaaggagttaaacttagagaggttttctactggggccatttcttacccccaaggacatgcatcctctggctggaagctcagctcttactgccttgcagagagccaccagttgccacaggcaaccgactgctcccgacaggaagggtagtattgattttgctggtctgcctgtaggggagcgggccaaagaggaatgctcagaggggctcctctgtctggggtgtgcatttgcacagcagccccattcatgtcctccagcctgtatctcacctcctcgggagactgaaaaactcaatcagcttttcccttgttccttctcagtttgtcttgttagcactctttcttagcaagtaagcaccatatgtcttctatgggaacttgttttcaggagattcccagcgcatgtgtgctggctgggaagagaggaattggtgttttactaaccagcagcgcttgccagagtgcccgcttttgagtcctgcccttcctgctcatctgccccatggtctagtttgtcctggacacagtatttcactggatcttactggggtcgcagaaaattgcctggcttgtgagggatttttctgaaccaaagagagagcctgtgtggatgcctctctgtggttcctcattatcctgggtagtctgtgtctcacaagcacctgttcattgatctggtcctctgtccttgcgaagacgatagcacatactgattataggggctctatgtgatgttattgggcttccttgctcttagccagccacccatgccaaagcatgcagctgatatgttctgcttttgaaataatttggtttctgtaacacgaagcccaccacccccctttcaacctttaatacctgtcttctttgaaagccagcttgttgagcatccaatttgtctcttttcttcttcactttcccccagtttccttgcactcaggctgtcttttatcaaaaacagagagtgagccaatgacacctcatggcaagcagcagcatgaagcattttcttctttcaccttgacatcttttcggcaaagaaaaagcaagggttgggaacctgctctattcactttggcttctacagctacctcttttaaaactgctggttgttattgcctggtagctgtctccctgaaggttttaccagttgttttggaaggctggctattttctattcccttgggaattcaccttacacagtcatagatgcatgtgttatgtgtatttgtgttcatatgctatcaattagtaatgaaaaatcaggccaagcctctttggtacttttttttcccctacagatgagtagtcagtgttcataataactgccaaaacttatcttgagtttcctgagtgccatggtctcatgtcattcttacaacaactttttgaagtagtccccattttacagatgagaacactgatgcttgacaggttatgcaccatagtggagctaagacttgaatgcaaagattctgccttgaaagcccaggctattcaaagattaactggattgcctgggcctgatacggtatctctcagtcactcatttgaactttgccaaccatagtcctaaatgcccaatgcttatccttggaaaggctagatatcagcaaacatgagatgagttgaaaataatctttgttctgaagttctaagggataagacgcattgctaccaacatatgtggcctattaaatgatgattctcagtggcacagaggagattgaccactgtggtggggaaggtggggcaaggactgagagagagtgggggacagttctgttatagcccaaggtgataaaggagttgtgataatcactggattgataatcactattctagaaccatagtgttcccctaatcataaaagctactattagccacgtgttgtggctcacgcctgtaatcccaatgctttgggaggccaaagtgagaggatcgcctgcagccaggagtttgagaccaacctggacaatataacaagaccctgtctcttaaaaaatgtaaataaataaataaatgtttaaaagccactagtaagtgaacacatactatatttctggcattgaactatatgctttcatttaatcattctcattaccctataagaagatactgttatctcattttttctctgtaaaatgagatttctctgtaaaatgattcttagtggcatagaggagattgaccactgtggtggggaaggtggggcaaggactgagagagagtgggggacagttctgttatagcctaaggtgacaaaggagttgtgataatcactggattgataatcactattctagaaccatagtgttcccctaatcataaaagctactattagccaggtgttgtggctcacacctgtaatcccaatgctttgggaggacaaggtgagaggatcgcctctcaccaagtttcagagaggttatcctggctcaaacttgccacatcttaagtgaaaaaaaacttagacttgaacccaaatgtgtttgtcttcaaagcctatgctctattctttcctaattatcagcgtctttttgcccattgtgatatttaatcagaatcattatcattaatagctcatccaactgataaaggaaggaaataaatgaattttgtatttgtggaccagagtatgtgattgagctgagtatgcaaagatttggtcccctggtctactggatgatcttttcacaagtgatctcagttagctgccatgtgcttaacataggttgaaagttagttgacagctttgcttcactgaggattgtttccagaattatcagtgcttagtgactttgaagataaacatggattacaggttcaaggagcctacgagagtcagaagagttgggaatgtgttcccaactctttaactagctgtacagatctgggaactgcacttaactctattcaacctcagcttttctatctgaacatcatgttaggtaattccaagatatgttttagctctgaatgataattgctgtttaccgtcaagcctgtttgttttacacatacagaaaaacactcttaacccatgaagtatgtagttaattgagaaagttaaaggaaaaagtcataaagaagaaaatatgctatctacacttaatttttaaaagcagctttattgtggtgtaattgacatatgataagctatgtatatttaaagtgtacaatttaataagttttgatcaaagtacccactcatgacaccatcaccacagtcaagataatgagcatcttcattcattactccacaggtccccatctcctttgtggtcccttcctcctgcccattcacccagcccctgccacatatacaaaaaaacaactgctaagctacctgatataccttctgtcactatggattactattcatgtttagagtattatataactgtaatcttatagcgtgtatacttttttgtgctctcacattctgtataattattttgagatttttttttttttttggaaacaaagtctctttctgtcacccaggctggagtacagtggcacgatctcagctcactgcaacctctacctcccgggttcaagccatccccctgcctcagtcttcagagtagctgggattacaggtgtataccaccacacccggctaatgtttgtatctttagtagagatggggttttgccatgttggccaggctgttctcgaattcctgacttcaagtgatccacccacctcagatgcccaaagtgttgggactacaggtgtgagccactgcacctggcctattttgagattcatctatatggctgcatgcattgaggccatttctttctttcgctgagtagtgtatggatataccataattatttaccttttcacctactgatggacgtctgggttgtttacaatttttggttattacaaataaagctgctgtgaacattcacatacaagtctttgtatggacatatatgtatttgaatcttaaggaagtatctaggagtagaatggctggaactggtaggtatatgtttaatgttttacaaaaatgtcaaactgttttccagagtggttgtaccgtcttacatttccaccaaccgtgtataagagttccacctcctcacatcttcaccaacactttgtatgtcttttcattttagccattcttttattatttttttttttttgagatggaattttgctattgttgcccaagctggagctcaatggcacgatctcggctcactgcaaccttcacctcccaggttcaagcgattcttctgcctcagcctcccgagtagctgggattacagaggtgtgccaccatgtctggctaattttttgtatttttagtagaaacagggtttcaccatgttagccagactggtctcgaactcctgacctcaggtgatccacctgcctcggcctcccaaagtgctgggattacaggcatgagccaccgagcccagcctcattttagccattctaatacacatgcactagtgtctacttgtggttttaatttttgtttttctaatgactactgatattgagcatattttcatgtgtttgttttccatatgtatatctttttgggtaaactttctatataaatcttttgcccatttttaacttaaattctttgttttcttattgtgagtttgagattatatatgaaaaaatattgtttaagaaataatctaaaataaaaataaatatattcttttatttatttacatatgtatacaactccttacatgtatgtacacacacacacacacacacacattctgcaaagatttgctcctagtttgtgggttcttttcatttacttaacagtatctttcaaggagtagaaatttttaattttgatgaagcccaattaattaatttattcttttatgtgttgtgtttttggtattatagttttgcctaactcaaggttaaaagattttctcctatgttttcttatagaagttgcacaattttagtgtttaaatttcagtctccaatttctgagttcatttttgtatatgatgtgagttcatttttgtatatgatgtgacttcaattttgtatatggtatgaggtatagattcaagtttgtttgtttgtttgcttatggatattaaagtgttcccgcactgcttattgaaaaggttatgcattctctactgcattgcctttgcacttttgttcaaattctgttgttcacatgtatgtgtttatttcctcaccctttactcagttccactgatgtaattttctgtctttatgccaataccacatcatttggttactacagctttatgatatgcttgaaatcagggaatgttagccttccaacttcttttccaaattgttttggttattgtaggtttatatatttccatatgaattttagaatcagcttgtcaacttgtatggaatctatagctcactctgaggagaattaataccttattgagtcaaaccatgaacaaagtattttttcatttatttagatcttctttcatttctcttagcaatattttgtattttttaatgcacaggtctttcacatattttttgtgtgatccctagttttttatattttttgatgttattgtaaatgataacatttttaaaatttaaatttttgattgttgctagtacagtttatttttgtatattgatgttatattaaattatgataaatgcacatactattatagttctagtagcttttttatagattctctttgatctttctacatagatagttattatgcctgcaaataaagacagtttaactcttccttttcaatctggattactatctcttttccttgttgattcacttttagaacctccaaaacaatatttaatagaggtgagagtggatatttctgttcttagggcaaaagcattcagttgttcaccataagtatgatgtttcctttgggattttcatatatagccattttccgtttgaaaaagttcttttctaatcctggttttctgattttatcaggaatgaatgtttgatttttgtgtgtgttttttgatgctttttctgcaactatgaagaaaatcatatggtctttcttttttttttttttttttctttttgagacagggtcttgctctgccacccaggctggaatgcagtggtgcgatcatagctcactgcctccttgaactcctgggctcaagtgattctcctacctcagcctctcaaatagttgggaccacaggcatgcaccactatgcctggctgatttttttttctttttttgtaggaacaggttctccctaggttgcccaggctggtctcaaacccctggattcaagcgatcctcctaccttagcttctcaaagtgctgggattataggcatgagccaccacacccagccaggtcttccttttttagtgtgtgactatggtgaattatattcatagatttccaatattacgccattctatgtacattgtacatacattgctaaggtctttttttttgcttatgggtttgctttttagagctctgtatcatctttcttatataaattctcatccataatgcattctctacattctcagtttcagtttaagtggaggcagatcttggacacttgtcaagttttcaagtcctctaggtttaagatttgttttgttttgccagtcttttataatttccttgtccacacctaagtggatagcagtttatctttaagtttctcacctttagtgagtgtctaaaacactcttgtttggtttgagagaagcaacaattatatgtccatattcatagttcagcaatgaaggtaattattaattaaacgatataattgtaatacccagcacaactgggtaaaaaaataaaataaaataaaataaaataaaaataaataaaaacttgggatggattacagctgagtgttggtaagcatacagcccagtggaggagagcagaagtgtgtagactagagaatagccaactagactcagatttagtgtgcggtggtaagctattcagagagtggaaacaattagttactccagggaattacagaaatggaaactaatagagcttctgtaattctctttcattcctataaacagtattcccttccttcagcaaccagtgggcaaaggtccagaggtcaccttctatacgaggaacacaaactagtcagcactgaattatcctcacaattagaaaaacacctgtgaccaagtgtggatccttgcaatgggctttaactatacctgtagcaaatatatggaagaaccctggatttagagtcaagtgagcctgggtttgaatagcaatgactgtctctgtgttgttgagcagccttgggaaaattagtacctcagagggtcatctcaaggaataagtgatagaacatgtatgagacagacacagagttgtaggtatgccttgtgtgtggtttggatccttgttgcaagatgtttacactatctagagtggtgtgttctacccaaccatatgatcctcctgcccaaaaagttccctagctctagcctgtcgcaacatttgatgcaaatggagaaggaaggacattgaaggcagagaaaacagtttgaccgaggttaggtggcaaggaaggagaaagcatacatgggaagatgtgagcagtcaggattgggcacaaggttcatgctgaggtaggggggcagacaagctgaaaagtcgcctgatgtgcgaccatgccaagccgtgaagattggctggattctctcacctctcccctcacaccttatataggaggttggtaagcaaggagagtcactgaaacttttctttttaagggaacgccatggtgagagctgtgccagggattctcaaaccttgactgtatcagaatcacctgggagcttgttaaaaaatacatataccttgggccccacccagacttactcaatcctaatctataggtttgggtcaaggcatctgtatttttaacaagctccctaggcaattctaatgcacgccaaagttgagaaaccactgctttagaaggttaatctggcagcagcgtacaagatggattggagctgagagagcctggaggttcagagacctgcttgcaacaacaatcccggcaggagataatgaggttaggggctgtgggaatggaaaggaagaatcagatatgggaggtatttttgagaggcagtcagcaaggactgggcaacgaatttgatggggaatgtgagggagaaatgggacttaacaaataatgtcaaggtttagagaagctgctctccatggcatgaagggagaggtaacagaatcccctggggaccttagtcaaattgcacacacctgctcccctttctgtgctcatcctccacatcttcctccttccctgcaagttccctgagatgtgtgccaggatggggcatatcagctcctcctggggaagcctgcatgtgtagtttgagggggaaacttttccaggtgacacttctgttgcaagccacttgttaggcatctttgagcctgtgagaatagtggtgtggtgagattaggaggaaggagggaccaagctggagctgaccacaggacatgaaataacctttggaggctgtggaaatgtgagttcagagctgtggagcaagaagtgggctgtgatataaattcaaaaggccactgcatggaggtcatggtgaagacagatgagaccgtggagagtagagaggaaaggatccagaatgaagcttgaagaaggcctacggttaggagtcatatgcagatgaagggtcaaagaagagcaggctgcagaggtgggaggagactgcttctgcttcaaggccaaggcatgaggcagacatctagaaagatctgcaaacaggagggcagaactctagctcctctgccatccttccaccagcgtgattttgtgcaggaagcagtccagtcccccaggagtatgtggcacagtcatgtaaaggggttaacgctgtataggaccacacatttgaaaattttctttacaaaatccagtgtcttttgagctgatgtaccagagactgacaggctgtaacttcttacactattccccccaggtttctgatcaactcataaccttctatacacatttttggcccagcacagccaaatgtaaggtattaaaaatcattatagtgctttggggtccttgctccccgcaaagttccagacatgctgcctgtattttgtgatgtcacactgtgaaaataggatgttgtgttttggaggcacctccagggtgcccagcaattggcacatcttaagtgaaagaaaacaaattgagtgagcaacagtagaaaagaaggacatttgtatcaacccaggaaataaagaattacgcagagatgctatttatgctgctatgaagctgtgacttgatagggacagcataaaggttgcccactcctgacattggcaagacttcaggctgaccagagccactccactgaagtggggtcagctgtctcagaaggtgctctgtgaagctgacgcagaatcacagtttgctgtaaaaagggcttacacatgtaaaaccttgtattttgtcttagaagtatcctggaagctatcgcattttcttagtagagacacagaggcatcaagtaataaagaaacgattccaaggttccagactcctgggtagttgggcaggagactcaacctagagttctggtttgtagggtacagagagaaaggcttgcatgcgggaagagcacatttaagaatcacttggggatgggcgtgggttagattccagtctgttgcttcttaactgtgtgacctggggccattcatttgacctttctgagcttcagtctccaattgtaaagggcagaaaatcatatttacctcctgagagtagtttcaagaattaaggatgaaggcaccattacagcgcttggcatgaagttgatccccccaaatcgatgcccatcatcataattactgggtttttccccagtcgtctgaacactcatgtactcccctggatgcacgcaaagagacactgctgttttcctttggcatccctagtttggattttaaatgcttttttcctcattaaaataatgttatagctggaaggagcttaggtgcagttgaaataatactgttacgaaggtctgtccttcaaggcatttataaactgaatgggactttttgagtgggcctggacaccaggattttacgggaaaggtaccctagcccccttttttacaagtgaacttttattaagccaccagctctcagaacttgcagaattgctggaaaattgccttgggcagggtatgtaatcacaaaatgaataaaagacaacaggatgtgagtctttccaaagcatgggaatagcacactgcaacttcttgccatccctaccctgggcaaagatgcagctaaccagctacattgatacttggaattaagtcaggaggcttggccaggggcccccaccattccacaccttgggcctgactgccactctcagtacaggttgctaatttaaatgccatctcctggcactgcatgttgaaacaaactggaaaatagcagggcctttccttcatcagatcatcaatgtctgcctggcgtctgcctgcctactgtggccaacaacctgccttcctgtgagcatcctccaatgtacaaatacctcaaggactcctgacctctgggatttcatggctcctgtccattcttctctcattctcttagcaaaagaaattacttaagaatgggtgagggatggagacatctctcagctccctatggggtcttctttcctgaacaaactgagcagagccgcaaaagaatacataaggaaggcttggcagaatgttttgatacaaaattcattacaggtttgtttatgtgctgggcagtttgggtcctcttacacgtgtgtagacactgcattccttctggttcaagttttgtgtttagagagaggttttggaaggagatcaaagatgtcagattgctggcctaattcttaaaagaactgatttggggaaaggcttgaaaacattcatacccaggtttgaaaacaagaagtagcaatgagtccagaaagcttggtgacatggataacagtatatttttaagaaaaagagaatttgaatgtcttctgcacaccttatccgtccctaatctccatatcttccatatgtatttttcttgttttataacactgtctaagactcgagtgtaaaatccatcatccatcacccaaccctcacttttgagtgggcagagggtgttgtggaggtgactggaattcattggggtcatatctaagcatgagttaagagatctatctgggactttgtcttctttcatgttttttcttccttctttacagtacaccgtcaatagagattgctggcttgtcatccagtttcctaaatttcctgacttctgccttgtctggcctttattcctgtctatatctctctggcttcaaggtgataaaaatgctcacattttcttaggaaatattcagttgtattctctttgttgtgaaggctcctttgtccactccgtctcctccatttaggggaggttttcagggataattagtgaactcagagggatatgatgtaccttttcaaatcagggtctacttccagtttttcaggtttgttttaaagtgtgtggctcaggcatagagagcagcggttatttggacacctggagttacttggctttgctacccactaccttttaatgtgaagatacctcattgcattgctctgcatatgtgcagaggaaatttggggggaccctgttcacctttggcatatcttgatagttgtatgtgcctgcttgttgttgttgtatattgctacagcaatatggctcatcatctttctacctaagaagatacaggggaaaagaaaacactgccataatcaaaactacagaaatgggtttcataagcattttctctaactactgcgtctacccagatccaataggaatgggagggcattggcatcgttagaaaccggggcaaaagttcctgctgcaatataaaatctatagattacgcttggaatcagtggaaaccattgccctttatgccagctgcttcctgaaggagccaagaaaagtgtatagttcaggggaaatgcaaatataagctccctcctacctatagcaggaaattagaaacctctttggttagcacaaacagattatgatttttttgcaagagagaacaggagagaggaaagatacttgaggtggcattgtataccataaagctatatttatgtgctaagacaagcaattgatgttgttctataaaatatagtaaacacctcctccctgcccttttgaatgtcagtcagaattcagaatcatgaaattttatagtattactggttagaagggcttcccactgggagcagatgccatctctgtcttcatagactcagagaaagtcctgacatgtttcatggcgttcgtacgtggaagtctgtgaaatggaaaggaaaacagctttttctgtcaacctgtcactgatacaagcttttacattccatcagaatgactaaactttaaagctgttttcttcagtgctgagtatctctcagaactcccaagtgttatcagattgatagagtcccagcatatgatagaagaccaaagcattttgtggcatgatattaaaaattcattcaaatactcgataaagcgtggttgacaaaagtgtgaaatggaataaggtagagtgaatttcttcatggtttattgcccttgatttctctccacaaaataaatagacagaatggactaaaatctcttctttatgaaggtgggatcctggcagctgaaggcctgctcataaaaatcctctccgtgccacatacccttgcaatgttcaaagttggaagcaatggaaatttattgctgttatatgtattcatgtttcagactgagtgaataggtaggggatgcttttatgaggttgctgagaccctgtgaagaatagagaaataaaacacacttgtttttcccttgaagcttgtttttttctaggggggattggtgattttagtaattatagtggtattggcaattcatggtggtggtggcggcctggtggcagtcctccccctgaaggtatttaaaagaaaacactcttttcacggtctccccttcctgcctgccatcttgttttgaaagagaagcataaaatagcaaatctttaaagccactgcaagccaagcctgtgttttcatctgtctccctcccttgccaggcctccctctgcctttctgacctgccacccccttccttccttctgtccctccctcctctcagaggacatggggagtgagaggcttccccctgtttccctgcaatggtgggacagaatgcctcattggtttcagatattaacttctgtgctgaaaacccggttggagctggtgtgacaaatggattgtacctgctgctggaaaacacagccctgtcccacccgcctgcacacacaagccctcttccccatcttgcagagcccaacctagggagcagggaacagagagctgccccgcggcaccatctgtttctgccagcatctatgttgggccccgccggttacatctgttgagaagaacagtgtacttgatgagttgttggaaagaaatgtttagtctcccccatcatctctgttagccattacgaggctgctgggctcacgtgggtgtatctatgtgtgcttcctctcaggcctcatctgtatcaattggaaatcagtcactgggagttagttgcagtcagcagggacccaaggcatttcccagtgacatcaattcgtcttctcttgcagaaattcaggaaacaattaaaattctgatgcgttccagggaggatttcaaataaatcagccgatagctgatatcttgtaactcttggtagcaaagcaaaattaacaacccagccgcatctgtgtacagtatgctaaaataaagaaattaaccatgcatcacctccaatagaggaagcagctggcctgttctcaaccttcccataagtacccaaaacctactgatttgttaagttgtcattctccttatggacatcaaggacttcctgcatatgccaaaaactgagctggccaaataatcggtaagttgcggaaaatccaggcaccgattaagctcagttataactcccatgttatgcagaggaaagctgacattttgaggcggacccagttgatagctgctgaggaggtaatacaggatgcaagtaggtttggcagcaggtttagccagaattttgtcagaatttgaagattttggaatcataatcagatagccagtattttctctctcccctcaaaccaaatgcattgtgcaagaacttgtgttaattatccctgttaattacagtgataccacctcagcttttccaggctcttttttgcagctgtctttgtggtgatttcttgtcttaccacttgctgaccaatggaactcaccattcttgctaggttctcttaaaaagcagcataacaagaaccggtcgggagtatgttcccttgaaaaataaaaatctcagcatcacacccaagtaaaagccatgtgccttattgaagttctaagtctatagtgtgtttgtgtacatgcccgtcacataaagtgattgtttattagtttcagtggatttttttcctagaaagatgcataaaattttaaagtaaaaagaatatagtgagccaggtggggtggcccacacctgtaatcccagcactttgggaggctaaggtaggaggattgcttgagcccaggagttcaagaccgacctgggcaacaaaatgagacctcgtctctacagaaaagtcaaaaaatgggccgggcgtgatggctcatgcctgtaatcctagcactttgggaggccaaggcgggcggatcatggggtcaggagatcgagaccatcctggctaacacggtgaaaccccgtctctactaaaaatacaaaaaattagccaggcgtggtggcaggcgcctgtagtcccagctactcgggaggctgagataggagaatggcgtgaacccgggcggcagagcttgcagtgggccgagatcgcgccactgcactccagcctgggcgacagagcgagactccatctcaaaaaaaaaaaaaaaaaagtcagaaaatgagatgggaggatcgcttgagcccagggtgttgaggctacagtgaattgtaatcgcaccactgcactcccacctgggtgacagagcgagaccctgtggaaaaaaaaaaaaaagaatacagtggctggaaaacaaaacatcacttgaaaattttcccaccttttaaattcccagcactgggaaggaaggggtctggtatggtagtgatcgtagggtcagctcaggaaatggttcatagggtgagctcagtgagaatcacattaggatgagaggaaactcttaagcagaaccacagtggggacattcaagagtggtggagaatgaatgccattcctctgcctgtaagagggcacattatgagaaaggtcaaagaagtaaggaatggaggaagatagggaggtctaatcagggcagagagaacaggaaagggtccacttaaccccttaaaaacagcaactgttgtcacccatctagtgcttacagcacctggtgcattctgggtgctcagcatacaatccctgataatcatcacacttttgccgacaaagtacagccataaattacttcccccaccacctccccagtcagcagggagctgcttgctacaaatgagtgaaaatattcaggtactcttacacctagagatcatggagagaagtagttaggagctgtgtactattgagataggaagctcttccacacaccttgctgtgggcttcctttgcacgctgcactggttacatcagacatgctttgtgctctgcagccttcctatttaaacatttgccctcaaaaacttcacgacaagcatatgaattagcagtttttccaacctaaagagaattatctactgtctctagatgattctcaaaatatgctgatagcaatttgaagcattataaatctatccaggttggttctgaccatgttgtagaagtaatttcaactggcacgtcacatgaaggaacagatttgaaaacagtggtatgcatgcccctgaaggtttcatcttggctaatggtctcaccaccttatggcactactttggattgtgacaacggtaccaaagaaaatgtctatagtctggaaaagatttatcactaagtatgactgtctatcactctggatgtacccccttgttataaatctccagcaagactgatcacttggtatacgtaagcatgtaggtacatgcatgtacaagtcaggagtgtgctgtgtacttgtctagtatcacttggtgtattagtatatatatatatatgtgtgtgtgtgtatttatgtatgtataataactcatagcaaatgtgtggacatagatgagaatataggttattagtttggagaaagacttaccagtttgtggacattgtatatacagaaattctcaagatttctcacatgatgtgtgtgcatgtgggcttgtacatgtgtgtaggtgtgcattccgacagtgtcttccatgagcgatgtagggtattattgacttgaggaagcaatcactgcttacatgaggaggcgtgtcatcttgaccagcatttaatgggaggggaaagcctaactccgtaaaaacgcaactgttaaatcttaactgccttagcctttcattctgagctgagacgttatactaaaatttctaaagcagagacattgttatttttcacgtattatgctaataaaaatagtgactggtgtgacttagtgattggagaaaaggggcttaggactgtaaatattggtagactttcctttcggtacacctttataagttatccatttaatcttaaaggaaattcaaatgccaattcaactgggaaatcaaactctgatgcaggcaactcagggacctgttctctgacccacgcacttgaacagtgttcacagtgagaacagttgagtgcatttagaagctagatccacttcaagaagttagcagtaggaagcatttcttttcctgttggctgggatgtagaggggtgttagaactttttccctctacttttgcaagtatgttttagggaactttataattagcttttgtgcatattttaattatttttgcccatcatcaggtgggattaattttgactgagagcaacagtgtagtggttggtttgtctcatgtaaaaggaaggctgggcctaggctgcagctcagtgatgctactaggaactgaagcacttcctattactgctctacctcttccccatgtagaatgcagtcattacttatgttgcctcacagtcataagttgaacttcagatttcatatcttaaatctggaaagtacaaaaggctctgtcttaggagggtttgtcttttatttatttatttatttatttatttatttatttatttatttatttcaaacagagtctctatcgcccaggctggagtgcagcagtgcaatcacggctcactgcacccttgatcttctgggcttgattgagcctcccacatctgcctccagagtagctgaaactataggcatgcaccaccacacccggctaatttttgtatgctttgtagagacgggtttcgccatgtctctcaggctggtctgaaactcaggctcaagtgatccgccctcctcagcctccaaaagtgccaggattacaagcgtgagccactgcgcctggctgggtttacctttttattcaggtaaggacagtctcttctgggatttgtagcaatcattggccagaactatatcaaatagtcatcccctacatatgaaggaactaaggaaataaattattattattattattgttattattattattattattattatgtttgagatggagtttcactcttgtcacccaggctggagtgcagtggtgcgatcttggctcactgcaacctctgcctcccaggttcaagtgattttcctgcctcagcctcccaagtagctgggattataggcacccaccaccatgcctggctaattttttgtatttttagtagaaatggggtttcaccatgttgggcaggctggtctcgaactcctgacctcaggtgatccgcccgccttggcctcccagagtgctgggattacaggcacgagccaccgcacccagccagaaatcaattatttttaattaaacatatcactgccctgaaaaaaaaatgggattctccttaaaaaggaagaagggagacgtgtacctgtaaaagagcactgctggatgatatattcccctggcctctgaaaatgcacagtggtcaggccaaccggctcatttctattgcatgatatgcacaaatcaccattgaacttcaaaaaaatcctaaaagagcaagtctcaagacaggtaaatccacagccacaattactactaaatgagaacttttagtttggaaacaagcacctagagaatgccaaaaagtcaatgttcctgcagatactagaagggcacagcataggtaaacacactttatcaagtactgtgatactgggatgttgaagcttgcctggtcacatttaaaaaaaaaagtgtcattttaatcagaaaagttttaacataacatacagtcaacttataaaattcattacaccaaaaataatatagatactacatataattagagtcagatattttcacagtgttaatggatgattccaatcctcagtcaacagacagttattgggaacctactatgtgctcacagaccataggggaatatagactatctgaacagataactatgacaacatggcaggtactaaactgggatatgaacgaggtggttttgggaaacaggacaaaacagccaacgctgccaaggattgttgatgaaggagtttaaactctttccttttttttttccttttttcttttttttttttttttgagacagtcttgctctgtgagcgatctcagctcactgcacctccacctcgtgggttcaagcaattcttctgccttagcctcccaagtagctggtatcacaggcacccactaccatgcccagctaatttttgtactttcagtggagttgaggtttcaccatggtggccagactggtcttgaactcctgacctcaagtgatccacctgcctcggcctcccaaagtgctgggattacaggtgtgagccaccatgccccgccaaactctttcctttggtgtttatatcctagaagataaatttggccttcaacaaactatcccttgataaccttaccagaatacctgggagcagaccagggtagaagttcttatatagtcttatgttcttatttttagcttccaggaaattcaagtttgggaaagtaaagaatgcctggattgatactaagagaataagtgaactccaggtctcaaaattttgctaagtaaatccttgtcaaggatcttcgtagagcaaggaatctaagatgatttatgcatctgtagaataacaccataatgaagctgttaacctagccaaaagctttggtggacatgacaccttaaaggtggccattataaagtgagagcctctgacagctttttcatggttttagataagtgggtgtttgaaatcattctggcagctcaccaaatgtttctttgcatcttgactactggatgaatcttgactacaagtacagattttatgtatacttattaaaataatataatttggctgggcgcagtggatcacacttgtaatcccagcactttgggaggctgaggtgggtggatcatggggtcaggagttcaagaccagcctgaacaacatggtgaaaccctatctctactagaaatacaaaaattagctggccatgctggcgtgcgcctgtaatcccagctattcgggaggctgaggcgggagaatcgcttgaacccgggggtcagaggtcgcaggagccgagattgcaccactgcactgcagtctgggcgacagagtgagactccatcccaaaaaattaaaaaataataaataataatataatgtatgtcccagccaccccatgccctgtctggcactactgccagcactggggaactgggaggagagctgaggaacagctccccttgtaggctcctttgtcttcattgattgacatatccaaggagtcctgttcccagcagtggttccaatatgagcaaaagcaaatctttgctcatcttcaaatagccttgtgtatttaagtaaccagaatgttccacatttctgaaatgactatctcacctatctagaatataagttattctaggcaggtggcacctgtgtcttattcctctatcctaaaacagaggagggattcagtaaatgattgctgaaggggtctacattagagccaaaggtggtctgagcaatccagcctgttttagggacctgggtgaaaagtcctggggagtcagaagctctgtgaaaacaagtagagggaaacagaaaagacaacaaaggggtgacaatgtttcctactttccatttgacaaagaacctgggtgtattgtagttaatatccctggggggttatcctgagagatgacatagaagcttgttgtttttggtataaacccgcaatgtcttcttatcttcattcccctttctcattcctccttagagttacctaagcacaatttcttttcttgttttgttttgttttgttttgtttttttgagacagggtctcactttgtcacccaggctggagggcagtggcgtgatctcagtttactgcagcctctacctcctgagctcaagcaatcctcctactcagcctcaagtagctgggactacaggtatataccaccatgcccagctaatttttgtgttttttgtagagacgggatttcaccatgttgcccaggctggtcttgaactcctaggctcaagcaatatgcccgcctcggcctcccaaagcgctgggattacaggcatgagccaccatgcctggcctctctttaaacactttttgcttacacactgcttttggaatgaaaagaacaaggagacttcagtcatatcctcctggatttgaatgctaaggagctgcgtaacatttctgaaatcttcccatgtttattaataagagaataattctacctaccttgtagggttaaaggttgagtacgatagcatggaagaatttgcccagcacctagtaggctgtcagcgcctgttacctttcctttccccaatgctccctaaagctaagttcattggcccatcatgtagagtaatgggtccacaggcggtgaattacttgtgatgctcttccaaggactgaatgaggagagacattttaatcaaagcaccagcaaagcttttgtagcgatgaacatacaattagtgaccttctcctatcagggataatcagcagtgggactggcagaattggaatttttttacatgggtgatctgggcacagatactcagtcagctctgtgtcgcttagaactgggaggcaggaggcatttgcaggttggtcacaaactgggtatcagacatattaagcctgcattcatctgacaggcctccagaacgtgatgtcaggagagacgtttagcagtggggagacaattatgagactctcagaggtgagaaagaggattctgctcactgcctagaaagagagaatatggcattggaaagggggtggtaaaatatgttgcctgacacacaccgaaaaggcctgtcagttactgaggtcccatcgccgtctcaggcttagactgcatgagaggatctatttaggggaaaaaatgtatagcttagccccagtggctgctggggtgaatctccagggctcaaagcacgagttacagtttgtctttagtttacttaataagcttcctggactgtctgatttctttacagcctggaacagagggtaacaagtctcccagtgcagtggatccaaagttggtgggcttcagtttgggagcaaagagctcactgtttgggactgggttgatgtcatcattttatgacagcatattaacacagagtaaatagtttattccccagggtactcacccattccctcagaggtgagtgtcaactccttcgagagaggtctgctcacctaacctgccaattctcaaagagccccacctcaggcattctcatagcctttctctggccttcgtaggtctttgtcccattccccgatgataatgccttcatgacaaagatgaaatgaaggttgggggcagcctaggctgtagtcctggtgctgcaccactagccgtagagccttggccaagtcatgcccctctctgattttttcattatgtcaactggaaaatatagtcagactgcctgccctgcttgcctaacagcacagtctgaagcatgagctgatggaatacatgtgtaagcatattgcatagtttgaggaagtattcatgtatacagtggtgatattagacttaagattttcattttttcatgaaattgaaactagaccatctgaagtcattgaaataggaaaaacacatacagtattttaaattagttctactcatgcagacaaaaaaaaagtgtcctggtacatcgttgtttaagatctggtgatctgtagtgtttgtctaccaagtggctaccgtaagtggcctccacttgataagttgtaacaagatcacagcaaccccaacatctctgccactttctctttctctcttctgttttgggtggagagacatctatattgtggctgtctcagagttacggggagagcaagtcaacggtaacagggaaaaacaagccttgtgtgggttggaccagaccatttgtaaggctcttggggcatttgtgtgcacgcacacacagacgttaaccagtccagaaatgagtgtcattctcctcacacagcgccgacagctgagttcttccctgatatttgcagacctctctgaagcttgactttgaaatcctcttttccttgaaccctacgtgtgagagagaagcccttctttgccactcaagagtggttctgtggtaacagtggctctgtggatcttttgtccctggctggctccttcatatgttattgtaaggttttagtttgtgctggcatgcaggtgtgtttttttctcactcagattttctcttagatgctgtaatacaatctataatttttggtacaggagcaagtttttacaaaggaagatatgtgcaatttgtcattttccagcctgatgacatataattaaaccttcaatagtctatgccttcaatagcataactacaacaacccatcacactttggaaataaatttgtttcatattttatattatctggactctctttgtccagtgtgtaacaggcccccaggaaacaggaagtcccccactagtgagcacccctaatgtgaatgactgcacactcagcctattttggtgagaacaggcagcttgctttcggtgggctcttttgaatgggccttgcccaagctcaatgctctctctctcctcttggcttgtggcacctggccacagtagcaggcattgcctgcttgaaaagaggctgtccttggattttcctgcctcttggaacacagagcttaattcagttccctaactccgggaagaagcaatgatcttcagccctatgaacctgtccggcaacccacagcggcccacaaaatatgttctctcgcctacaacctcatcccagctgctaccacagccctgccgacgcagcgcctgctgcggtcacggtccactcccaagggacactgccttatgtcagcaggccctgtcttgattcccaggtgctgggaagacatgattgcagcctcctgcacccctgctcccctcctctgacacacacactctgagcctgcaaggtacagcagcccactaaagctctagttaaaagtaccaagttgctggaatgcccagggaagtgagaatgagcgggtctcacacagggatgatttgaaacaagccttgtggctttttaataatgtgccaaagcggtctcagtggtgggccagcagggcccccagtctatcttctgtgaaaggagaaagcccagcaggccctgccgaatgcagacagcccctccactctgctggaggagacagactccgagatggcaatcaaggcttgatttgccaacacatttccaatgattaaaatgtaattagcacaactgagtgcctcctccccagctaattttaatacatgctgtgacaggcaggcagccggctgtgcctttagcccagcagcagatggaggcagaggcagcgggagaggaaaaccattttgcaatgtgactattcgcatcacaaaaccatcagggcgctcagctcttagaaggcccttgatggcagcacatcaaattggcgctgtcatagctgaccgtggcaatggcagtcatccttcatactgtcccagaagcacagcgaggcaatttccaggcgtaaccctttaagatctagaaggggagagagagacttggagagcacacttgtcgtcttgcagtgacaggcgagagctttgcaatgtgcgctgtgaaacccacgctcttggcagcttgcaaaccgttacttacatgttccttttccaaggcacagtggagtgtggttcagaagctttggaaatagctgtttctccaaatgggagacaggcgtgagctgccttctgtgtgcattatctgaactgggaaggatgagcttttcagcctgagatggtatggcaggttggaggtttcctcttctattccattcatcccatagaagcctttgagcctggggcctctcatcatgaccatctgcttttctcctatcctgaagggcatgtcagacaagctgcaaagtccagaagaccgtttgcctatgctcctgttctctcacctcctggcagaaacactgggccctcaccactgttgtttggcctgccctctccttccaaggcaccacctgaaaaggaggcaagctccttggaggctaaggatcatttggacctccctgggattggggtgcacaggataatcacagggggcacttgtgatctttgggatctgtcacccaggcttggtggctaactttctgtgtgtgtgtgtgtgtgtgtgtgtgtgtgtgtgtgtctgtgtgtgtagacggggtcttaccatgttgccccagctgatcttgaactccagggcttaagggatcctcccacctcggcctctcaaagtgctgggattacaggcatgagccactatgcatggcctggtggctgactgtcatagaacaccaaagctagacaagcctaaataataacagtgacgatgctaagcatgtattgggcatttaccatggctgagaactatgttaaatctcttaaatgcattaattttctcacttcatacccacacaaacctaggggctccatattattattcccattttacggatgaggaagcaaagtcacagtaaggtgcagccactttcccagcttctgctgttaagtggcagaacccaaatccaaatacgtatctttctaacttgtgagtgggacaaaaaagtcatagctgagacatgctgcaccacagagatgcttcaccagtggaagcctctgagcagagaaatccgatctgaaaacaatgggattattctttgccatctaatggcctctgaagatcagcagccatgggaacctccagaactccatcacacgggtgacgtttacatgccgttgtgcatgtgtatctttttctcctctaaccgaaaaataatatgtaatcgttaaagatcaaaaacgacagtaaatgtaaagatgaaaataaaagtgacccaaactctttatcactcagaaataaacagtgtttggtgcatttttttccagtgttttttttttctttctgtgtgtatgcttagcaattttaaagtaatattgtatatataactctatgtatcttgtttccttcattgtagtagtaataataaaagtagcagtttttaatgtattttctccttactgctaccttgagaggtagttactatcacccccgttttattgattaaaaaaagaaattgaacctgtgggagggtatgtgactcacccaaggtcacttcagttaggttggtgaaaagtaattccagtttttgccattacttttgcaccaacctaatatgattttttttaaacttccctatgactgtgatcacttttccatttcagcaaaattctttatgaactttaatttaatgagtgaacacaaccctggcaccttgacctgttccccaatttggtaacatttaggtttatgaagtctgtgtactaggttagtgcagagagttagaaacaccaggattcaaatgcctggatcttcctcttatagatttatgactcttgacaagttgcttcatgtctttaagactccttctttcactgtaaaattggaaaactaaaacctacacactgggggctggggggtggggggagtttgctgtaaggttaaaaacgtgaatatatgaagagtctatcttagcagatttcgtggcccttgctatgtgctgacagtagccatataaataatgtattattgggtcatttcctaattccataatgaaatttttaaacaaattattatagacatttttgttcctttttgagactagttgagctagacagtatggaaaatatgaaggctcttgatgcatgcttctcttcttctgatgcaaattgcaaaattattttccaaatagaaattgacattcctccagaagtatatgagtgtctgcctcacgacagccttgccaacactgcatatcagcatttacatgtttttttctaatttgattgatgaagagaaatatatctctttttaatctgcatttctttgattactagtgaggtggaacatttttttcgtatgtttattagccatttatatttcctcttccgtgaattgacctctttgcttttgaaaggaaggatgagtctccaagggctagctagagaaaagatgctccagtgataattatctcagagccctggggtgaggagttgcaggggagagaattaaaggtctcctggggctatgaggcggctactaagtgagcggctttctacaccagagcgaggctttctacacagtcagcttgaaatcagtatttgttctctacctttgtatttgttctgttaagaaatattttggattttttagtgggactcttcacattctactcaagccagcgcttataattctttcagggcagacaacgagcatgcctgttcagtttgggttttttgctctgaaagtcccattggtttacagtgaagttgctgtaggtcttgcttgagtcttttatgatccctgccatccagccaggagctgtgactgctctgtaaccttcttagatttaaatctgttgcttgtgttctcctcatagtgttacagagcagcagaggccatccatactgatgtcttaatatcattctctccttagatttatagggtaaaataaaccctctgccatagaagtgcttattgattactgaagtacataataaagcctaagaataaagtaagaccaagtaatcggttctgttcctgggggatgacaataaactctggccgaggcagcctctgaaggttgccttttgccttggagctaggaggctcctttttaattggttgtcaaaatagtaagcagtgactgatagaaatcagacaaaaagagtacatactgtatggttccatttatgtaaaatttttaaaaatacctactaatctgtagtgacagaaggcacatcagtgatacggtaagggacctgagagagggatagaagctttggggagggatggacaggttcactgtcttgatcgtggtgatggcttcacaggtgtgtacacatatatgaaaagctatcaaattgtgcatttcaaatacgtgccttttaccaatgtcagttatatctcaataaagccacaaaaaaatagtgaacagtatcccataaagagacaatccatggctcactctgtgctagaaaaattttctcttttcttagaaagctatattttgacaaacattcagggggaattgtgagactacatttcaccttcacctttagctaaataggggttttagaagactgaaagatgccaccggaaattaaaaaagaaaaaggcataagaaggtaggatagccctctttcttcattcctttttctttcctacatctgaaccttaaaggtgccttttaacataattttttagtaaaacaaaaaaaggtatttagaaaatattaattcttttctctcatcccccccaacccttctgctattacatttcccccacccagaaaagagattctacagtgcagagtaaaaactactccaaaatgttggcagtctaaaagtggacaggcattttcaacacaaagagatgtttgttttccttgcattttaactcttaatttttgacacagtagggaactccagcatggctgccatttaaaatgtaacaatgccatgcagctctgattgcctctgtcacaggggtgttgtgactgaaggccaggagacaaagcaaatgaggccagagacagtgcctgctgctgaagtgctggtccatttctccacccgcatttgaatttgtcttttctctggctaactgcttttctgccctgatgaggagtcactcggggagactgaagctggaatttgtacaacctctttcagtccccttgattttaatcagaaatacacaattattcttttcctccaaatagagaaactcaatccccattttaaattcaattattgtaattgcagcattcagaaaaatagcacattcattttctaataagagattgtggataccaaattactgcatatagtatgtcaaaacaggaaacttgagactggcaaaccagtgggtgtttttatcttggcaatttgtattttcttgcagacaatttatagtaatcctacccttccttgtttatgatatagaagactaggttttaaagccatcctaaaataaagactgtttttgttgggtacagtttaattgaaaatctgttatgagtatgaggaattctacaaagggcaaaagtgaaggcagatacccaataaagggaagaaaaaaaaggaatcactttaggatcctatgtgacggtagcctaagatgtctttggatcttcttgaaccattctcattatctcaagccatatttatattcctttagccaagtttctcactatcttgcatttgtaaaaaaacaaaaaaagaaatctggttggtgagaagttgataatgtggccattatgtcttagcaatatgagagcaccattgtccctcttcctgctcaattccagttgctctagttggcttgaagtgaatcaaatgtgaaaagaaatacagtttttttattttgagtttcctgattttcataaaagagtaaccttaagatgtgatttcttcaagtgcatgctgttattttcttaggatttactgtcacctcaaaattatatccatgtcagccaggcatagtggctcatgcctgtaatcccagcactttgggaggctgaggtgggtggatcacctgaggtcaggcgtttgagaccagcctggccaacctggtgaaaccctgtctgtactaaaaacacaaaacattagccaggcatggtggcgcatacctatagtcccacttatgggaagctgaggcaggtgaatcgcttgaacccaggaggcggaagttgcagtgagccaagatcgcgccactgtgctccagcctgggcaacagagtgagactctgtctcaagaaaaaaaaaattatacccatctttttcatagacacattcagacacctaccacactttcagatcttttagtgttcatgccgccaaccactgtctctctcttgatctcttcactcagacactctccatgctaccttccctcaggtattttgctactgtaatttattaattctttcacatatatgtattgagcaccttctaggtaccagcttcaagtggagcaagatatgagcaaactctgagatactgtcaaggaaactagccaacagtgttggaggtgctagaaaccaacagttaaggtacagccagtgaagtcagagccctggaaagcttccatatggaagaaggaacagtcatttccatgtgtcctgaaagggtggtggtctgttggatccttgagtgcctactaagtgccaggtactttagttatattctctcagcaaatccccatttttgcagttacctctgggaatttttatctctgtcaagattactctcctggttgattttggtaaatcagtccttaaatcaatcttgaatataaataatctgtgagtagggctatcaaaactatctcctaattctgactggtcagaatcgctagacaaagtttaaaatatgtagcttcctacttgtaccagtaatcacctagtgtttttaatatccattctatttatctgtgtatttatttttccaacttaactttgaacattttaataatgtcaaagcccatatgcactatgcatagcataacttacaaatttaaactccaaatcttgtacctatgcattttactttagtccctgtgtgcaggttactgactatttgaagaataagtccaagctacttccatcccaaaaaaaaatgttcatcaagaacctaaagaaacacttcaaaatttcagctctaaggtgtctttcctttttggttttttatcagtgaaataaaactattagttacctggaagattcttcttgttgctcacttcgttgagagggaatgatggtttctggttttgtttgtctgggtggttgtttctgttttcgtgtagcatagtattgagtctttaaacacgtcctgagcagaaatccttgcagaatgtgacttcccctctggcaataaaacggtacaaaaattcaacccaacatttaaataattagtaagttaccctgttgttgtgtgtgatataacatatctttcatggaaataactggaaaaatgaaactattggtatgtctttctggctgctttcacatacctgaactgatttaattctcacaaaaatccggtggggtgtgtatcatcgccattcactggttaagaaaggtagactccaagaattaagttcctttccaaacacagcatgattattaagtggagggggtcagaatttgaacctacgtcagcctcagactgaatgagcacttcctgtgagccagggactgtgctcagtccctcttaagggagagctgtcttctgtggagcagaaatacggctatatggctgcattcactgctgcttgtaggcgctgcaatctcttttcggtttcagcttgcctctgtactttgccaagcaatcaatcaggaaaatattttgaagtagtttctttgtatagcctgagagagagagtgagatggtacgttatactggctaagaacatgaactttgaaggacataactgggttcaagtgccatctctgtcactggaagccttacttaccttctcatctctaaaatggaagggtggtagtataatactttcttctagagctgttgtcaggattcttggtgttttttgtttgtttgtttgtttctttgtttgtttgttttggacagggtctctctctgtcacccaggctagagcacaatgacatgatcagagctaactgcagccttgaccttccgggctcaagcaatcctctcacatcagcctcccaggtagctgggaccacaggcatgcatgaccatacctgctaattttaaaattttttgcagggacaggggtctcgctatgttgcccaggctggtcttgaacttctgggctcaagagatcatcccgcctcagtcttccaaagttctgggattaaaggcatgaggcattgcacctggcctcaggattcttttttgatgaatgccagccaacagctggcatttctagaggaaaacatgctctgccgttgttcctgtggaggaaccctgcaagatgtgaaatgcacttcaacaaccaggcttttccaaaatagagagctcagggctgccctgccatcatggacaccccatctctcctttagcttgagatggacattgaccctttggctgggaattgaatcatgttggtgatacttagcatggaaagccgtagctacattcagtgtctcacaaccttagtggtggaaggaagaatggttgcagcagcttcattacctggggaaaaagaacttggaattccaagcactttaagaaagatgcttttactttgagtgttggagaaaatagagcaattacctattgaagacaaagtggatgaaaaaacacctctgttcatgctaccctgatcatgtaatctattcatattcattctgccttcctgaaggtgattcaagccagactggctgttcctgctggctgtgcctttccttccccaggatacacagggcacatggtgatcacctgagattcccagctaaactcagacattttctactccaagaggagattcctcaaagggctatagcacacaggcagcatcagataatgtggaatgagtggaaggagggagggaggaggaatccataaatcatcaaattgttgttgagcatctttgagggtcctcaagaatacactagaccctgtgatgattccagggacaaccagcctgcactttctgaggagttcactgcctgcctggggagcaagacttgtatatgttaaattagcaaagaatttatgcaagacgtatgtgaaatcagtgaagaattctattctatctagactagagccagggagatttccaacacctggctcatgtatgctttttaaaaaaagatattcagtcttactgaagatgaatagatggatggatggatggtttctaacatctattgattgcttcctatgtatcaggcagtgttctagacatttttatgtttattacatatgtacttatacaaattatatgtttattaactcaattaacgttcttagcaacactatgaggtacatactgtcaatagccccatttaatagatgaggaaactgaagcacagagaggttaagttccttgctagaggtttcacagatggtgtacagtacaggcaggctttgcacccaggcagtctggctccatagttatatatgaaggataacgatgtggtcttttcaagagctgttggcatcttggttcacactgaaagctaccaggctttgttatctgttcctctggctttggcttcctgagtcttaagcacccttctcttttctagaacatagaccagcttgaaccaaccctctgtgattccaccccgcctctcccctggctgcaccaggcctctcatttgtagtttctcttactgagcacatttctaaacgaggacggttgctccactttaaggacatacaaatggcttgccctcacctgtcaagcatgatccttgtattttaccaggcccattatgaacgcaatctttctgttgaaaatttgcatacctcctttcttgaaaagtaatgacagcaatttctttccctccgctcactttctgagtgtctcatttaacggcacctgtgaaaccgacaggcacagagatgagaagtgaaagagagcagttgattaaatcatcatcaagtcgggcctcagaaagtcaattctgcttgccgtctgcaatgatatccttttatcttaaagtaatgagctatggcacttttgcatcgggtaatgcgataagttctattagcatgttccatttgcctcacaagcaagggcaagtcattttagctagctcatatcactgcaatcaaagcaattggcttcccaggcagagaagaaagggaaaaggctcagggtgatttctatggatcacaacacagcggaaaaaatagactcttgtattattttaacccataacatacttttcctttttactcatcagcaaatttgggttttattagcttacacaggactccaaaaagaacccagcatcagttgaagcaaacctgggggtgggggctcagaccccacccaaagcaccaagaaactatatatgggaagggaaaatcgccccattacagaggggtcacaaatagaattctgccaaagcacacaggcaaagatgtcttcctgatagtaacactgtggtctcataataaactcttgcttcacaccatcttcaaagtcatttgtaataggtccccaggcaagtacggattaatgctattgatgacttagaatcagtaaatcaatgacagagaagcaaaggatctgttccttaagcttaaaagagatcatttacaaatcaccgggccccagactgtcagttttacctttggacaagatacttatttttctgagtttggcaaccactgaggtttgtggactctgggttttaagtaaatttcatctttggggtttatgtatatttatacttggcaaaatgtgacttcctttcttagaggaaaacaagctgaactccccaaagatttgtgaaatattcacttccaaccccacttccaataactcaacaatactttaatgatctgtggaaatttacaacatacagattgttttatgaaatacacttggatttcaaagtgacaaaaaggaaaaaaaatattagaatttaatttatgagctttaaaacttcaagtttggacaacctgatttctgtcaatatatttgcacttctaatgggtggtagaatgaacctagcacatagtagttacctgaacattgttggttgaatgagtgtgttattatctgagacactggagggggaataagaagtgttcccttagccccctcagatcacattggttatttgagctctggccagttcaaactgagaacttgcaaaaatgtcagattctgagaactccccattcagaaatgctaggttatcagtaccgaattccagaggcttctgagagttgattctcttgtatctcctgaacaattgaagattggtggacctcatattattttcaaatgggctcattagtgattaccaaaagctttattcttgtaaactgttgtttggaacatgaatattttaattaggctttcattttatctgagctattttatttgatcaggcgtagttactgttaagatagaggggaagagtcgacgacattatttcacagtcagtaagaatatggtctcagtaagaacattttcaggtttaaaaatttaaaaatttctagggccccagtagctttaaatttcacttagtccaaaaccaatatgagagcaatgtaaacagtgtgaaattagggctttgtggattgatgaaaaacagacaacatcagagctgccatatgtggcacaaaatggcggcccatttttacatgagcaaaggattgggcagctgggcaggggatggtgaacgtgtttttagtcaccatgctgctatcttacttctttaaataagaaaataagtgtcatgttttctgcaggtggcttcttctgaaattgcttttaggtgagggatgtctttaaggtcttagataaaccgcctgccccaaaggagaatcgatttgttttgtcactggcaaagttaaattatacttgatgttagatattgtagtttacaagttggggttctccctcattttcctctcatttcctttaggcagaaacaagaataaaataactttgttcagcagtggtattcagccctgacatctttggtggcaatgataaatggatttgagatacgaaataactgttccagcaaggtccattgagcagaatagagagcaatgccctcctcaatgtcattgtatgtgatatattcaatgattgccactctgtgcttaagaatgcattccatcacaaggtacctagaattccatcttgttgctacattctgaatgaaacagagagatgtcacagaccttgactgatttcaatttggaccagagtcttaaaacacagataccgagattcccaaatgaaaatgaaaaatatttgcttttgaataaatataataaagtcataatcacatcttttttctgagccttttaatggaagatattttcttctgggccccaactctaggctctgctaacgattttaacctccctcagtatgttcacacatacatctctttgcgttaagcagtcatattagtgtttcttgtactttctctttggaatcacctgccttttaaatcatactttgcttatgctgcatggaatcaaccacagtttgaacaatactcaagaagaatgagattgacttgtcagtataattgagcatctattgtgtcccaaggcctagagatacaaagataagcaaggcactgtccttacctacatggagctcattctctggttggaaagactgttgtggcaaacaacggcagtacagttttgtaagggatggagatagaagcaattaagtctttctggaaaagtattggaagattcaaaaaaggaactgtgttttgaaggtgaatgtcaggcttttaggtagaaacttggaggaatagaattcccagtagagggaattgttaagtgcagatggctggtggcatgactgagcgtgagtgggcgtggttgaagcaaggtatgttaggatagtgccacacaatgcgaggatgccaaccagggccggaccacaagctgtttgcaaccaacctgctgtgagattagtatggggagtcaagagtaagcattgggaaacttttagagtaactcagtagcataattttgtgtttcataaatctaataattttttaaatgtattatatatatttgtttttctttttcatttttcaagaatttgactttttattatattttacaaaagtaattgtcgtaacatattagaaattaaagaaagcaaaacaaaaacaaatggctcttcaccacagaaagcttaagaagcattgtgttgagagagtggttgggatttgggagttgagggggattagaaacagaatgtgaagggtcttcataggccttgtgaagcatctgcatcaaatagaaatttaggaaatccactcttgtcaataaggacttggattagaaaaggaagagagcatagaccttggaaagcagtcattatcctcttgtaatgacaaaataaaaccctgaactaacgcagtagccatggccacagggatggagagttagaaagcagaatcaataacgtggggtgagagaggaagataagtccgctcaaggatggggtcaaggataaggctcttcacttacgcagttgagtgattgcttggtgatgctattaccaagggcaacgtgggagaggggcagtttcaggtgagcaaagatgttgagtccagatttagatggatacttgagtctgagtgttcgctgcacttcaacagggggcacatacccaacggaagcttaataatacttaacatttatcatctgtacatacttggtaccatgcactaagttgtttacatgtattaactcattctcctcttctagccatattttacagagaaatatactaaggcccagagagtttaaataacttttccaaagttacacagctggcaaatgtgggcatagagatttttgagtttcagcatatacatggtagaaaggaccaagggaatctttaaggtctcccttgaaagtcacatagaaacaatagaactccagatgcaactctggggagacagtgacattaaagaatatgcagaaaaggaagggccttgaaaagacagtcgcagacagcaatattggtgaatgggtgcaaagggaaaaattctaaaggatgtgcaattgaaacaatctaaataaccagcactggggaattttttaattagattatgttacaatccacatagcagattgcagtgtcgcctttttttttttttttttttttttttgagacggagtctcgctctgtcgcccaggctggagtgcagtggcgggatctcggctcactgcaagctccgcctcccgggttcgcgccattctcctgcctcagcctcccaagtagctgggactacaggcgcccgccagcacgcccagctaattttttttgtatttttagtagagacggggtttcaccgttttagccgggatggtctcgatctcctgacctcgtgatccgcccgcctcggcctcccaaagtgctggtattacaggcgtgagccaccgcgcccggccgtgtcgccattttttaaagtgatgttacaggataaattttactgattaaactgaaatatttgacgtgttatgtgaaaatcaaagcaggttccaaaatggtaggaattcatttttatttcttaaaatgtatgtttaaaagacgagtgggattatatccttaagactggaaagacttacaaaaatgtattaacagtgtttacctaaggattgtagatttatgggtaatttttaaaatgtatccagtaaatatgttttttttgtttgtttgtttgtttttgagacgaagtctcgctctgttgcccagggtggagtgatctcagctcactacaacctccgtctccctggctcaagcgattctcctgactcagcctcctgagtatctgggattacaggcgcgtgccaccacgcccggctaatttttgcatttttagtagagatggcgtttcaccatgttggtcaggctggtctcaaactcctgacctcatgatccacccgccttcagcctcccaaagtgctgggattacaggcgtgagccccgtcacccggccgtaaatttgtattttcaaaaggagaaagattgggtgggttggtttgttgtttaaggggtaagacttgtctgggaaaggaagactgtgcctccagcagttcacttttaattcatgaaaccaggggaagagacggtgaagatggaagttgagtggtttcagtattgagatggctggaaggactcaggtttaggaactagtccctttctaactgtgcatttgaggcctttggccaggcgtgcacacgtcctctttctctccttttgtgtgtgatggtttgggtcatgtctttgtctgaaggccgggtgaccatgaattcttatctgtgattgctgtaaggcctagttgtttctttttgtctcttttcatttcttgcttttaaaatggaggatatatttttagcttttcacagcgggctctgaaatcttgtcatggagagtacttcgtcacctcaagctggtagttagtgtgcaacctgtttgctaataaaccaaagcaggaccccgatgtcaaaatgcttaaaatggtcaaatccgctgggacgccgtctctgcatctgacatgccttttccatttcccagcctcatgcagaacataaacctgcatcaggaggtggctcaatgtgaactcttataaattggagtgggtatctagggattgaggagcagacacttcttcttttaacctttgaagaccaagaatcacttggccaaaaaaatccacagtgtattgaacttagggtgtgaaagctatacagtgtattaaatgtgaatttgagaccatgaattctacccacactgactctataaaacagcctccctttttcataaagcaggcccataaaccgctgccagtgaagcagaaagactccttaggactgtggctcgctttccgtctggggttgtcaacaaaccccctttatgagtggaatagacctcttgtatgtgtcgagcttctggctttttacagagtgtgttaggagccaggcaaggcaaacgttaggcgctgtttgctgagtgcatttattggctttgcataatttatgagctggaggggttgaccatcattcgtctctgccaggggctggcactcgaggctccagagagtggagctgtaaattggatggtgcgctcctgctgagctcacggcaaagtcctcaggtcagtatgggaatttaataccagaaatggaactgttttctcagcacaccatgtggaccccagtgcagcagagactgttttggcagactccacgactggccttgtcgaggagctgtcactcacccggcatgttgtgtggggagcctgagcatttttaatcggcttggcatccgtgctgcttccataatggataccagtaggtctcagttcttcaccatatgcttaactctggagacaaggtgcttctgggtatatcagtaattacttgatgcagaattaagtggaccttgaaattagaactggactgttggaaagcaggaagcttaacactttgatagaaataaccattcccagggacatactgccgttaggatagggggcacagtggtggttctttcccagctaccccactcctcgtcctccctgcacaccagatccttggggaggtgggcaaatgcgatgccacagccttcagctgtcattgattacctcacaaggagcgctgtgaacatctgggaacatgagcctgcctggcaaaatagtcttctgccttccacacccctcttgaattgagcgttgtcactcttgaaaatgtgcccagatcttaggaacctcacagagggcttaattaaaggcaatggagagatcacacaatcaggacagtattgttcctcatccacctgcggttctaggccttcaaagtcttcatctcatccaatttctttctcaactcatttgacttattacaataaagaaaccactcatcaggtcaaagaatgtaaatgtagacaatctgaggttggaagctgggttggaaatgatgcaccgtacttggttaaatcgctgtcactgaatatctgactaccctgtggcactgaggagccaatgggagaagtagaaaatgttctaatcctccagtctataagactgtgatataagttcctaaatgcttttactacggagtgcttagtctgaaaagaataagtagtccccaggttgtctcataatagcaagaagtccatttagatgggtgttctgttacttcccattaaaagctctctaataggagcttaaacaataaggtaacttagtgttttctgaataaaagtcctgaggcaggctgccctgagatgggttcagtggtccaattctgtcaggcattttttcccttggtcccactctgttgtttttgtactgagtctttttgcctcatttttgcaagatggctgctacgtatctggacatcacgttcttatacactcatgttcaaaggccaaaggcaggtggttccttcttttctttgtttactggggagacaaaattgtttctagagccctcagcagatttcagaatctcattggccaaagatgggccttcaaataagcgattacaatgcccagaggtttacctcttttcccatctttagcctcaagaaaaattgagaaagaaaatacctggcatttttaacctcaaagtgtcaggagaaggtacagactagggagaagggagttgtgaatggctgtggggatctagccagcagtggctgccctacaagcaaatttatttcctgtttctgttcaaagctataccaactcccatgtccaggtggccacactaaaaaaccttggcatcatcctagacacatccctgttacttgcttcccatatccatgtgttatcaaatcctgttggttctaccttcagaattgctgtgccatctgcttctgccttcctaaaccatggcaccaccttgggttagacagtggaatggctgccaaaccactctccctgtgacctgatttttccccactgtgcactctctccacgttcccacagaaagtcatcctcatggaagcagctctgatcatgccacacccctgctagtgtttgtatcccagcttcatgtcttactgctaaacggaaggctcctttagagccaggcctgtatctcaggtgaatttcagtctagtttagcagttccttatcaagggctgttgactgaatgaatagatatatttacctgctgagctttactctaacaaaacacatcccccagtttttcattgaatattgaattaacaaaacacttcattttttttaagttgtgttcttttttcccttgcttatcatgaggatcccaaagactggggttaattattaattatcactctctgcttatcccaaaccaaactcagtggttggaatttgggatctgtttgatatggtctgagtctatggccctaaagcatacttttttgcccatattttttatttactaccctgacctcttgtctttggcatactttttatagggaatgttccttctattctctgggcctctaaaccggaaaaggcagccatcacaagtggtgagccttggccattatgttctgtttccttcaaagttcaaatgagtgactacaacgcccagaggtttacctcttttcctgtagaaaagcaccggtagagatacagccattcacattagctgaagatagaatgtcttcgttaagaaattgattttgctctgaatttcattgaacaatcttgattcaccttaatcctgtggctgactcctagaggggcatcgcctctaccctgccatggtgggagggaagcgctcacttgtgtgattgagcaccttgctggactgacctgaggaagagccacagagtacaggcatcagatgaaatcaacaaaataacttttttgcatctggatagcattttgtttcagatgctgtttactagcacttgaactggagaaactctttctttccaggaagacagcattttttatttcctttacttatcttgcactttttttgtatgggggttgggggaggaggcatcaaaagcaaaaacatactcagttcttgcactaacccttattctcttgtcttcattttcagtgtgacagtgacagtgaccaggaagagaaggtaagaccccccctcccccattgtgggcacagcacataacacactgaacaccagagtcctcccacacacagctgcagggtaggatgccagcttcatgttgacaggaccttttctctttaggaaagatgggcattattcacacagtgacatttcctatgctatgacacgtttaatttgtcagatctacctttttttcatttaaacaagacctttaatattgcatatatgtgacactgagtttttactttatggaagatgactcatagactcaaaaacattttaaaagacaaaattatttattttaataaccatctgatttttaaaaatccatgatgagaacgttaaacttgctagtttgtgtttataatgtcatttctgcatttattttactgacccatatgcttttctgtacctattggccttcttgatagaaatgttaatggtctgtgtctaggaatctcatcatggggtacgggtgggcaagggaggtcagatgggaactgccctcttcccatccgggcggaccgccaggtaggaggacagttcttccagcaggtacatgctctgtttcgaggctcatgggcaccagcctctgtgtatccagatcaacatggatcaagaaaaggaactcagtttctgaggttccagaagattggatcacaactcggtaaagtgagctttctgctgcctgaagcaaagggattatttgtctgtttggtctttctttctagccgttccaatccccaaccaaagttccttccatttttactgctgctttatgttattttgaaaagagttacctgaatatcacggtttctgtattgcttggtatcaaaaggatggactcggcctcccttcccccgtttctggatctgtcctgtgccctgtgctttgactttcacctcctacatgcttgcggattttattcagaatgctgcagttagtatttagtgggatctttccaacaaacccagaatttttctctccttctctgctgccagcctccaagagagatctaaaggctcttgttctgtactgtcgttaatttgaattcagcatatgtagcctgttataaaatgcgagacatcatcatttgagcaggtcaagcatattcagatgaagacaaatggtgcttatttgatttccttaaaatcaggaaatgaaaaaaatgctctctggagaaatcatgttctgcctgacttggatgatagaccaatgcatgtcccccagataagaacaggctctcgccttgaggtttttatctctgaaggacggccaggactgtcagcttgctgacatgtgcattatccatgtcattttaaacaaagtgacctatggaagggtacgctgtgctgtgacatggtaatgggctgttggatgacagtgaaagtacacactggaaagggggctgtggattattcttttgtttaactgacaagtaggagctgcctttctccagcccccaggagccttagctccttggaagtaggactcctggtgtctcaggcagccagtgtgtagtgggtgccagggacatgtgcacagcagtaatggttagtgttcaagacacggtcattggcccccaaacccccgaggccacattcccacatggtgggcatcactggtacccagggagggactggtaccttctggccattccagatctatcagcaatggttgatctcactttctaagtctgtgccacttttccaaaaggataaatcttattcagggtcgtacaaccaagctgacattctttccttaaaaggaaatgtggggccaggcgcagtggctcacgcttgtgatcccagcactttgggaggccgaggtgggtggatcacgaggtcaggagattgagaccatcctggctaacactgtgaaaccccgtctcaactaaaaatacaaaaaattagctgggcattgtggcgggcgcctgtagttccagctactcgggaggctgaggcaggagaatagcttgaacctgggaggcggaggttgcagtgagcagagatcgcaccactgtactccagcctgggtgacagagtgagattccatcaaaaaaaaaaaaaaaaaaaaggaaatgtgaattccaaaaccatcaccagtcttcagcagtggtagaaggtggtaaggatgcccggttttgtgttccttgtaaatgtcttcaccagtggcctcaaccttgacacccaaatcacctagggagctgctacaagttccagtgcctgggcctcatcccaggtcaatgaccttggagcctttggggctgtcttgaaccatgggtcttgatgatcacctaactctggtaatttctaggagtaatctgcctctggttgtcagagggatctgggggccaatactgagagcaccccaccaggtcctttcccatcacctgaattcctgagtagttattgcctgggtttccatctctaagtgcaagaagtaaagtgtcggaataatgggtattgggaaggtagctcccacctaccactctgagcttgagtagatttcagggtaataaagcggatacatagttgtttataggcgagtccaagagtggcaatggcaagaagggaaggggtattaggagtgttcctcagattcatggcgcacctcctgccctgcacccccagccattcttcctttctactgtggtgatcctgcaggtcttaagtgggagccacaccataaccagtgttgacatcatctgcctctgttctgccccatgccatttctccagggggctcccaacaggagccattgagactctaattgccctcgcacctgcttggccctgttgcagttaagactgttaggcttccccttttggactgagattgtctggtgtttatcgccaactttaacaccatcctccaagacttctgctctgtcggagcctgggtccctgtcagcctcctctgtgaagaaacctcttgcctgtgcccccctcgaagccccagagctaaccagggctgctttcatgtgttgcttggaggattcgcattcgaatctgaattgctaatggtggaaaagatgccactcagtgtcctgggataccttcagcaagccccaccagggatgctgttggaggcaaaagtgaaacttgtcagggacccactgggatttctctctggaagacctgccattctcttactccatagggatctgcagaaccggcaggctaaaattagggtactgtgtttcacacagctgactgaattaagataaactctgctttcctctgatatgaagctgtaatttataaaatgatacccttactaattaacgtggaagtgactccgaaaggggctaaaaaagcagagctttccctaaatgcaggagacacacttgtgcacaaaaaggctttgatgagacactgagcaaagtatctcccttatcctcccctcccagccacgtgaatacattgcacattaatgtcagataaccacaaggacgttcatgaagagtagaaattgggctgggtgcggtggctgatgcctgtaatcccaacactttgggaggccaaggcggggagatgacaagatcaggagttggagaccagcctgaccaacatagtgaaaccccgtctctactaaaaatacaaaaaattagccgggcgtggtagcacgtgcctgtagtcgcagctactcgggaggctgaggcaggggaattgcttgaacccgggaggcggaagttgcagtgagccgagatcgcaccattgcactccagcctgggcgacagggcgagactccatctcaaaaaaaaaaaaaaaaaaaaaaagatagaaattgggtggggaattacagaaggctgtgaacactgcatcttagatgtgggattgttcttcactgtagtgagagctaagaaaagaggcagcacttggcacccttaatcacccaaattaagcaattattctgatcccccattcgaaatgaattggtatcatgagaacaaagaggcaacatgcaattgccaaatatttggcctatattttattgtttcctttctttctccagtactggcagcagcccatgatgctaagaaatatcccgtttggttatgaagttaatgtggagattaaaagtcattccctgttctacccacaccctttttcttgtgtatagcatgtgactgagctgattggaaggcatatagcccagtggccaagcacttgggcctcagtgtgatggctgacacatgtttctgactctgtccatttctattttgttgtggacaagccttggctttctcagctgtcaaatgggggtgacaacagctctacatatagtcctgtagcaattaaatgaaagcatttagggccaggcatggtggcttatggcggtaatcccagcacttagggaggccaaggcaggacaaagtgggctcttgtctttgagccctagagtttgagaccagcctgggcaacatagtgaggccctgtctctaaaaaaaaaaaaaaaaaaaaaaatcttaaaacttaaccaggcatggtggcatgtgcctatagtcccagctagtcaggaggctgaggcaggatgattgcttgagcctaggagtttcaagactgcagtgagctaagatcatgccactacactgcactccagcctgagtgacagagtgagaccctgtctctaaaaaaataaaaatatatgaaggcatctggctcagtgcctggtccatagtaactgctcaataaatgttagcttttgttcattttacttgagataaaatgagagaggacgcttgaaaaaagaggaagactagcatcctctttggaaagctggggttcttctagagaacctgctagagggtttccccagaatctgaggctcagcctttatcccaagggcccttctcctggacacaggctgaatggaagtgttaaattttgaagggttctgaaacagtgtctttttaaaccccttatccaaacatcaggccttcctctgagcagaacctggagccaagagcacgtgtactgtcctggagggatcaaatggtgattaagtgaattgtatagctcttgtcccttcagcaactgttcccaaatgccaaacactgtcggttcccagaaacccatcacaggagagatgttctggggtagggccagagcatctgtattttttaaaaagcttcctaggtaattttggtacacaactggttttgagaactactgccttatagtaaatgtcaaagggaaacatgatttttccccgtgtttaatgctcttgaaattttgactgcttaggagaaaaacttgaaagttgtggagatgttgcctgtgtgtgcagacatgtgccacccatgcttatgtctgtagataccgggcataagtatacatgcagtacacacatacacaatctcacagaaatgaatccttctccttttcctatcaatcttttaacatgactcctgattgcagttttttctctctgtgctgttagcagtaggaacaaccacctggagaaggtgtttgtgctcctgggctttgctttggtactgtgtcctgtacccaggacagcctactggcacaatggctaactgcaaatgcagtactaccgatttttcacacctgctttccctctttccacacactttttggtgcattcccttttttgtttagagacagggtctcgctctgttgcccaggctggagtacaatggcataatcttagctcactacagcctcgaactcctggactcaagcagtcctcccacctcagcctcccaagtagctgggactacaggtgtgtaccaccatactcagataacttaaattttattctgtagagatggagtctcactatgttgcccacactggtctcaaactcttggcctcaagtgatcctcctgccttggcctcccaaagcactgatattacaggcatgagcaaccatgcctggtgttcatttttaaattcatgctaaaagttgttgtgtttgatcattttatgttcacttgtgtgggaaggggcttctaagaaaaggagcaaagaaaaccagcaaagtcttatgttcctaactcaacacaaaccacatgcctaacttggctcgtgcaggagtcagaaactgctgagatgtcaaactgaagactgggcatgtggtttgtgcttacagtggaagagtcccatcccttggttggccatgtttcacactcggtaaggtttgtgcaccctcagcaacattccagaagctcagaaggccctcattgttgcttgtggaacccccagccttagttttcaaataggatatattttggtcaggagacagtttggaggtactgtcctattttgtagctagaaaggaatatctccacctttccagatttcatagcagcaaagcagacagccatcacccagggaaagagaatggatccatgttcttgtctttatatccctaatactttgcacagtgcttgatatgaattaggtgctcagtgttttgcaaaatttgcattttctttcctggatactcatctccaaacggaggggataagtgaaccaagttcagaagactcatactcaaacctgattgcacctcatacagtcgcaatgtctacttcctggacccccaaaatgtgtgatctcttcctcaggcttctatatttcatctacagttttctcatacaatatatctaagccatttataagtttcctaacttataaatagacaatttcttatggttcttggctgagtctcaggagatttttaatttatttttgttttttgaaatggagtctcgctctgtcacccaggcagaagtgcagtggcgcagtctcggttcactgaaccctcccactccttgattcaagtgattctcctgcctcagcctcccgagtagctgggattacaggcacccaccatgcctggctaatttttgtatttttagtagagacagggtttcaccatgttggccaggctgatcttgaactcctgacctcaggtgaccggcccatattggcctcccaaagtgttgggatgacagtcatgagccaccgcacctggcctaagagctttttattttggatgcgtgatttccgtgatgcccatctactcaacctcttcttaccccttcaggattttgtctgggttaaaatgacattttattgttcttccaaaatcatcatatttccaattggcttaattacattgcatacatcccaaatacacattgatactatccttggattaaatttctatggtaaattattttaaattcagaatctcattatctttttcatatgataacattttcaggcaaaaccaaaaattacttcacttatactgaacatgtatgtacaataatctgttcattactaccatgtcatgcacctgaaaaagaagttataaatgtacagattttcaattaaatataggtaagtcaacagaataaatacttgttattggaaatatgtcaggcattttcagctaaggttttgtttcttgaaataaacagtgagaagaaagaacaggttctagatgttctattgctcgcaataggtgggtggtggagaagggcactcagaagacccaattcctgatttctcactcaccagctgtatggccttgggcaagttacctaatggtgcctagcattagttttgtcatctggaaaatgaggcagtattcaatgatccaacattgactatccagattttccaaatagctatttacctaggccccaacagcatggcagaacccagagggaaattaatatgtgattgtatcttccctttgccaatgtggaaagaggattatataagaattgtctccattctttcgtctctctcagtcttccaagagagaataaacatataggggacatactcgggtatatgtgtgtgtactctcaagcaactgaaggaaacttacatacagacctgatgtctaaacagggtccttatctgtttgttggttcagtctttcagtcatacatatccactcattttttcacaagtgtctactgatgaactgacatgagaattatagttgcttaactctgatggaactgtcaccatgtacctgtgagtaagtagcagagcagttcatttaatctgtgttcctcaactactgtaagtatttaggaaagcatggggactaggtggagagctagcttacggaatgtgtttcaagaactcacttgtttggtaatgaccattacttgatctataaaaggaattgttccagaaacatcaaggttgagtgcatgattctgtgttcccacagaaaagttcctgctgcttccccttgggtgaatgagccatcgccttgggtgtcatggcttacctgaagggaaagttgtaaagccaaggaggaggctgggggaggtgatggctatcagccccatgaaattgaccatgagccctgagccacctgaataccaggagggtcatgagcagaggcatttgtacaggtgatgtcttgaacaacatgcttcatgttagtggcctctgatagagtgtaacctgggaggctctttggttgtcagagaatttgtcttatactgtattagggttgcagagtgttctgtcttcaatgaagatagaactttttggtcatgtacgtgtgtgtgtgtgtgtgtgtgtgtgtgtgtgagagagagagagagagagaaagagttaatcccccttgacaactcctggatggcaagatagttacagataaatgctcctcagaactgtgccattctagtgtgacaaatataatcaaatatctatattaggatgtgttaataattatctaaactttatactttaagaagtccccagattcaacaaatgaatggacttctgttttcttttttaattaaagttacagctgggaaggtcaaattggttctcttttatacaggttagagattttccctatcagtttccatgaggagcatgttgagaagttctagctgtagacctgcatgacctcttcaggtacccgaagaataacccaaagaaagctggaagcagctttctcccttgttgttctaaaccaggcttgactcatatacttacggagacagccgaatggggtctttgaaataaggaaagaccagtaagccctgtggtgggtggttgtagtactcaaggagcccagtttgggcttcatcttttctttctagtgctcttagtggtttttgaagttcctaatttcctggtctaaaaatatagatgctactaatgtcttcggtcagtgaaaaactaagattagggtcaataatagcaactaaatagtaataataagcaccacttcacatgaaagagaacattgcattattcaaaacacttttaaaaacatcattttataagatctgtttaagtatttattgtagggatctatatattctcacatacaccatcgttgaccatgtgccaaactctctgttagggcttttcaaggctttatcttctcaagcaggtgtcattgttttacaaataagaaaaatgaggcataagtgatggagctgagatataagttgtgtcttaggattccagaatctgggccctcttcccatgccgtgctgcttccccgtacgtcagtgtgagttgggataagcctagcagtgccattcaggagctcatgctgtcatcccctctgtgtctcacctacttgtgctgcaagagacctggatcctgtttatctatccaccctcacccccacccaaacaattgcactaactcctaaaaattcaaacatggcggtttctcaagaaacatggaacgaataaaatttgggtctactaacaacttagattgtacaggctcttctgaagtgggacttttttcttattttagcctggaatgcagttatccaaggtgagaagggaagggctatatacaaggtatatattttaactcttacagatgggtagcaaagtcagcccatgattaattagggatgtaggctacaccagtcggtggacttagcatgaaccatatttggacacagaactcagtcttcctttaagtgtctgtatatgtgtaaacatttaatattttattaaatcatagactccctgaaagcatcccatgcctagcatgtacttgacacatacggccctgtaaatattagtgttatacccagaagttgctttattggttatccaagtctcataaaggagaagggccttgcctctgtcactcagaaagcacaggaagagcagggctggagcagaggaatttcttctgagcttccagtccagagcctcatgaaccccatatggtccctgcagaccattttcttcctacgaccccacacaggagaaggggccatggttccatggtggctcctgcactgcaccctctaaggtagttttgttctgagttataattcgccccctcaagaaccctcttgtccatccccagacactgattctcaccctgacagaggtctgggtccatcagggccacagggccttttcttttttaacagcaaatgctgcgtgggctgttcctgcagcccaaatgatagtaaatacctgaagcagccatgtccatgttaaagattatgtatttgccactaaggggagaatatagtgtttatcggccggagtgcgtgccggctgagctgattacggcacaacactctgtcagccaatgatttgtcctgtcctttatcatctgtgtcactcagcagtgtgctggcgaagggaacggatcacccccttccctttttttgtacccattttgtgtagaaaatttgtatttactttgggagtgtaatttgttcctcatggataatgtgaccctgagcggagctggatcatgggttagttgaagtgatattttccgctaatggtagtcgtacatcattgctgtcagctcgggttaggaggcaagcacattacagctccattttacctctgcaggcatctgggattatttgccataaccgagtatgacatgaccgcactacagagtgcattaaaattttactggcttctcaggcaagttccccagctccagtgtgtgcttcaggcaggcggtctgatggggagtccaagggccctgacttcctgctcagaggtgctgcgggcagtggcctaagcaggggctactctctccttgccctgagaaagaagcagggaaagactctgtggggagccacccaggggatgtttatgtctctatacgtcccggactggcaagtgactagctgccttgtgtacataaccaggtgccgcccacagtggctgctgccatctgctctctctccttgatgacttcagcccccagggtggattaggcaaaaactccttctctaaggagagcccagggtaagtgcaagtctctgccaagccttgggctgatttgtattgttcttgtctgcctacgttcagactgaagaaaggaggcgtaagtcctcattatggcagaacccacgtccagccatgtagctggactgagcctgatagagtctcatcaacccagttagaaatgtttgccaaggtgttttacacattatcttatacagtcctcacaccaacccaatggagtgtaggcgtgattacctccattctacttataaggaaactgaggttcaaaggttctgtaacttacattatacagctaatggtagcagaaatagccttctgacttcaaattctatatggtttctagtgttcagtgctacagagagataaagaagtaactattgtttaaatagtgcttagatgtgctatacatatgttgacttgtttagtcttcagtacaatcctaataggtaggtgctaatattatcccccatttacagaggtgggaactgaatcacagaggtattaccgaacatgcccagtcttgctcctggttaatggcagaggcaggtttcaaacccaggtcagtgtggcagtgctcttagccgctaagctggactctcccacatgccacattccaataagcctgagagctgataggaaaagaccagtgaaaactgtaatacgttggaatacaaggaaatgttcaaagagtattttatcactttctgttgtaactctaacatccaacaaaatatcactcaaagaagatgttttgtgatgagctttaattaattaataagtcccatttgcagttagcacattacttgcatgcaaatgatgcttctaaggtgcttgaaaggtatttattttgataggttaagactaagcagtcactctggcaaatgctttattcttttatattcttattggaaaggctgtaataaacttatgttgaatcatgttctttaaaaggacaatttaaggttgtctcccagtaattagtgggatatggatgagggcccataggctgccatatagaataaaatgactgcagattccatattggtggattccgaatgctggacacttgaatgtactctcgtgcctacagtgtggacatgactttttgttctgacacggaaatacccctttttacctctctagccgcctcatcgctttctattccaagcttgaaatgttacccctcctggacagaatggacaagccattcttaccatcacctgtgtacatgatagggttgtaattcatgaatttattcaataagccagacataaagtgagttgtaccttcagggcagttttttaaatgctgcaacagaagagccatagataagcatggcttttctcactgagaaatttaaaattaagttagcacactaagaattgtcctccctgcccccgctcccctccttgggctcacaagcacacacattgatcttccctgctagattaccataggtccaggggattgaccttagtttctcctctagccttagatccaatcactcaagtagtaaagaataagaacaaaagtattgatccagtcatggaacagtaattatttctctcagatggtcgtttagaatgcagcaataattttaaataatgtattcctcagagacagcatgacaacatatgtggattatttagttggtgcgtttaagtaagttacacttgcaccctcacccctttactggacgtccaatgctgtgcaaggaggcctactttaagaagagtagacattgagaaaaatcagagtttacccaacaaatcaattaccaagcaattgttcattataaaggggcttatccattttctgtagctggacaaaataatggacctccacatgctcacatgcttacagtgcaactccacccttccgtatgaagagacttcatgaagtcattggatccttttgaaactcttaagttgtaacagctttgactgtgtttatgttaatagagttaccttttaaagactctttttgtttcaaataacatacattaaactaacaaataatgaaatgtttaggcttttggaatttaaatgtgttaaaataaccaaaccatcagaagggcagagccaggcaactggatatcagaaacagtgagcagagggctaaatgccctccttgctttgtctctacttatttttgcccgtccacttgaatcttgataatttcggagacttcgtttctccttttggtagaaatcatgacccatccacttttcagttttagctacaggcagagagactgtctctccttttccactgccattgctaagatccaagggagagattctgactggctgagattagctcaggaaaggattgtgggttggtgtaacttaagccaggtgcttacacctggattggtcagttatgggtagagagacgggaccatgttgtccaaatgtgcttctctagaggtgcctctgtacatggtgctggagtcagtagagaacccagaaagttaggagttgggcctgcagcagtgggttctaggaagcaaaacctaatcttcctgccatttggatgaggcactacttacaggcataaattcttgacagccatagaagctgcctgggtcatccaaagttgacactttatagtgatcacaaaatctcaaatatggatacgtatttacaattatgtataataattgcctaaatattcatagagtcattttaagtgctattcacagattagttctatcttgcttaagctattaaaagccatagaaatacacaggattttgtagagtgagagttcatgtgtacatgcacttagaaaagtccagaatttattaatattttaagtacacctatagtagctaatgaattactcccctgccccacccaagtataagacagccaccttgagagacacaaagatctcaaggaatgtcaattagtaaattacatatctagggtacaaaatgaaacttctttgtccaaagggattgtggtcaacctggagaatccaatttgcatgccatgcagtactacttaaacttcagcaggcagccttcctgaagtgatgttcctaagactagaaaatagtaactcactcatagcttctttcactcatgtttcattcaacaaatttaatcctcacttgtatgctaagccaagcactgtcatgggaactagggatgggaagaagacaaagacatagaaaaccttcagggaaatatggcctaattgaagggaaagctgaggtacctagatgaattacaagaccccgtagcgtatgctgtttctgaggaatggcatgatgtctgaatgcaaaaaactgagccatactctgtaagggaggaagcaattgagttagatcttgctgcagcacatggaatagatgttactaggtagcaagaatggggtagatcacaggcaaaggggatatcatttgcaaataacagagttaggaaaggcttagcatgtggagagaagcatgaaaacttctgtttgtttggtcagggtccatggcagtgttggggggaagatgagactgtaaacatatgttggtatacacagttccataaaaacaggccttgcacggcaagatgagagtttggacttgatccagatggaagccactgggtaccttatgtaggtgaatgacacatcagaattgacattttggaggaggattcaggcagtggcatgaaggatggagtgaaagggggtgaaagttgtcataatgggggatttgagaggtgatagagatctcaaccaaactaatgtggaaagaaggagtctgattttagaggcatttctgaagtgatgattttgtgaccactgggaaggggggtcaagggaggaatcgtggatgactcaggtttcaagtcaggctgactgggtcagtattgatgatgccatcaatcacacagcgaaagtggggggatggagaaaataggagctcagggaggggctttcaggaccttcagctggatgaggtcagaagagagtacatattgatgatgcaggagtgatcccaattttagttcagtgtctgggagacaaaactaccttagtagcagagatggagctataggggaatgagtgggaggccagccagaacactgggattttgtctgtgtctacaggaataaatatacgtggtgatgataaccattaaaaacaaaataaatactggggactagtagagagggaaggtagggaggaaggcaagagttgaataactattgggtaccatgctcactacctgggtaatgggatcattagaagcccaaacctcagtatcactcaatatacccatgtaacaaacatacacatgtacccccgaatctaaaataaaaattgaaattattttttaaactacaaaataactgtatattaatcgtagcacttgatatttgtatagcttttttttttactgtacatatctttattttttcatttgtggcaaaatacacataacataaaatttaccatcctaaccatttttaaatgtacatttcagtagtaatggtaagcacactcacatggttgtgcaacctatgtagtttttttatgccacatgtgttaaagtaccatatatagttcatttaaacctcataagaaacaccctggatgaaaggatgttaaatatttattttagaaatgaggaactttgaaacgggatgaactgaaacaaagtcgtaatgctttggtgataatatccccatgccttctagggtcagtattggggttataccacagtatccttagtgatgatattttaacatctaacttccagtggaccaaacagtaactcacttatagcctgagatcctattgctttccttaaggaaactggaatggaatcagccccacagcatgaactgggccacccagcagcagccaggtcgccgctctgagaggtctggttctgaggggctctgtgggagtaagacagcatgaggccatatagctttggatataggaaacgcctagaaaggtagagagatatgataccacacttccagctctagcaacatagtgctgtgtgactgcggccttgggcagtttactaatgcttctaagcttctgcttttgtgtttttttgtttttgttgttgttgttgtttttccttttaaaaatctagatataaaatacctagaattatatggcccataatagtaactactcaggtcaggcactgtgactcacacctgtaatcccagcactttgggaggccaaggtgtagaccaacctgagtaacatggtgaaaccccatctctacaaaaaaaataaaaattagtcagatgtggtggcaagtgcctgtagtcccagctaattgggaggctgagggaggaggattgcgtgagcccgggaggcggaggttgcagtgagctgagattgcaccactgcactccagtctgggcgacagagcaagatcctgtctcaataatactactattaataataataaggattcagtaaattttacatttcagtcccttccaccctgtttcctcctgctggtcccccaccattgaccgacttaccctgcaaaaaaccataacacacattagcaagattcatttattacagccaaatcagcaccccaggatcaggccttttaggaaatgggatccaaaacataagtgtcttaaagaggtagaagatcagagggctttgaaacatggccatgtcatcagtctgaaatttagaaagaagttccctgtggcaagagaatccgcaggaaatcactaagctttggaggcccaggatatacccagtaaagcacaggcggtgggcccccaagggaagatggacagcaaagacagcctttataatctgagtagatttcacccatgtccccctccacctaagctctggttttcctttagaggaggcttttaacttaattcctgttgaatttactaatgttgtgtggtgtgagattttaagtatcttctccagcctcctgggcccctctctcctcccctgtcccttccccacctccctatcctgtcttgaacttccaaccccaagagctcttctttacactgtttgctaaaatggagcctcttgtgtgatgcatacccaggaggtgaagctttcaggggtcctaatgtgtgcttcaggataagggcaccatgggtcccctgcctgccagtgtgcccctcaaagaatgtgggctttggcaacatggcattaattcactgccaatgaaacaatgatgggaattttaatgatagcgttgctgtctaaaagatgacgggggagacttctcagcgtctgtgatccagaaaacacactttctagtaagtatctcttatggtcagaagtgagagtgaaatctctgtcagtccttcctaagcattaccttggcaagcgctacagagcaatgtaacataggatgtgttcagtttaagtaacagaatgcctgatagtggctttgtccgtgtattagtttcctgtggctgttctaatgaattatcacaaacttggcggcttaaaacagtagaaatgtatcttcttggcatgctggatgctagaagttaagcatcagtttcactgggccaaaatcaaggcatcagcagggccacattcctcccagacgctctaaaggagaattgttccttgccttgtccagcttctggttgccaccagcattccttggctctggcagcatcattctcatctctgcctctgtcttcatgtggccttttcctctttcgtgtgtctcatctccgcctgcctctctcctataaggacactcgtggtggcatttagggcctatccagataatccaagaaaatctcacttcgggattcttaattagtcctatctgcaaagatactttttccttgtaaggtaacatttgcgggccttacaaaacacattcaaggcagacaaggagacaggcggtcatgtgtcctgtatgtccccttggctagaagagtccattcctaagtgtgagagagaaaggaaaagcaaagatctggcaaagaggggcaaggatttccatgacccatcatgattgtcccctgtgggttggcgttgtgctgtcttctgttagcaagaaagaggcggaggacatagtttgtgggtggtcgaagaactatgactgccaccaaggatgcgggcttccacacccccagtgtgtcagacaaaaagatctgaatgggggtctctctttttttggggaaggtaacgctgttttttaacgctattaaaaatctagatataaaggccaggtgtggtgtctcacgcctgtaatcccaacactttgggaggccgaggcgggtggatcacctgaggtcaggagttcgagaccagcctggccaacatggtgaaaccccgtctctactaaaaatacaaaaaaattagctggacgtggtggcaggcacctgtaatcccagctactctggaggctcaggcaggagaatcgcttgaacccaggaggcagaggttgcagtaagccgagatcacgccattgcactccaccctgggtaacaagagtgaaacaaaaaactccatctcaaaaacaaaaaataaaaatttatatataaaatacctagaatgatgtggcccgtaatagtaactactcgggccgggcacggtgactcacacctgtaatcccagcactttgcgactgagcgtttccctgctcagtcacactgataaaccaccatcgcctttgagtttctaactctgcctatctctggaatccactgaggaggaaagtgggcttaaggtttggtcttggattctgaaggtgcagacctcatcaccacctgctgctgtgcaaagcacactactggacctctctagaacctcagcaagaattcatacctcccaaggctgtggcaaagatgaaatgcaggcctcgggagtgctttgagctctagaccattccacgagctgctgttcctgttgtcactggacagtagggcccactgctgcttcatagcctaaagccaggtggagggagtccagtacccttgttgattctttgcttccctttcccttgtcagccacacccaccacacagacttccacatacccatgtgttgttgttgtttgtttgtttatgttcgtttgccagttctgacttaggagcaagcctttggtgctgaagttggtactgttctcactcctgaatgtaatgcccataatggatggagaatgtcaggggaattgtgggtaatagtaagattactgtcatattcccaaaccctggggtgggtgggaagaagcccctaaccatgcagctttatttccactgtgcttgtggtggggcctggaccaccttattcctggtggccttcatcttgggtgctacaggtggcaatggcaaggactgaagtggggagagtgaagatgcccgcagcatctgtgcctggccctggctcattcgtctgattggattgttagcaagccaaatatgacctggcctgcagggtacaagaagacatggaatacctggtaggcagctagataggaacgcgggacttcccagcagctgagcgtggagaggtggttccctacctggctacacatcacagtcactcagagtgctgtgctcagagaggcactttggcaataccctggacattccgattcagaagtttcttaggcaggtgtggtggctcatgcctgtagtttcagctacttcaagaggccaaggtgggaggatcacttgaggccaggagttcaaggctgcagtgagctgtgatcatgccactgcacttcagcctgggtgacagagtgagactctgtcgctacaattaaaaaaaagaagtttccaggtgaggtacaggaatctatatttctaaaagcaaccctgggactactgatgcatagcctgcctggcaaatacacagtttttaggagaaaaccatgagctttggggtcagggaaacctgtttttggtaacagctgtgctacttactagccatgtgagctttgtcagtcacctaccggcctctaaacttcagtatcctcagctttaaagctagtgtggtactaatacctgcctcacaggattgctgtgaggatgtaataagatgtttatgcacaggttatatgtatgcacatcatggtgctttaaaaaccctcaacttccccctaacccagcacggaagttcaagggcagactggcccactggctttggctctggtgcccccagccacttcccaccaactccatccatgtaagatttacatagccatggccaaattgttactgcaattaacaatcacacctaaaagcttttacttttacttttactttacttaaagggaactcttaaagagtgtttacttcatatcattagcaaatcattgttaattcttgtgatactcaccgtaataacatctatccaaatgaacatgtttgctcttaatgcgagtgtcatgtgcaatttgggagaaattctgttgtcatttagcattaattaatgcccacttactgtaaagtgttcagagacaccaatatcagcgagatttccagaccacatagacaggacagaagagctgggaaggggccagaagccactagcagggctgcactgtgactgaaggcagtggccctgggcacacttctctgctgagggcaggcaggccagccttctggctggaggatctaggtgtccacccataggtgttcagagcacacaactgggccatcccagcctggctccactcactgtggctggaaggggttctgcctctccatccccagcccttcaatcccacacaaccacctctgatgacctctcctcccagctgcagccaccttggatgttgatttttaacctgatttcacctggctgcacatgtcagctggtgggccctggagtgtgaagtgtgacttgcttgggcccctgcagccttgcctccctgcagcgacttcctgcagtttgactttggggcagcggctgccggagaagcctgaaagttgagctcaggaagtcatcttcatctccacccccaagcaggtgcttgatcaggactgtttattaatgtgttctattttctcaaatgcgtcctccaaaacagagtgtgtgtgagatactactcctgtgcctgggacagtcagtgtgacagtgaacagtgctgctctaggtgtggggacacagccttacgttccctttcttccaggcagctcagtgtagtggaaactacaataactgaccggggctgtgcccaccagctgtgtgagggggcctcagttttcccacctgtaaacggggctcactttacccaccccgtggaatggtttaattaggtgtgatgaagtcctgcatgccacaggtggtgcttagtagccatcgccttattaaaaatgccagtgatcaccgaggatcatgatttccctccccttgtgtccacacctcagacacgtcctctctccttctggaggggtaggaacagaggaacagtgcctctcacctgaggagggaacttctctgaatccaccaggaaacccagtcacaaatcacacagaagcagtgttcattttttctgtccacaaccaatatgactaaagtacggtggaaagacaagtattttttgtcctggtgaggaaaggtgccttgatatgtactttttttctgccttgtggatggactgcattggacagaggtgggggtggtggagggagtggaatttaccatggtggtacaaatgagtcagtctgctcaatagggatgtgtcccatacagagccgcagatgcctggtttaaaagactcaggctgcagttaactatgctaaactcaaattttactgagtggaatttagtctttctctgatgattaaaaggcccttcagaatcttctgagccgttttgttgaacagtgcttttttgttacttcctgggtgtaggaaatggtggggaacagagggttttgctggaacacccactggacttgtgtgtcctcctctcggtttctaagggcccctcaggccacacgcctcccatttccaagagagtgagaggggcctagaaaaggctgaacacaaagccccacaaccgccaaattccctttcaagggtgttacttagtaaacatgagcccttgagcccacattcttccagactgtgtctgcctcaggccacccctccttctagaaggagcagtgggggccctggcaggaggctgccggctcagcctggagtggcccacagcaatgctccaattcacagtgaaatgatttcctctgcctcgtataatttaacctgcccacattgctaaacttctatattacacatttctgtcaggatgtcagaagaaatgataagcctccttgaaacagcaacctctattacatgctaagagcattgcgcctggctccccccagctctggtccttctggtatgtttctgagatttttagcatggtctctcaagtataaagaataccctacttcatgaccccagcctcttgttagctgatagatgaaatcttttctaaagctgactctcttgtctattatgttttcaaaattcaaggttttagattcttggatggctgccaagtggccgggctttcttagtaggtgaattgctcctctctttttttgatccttaaacaggaagtagttgttttttagggtggagggaagcgggaggcatgttccacctcccttctccctttgttgatgtttccaggcaattggtggggaattttttcaggaatttctcctcggggaccatactttaggaataaacccaaacacggaaaagccatttccttgtctggtgggagcttgtgttttctcgctagattgtgtcacccagaatttgttgtggagcttcttgacaattgtgctgtgcacgtgactgcagcatggaccactgagggggaatagcaccaagctgctccatccacacgggagacacttgcgagatctcagggccatggacagtgcagctgcctgtcgctccctgcaacttactcccgacccgggcctcctcagagacagccacaatgcagacagtccacacataggatggctcaggactctcttcattattagctgtggttgtgtggtttccccgggagagagaactaagactgagtttcatttaaacctaaaagtgaggaagaacagatgccatattcctacccttagttgttaatttggattacaaacacccatgcttttcttcaggtcattagtcatgtggcttttttcttctttgtctcactagattctgtgggaacagatttctttctgcatagcatttagtggtgggaaaatgatgtttgctgaccatccttgaaattgaggcacaatgtagttcttgattaggaagactctggaataagcgcccaggagaaatggaaggtgtttggtttccaaaagtggtaccttcaactctttttgtaagctgagtgtgtttctctccaaagttcctagcccattagtgaactgtcatacacttcaaggccagctcaccactccgatagctaagctgtcatacatagtccagggtccgtgtgagccccagctcttttaaaactcctggctggctgtgtccagagaagacattcttatcagttttctcagttacttttgggaaaccatctcagagtgtaacctaagtctaaactcagacaaggcactgtgtgttttacaaaatacacatcccactcacctgggcttaattacctgtaaaactgaagtaatgaaagcagtgcctcaggcttctttgcagctcaaaggggatgggccagggattggaatgtagacctgggagcttcctttgggtgcctcctggatgaactgcactgtaggttcagtgagactccttccgggataagccaaggacaacagagccagactgtggggcagagggtctcatggtcctcatggcaaagccagccccagccctcagtgtgccctcatgactatgagtccagtctttacaacaggaacataacaattctacagaagggtggaggatctaacactgaacaagcaaggccccatggaccaggcccccaatagacgttacttcattcagtcatccccacagccccgggaggtggaggcatcactttccataccgtatagaggagggaactccccaccaactagtgaagtttaaaaccagcattccaagcagggctgcccagctaccctgcctactttgtcctgttgctgcatcttctctctgattcccctgaagtctgtgcgaagtgccacaggaggtcgaaggagggaccagaaaggtgagggtttcccggaagtagtggaagcggaccgtgtcctgagaggtccccagcccgagaaggaggcagccaacctcagcaaggacagcctggtctttttttttttttttttttttttttttttgagatggagtttcgcttgtgtcacccaggctggagtgcaatggcacgatcttggctcactgcaagctccacttcccaggttcaagtgattctccggcctcagcctcctgagtagctgggattacaggcatgtgccaccatgcctggctaatttttatacttttagtagagatggggtttcaccatgttggccaggctggtctcgaactcctgacctcaggtgatccacccgcttcaacctcccaaagtgctgggattacaagcctgagccaccccacccgctgagcctggtcttagagtggggtcagcttcggcttcctattgtgagaatcaggcctctggcacttatcagccctgaggcctggcttaatttacttcgaatgtctctgtctccatttcctggtctgtaaggtatcactggaagtgttctcaaccctttagtatgctttagtgtgagaaagcttgtaaaaatgcctgcatggtgccttgctggtgcccagtcagtcctgcatttctcggctctgcaaaatcacagacacatggaatgggatggtatgccccagaagaactgggggattgggagacctggcaggtgtgagccctgggtttgggaagggcagaaggtaagtggtgacagataagtctaggaaggcatttgggtgtcaggtcataaaggaccttgaaaaaccaacccctgggttagttgaagctttggtttagtttggtttcacggaggaacaggatgatgagatttttctttaggggaagatgacggcagcaataagagtgttggaaaagtcaccctgaacaacttttgtaggtaacttaagggcagaaaaaaggaactctttatttttcaagtggcatcatggctatcacagctcatcagtgcctggaacaacacctttaataatgtcaataggaacgcttcgaactgctgcagaaattctgcttcctgaatgtttgaacttaccctcccatttaatctttaaaccatcccttcaagagagggaggacacaagggtttttctcaattatgtaccactgtgagcttggcttagttaccaaaggctgatgatgggctcagcagtgggatccgagtccctgcgttcccacccaggcttcccaccattttcctcttaggtgcgcatccgctttgaagctgcattctctctgagacatgtggtggtaatgataatgttaatactagtaatgatcatagtaatcgctaacattgagaaagcatttacttattatatgccaggaatacgttgctagttttgaattgttttgtgtaattatcatctcctctttccaactaagaaaactgaacggtaatgagataaattaccctaggacacataacaagggtgtggtaggatagaaccacacccttcccaggtgaggagttgcctgtcatttctcagggtcctccgtggcacctggggacaggtggaggtgggcgtgggttgtcaggacatcaggggcctaactctgactctgcgtcaatcagagaagcttgatttttatctgtttcattggcctttctcaaaagagttgatttgagaaagtgttttttaaatagctttttaaagcggaaaggggccgtgtgcgctggctaatgcctgtaatcccagcatattgggaggctgaggtaggcagatcacctgaggtcaggagtttgagaccagcctggccaacatggtgaaaccccatctctatgagaaatacaaaaattatccaggtgtggtggcatgcgtctgtagtcccagctactcaggaggctgaggcgggagaatcacttgaacctggatggcggaggttgcagtgagccgagattgagtcactgcactccagcctgggtgatagagcaagactccgtgtcgaaaaaacaaaaacaaaataaaaataataaaataaagtggataggggttgattggggtttttcttttttggaaaaaagcaattaaaaagaagatggattgatagatacataatgagctgggtagatggggagacacatgataaagcaagtgtagtacagtgttaataaagtcagtggtgggtatataggtattcactctaaaataccacttttctctatgtttgaaaattttcataataaaatgttggaggagaaactagccaagtaaataatttctaagggcccttccaattttttaaaaaattttatttcctgcacttctctctacatcctatagttgtgatcatgtacaaccatgacgtgatcattaatctagatagatctcctagtcaccactggatgttgccactaaaaaaaaatctaggctgggtgcagtggctcacacctgtaatcccagcactgtgagaggccaaggtgagtggatcatctgaggtcaggagttcgagactaggcagaacaatatggtgaaaccccctctctgctaaaaatataaaaattagccaggtgtggtggcaggtgcctgtagtcacagctactcgggaggctgaggcagggagaattgcttgaacccgggaagcggagattgcagtgacccgagattgcgccactgcactccagcctgggtgacagagcgagactccgtctcaaaaaaaaaaaaaatctgctggggagaacaaagtcaatcatcactcatttggttctccaactacctgagcctaaattttgattggcaagtttggttgggttcagatactttcactagaaagccgtaggcctgtgagtctccagatgaaaggtgggtttagatctacacatctcctgtttcagggcagtgagctgttttggacccatctctagtagaagtttcttggagctctccagccacaataaaggtacagtgttcctgttcactcactttggcagagccttgaaaaggagcacagagacggtcaaatagtaaaatctaaaaacccgtagaaaaccctagcagaaagtattcttaaagacccagctgtatttttctgttcataagacccagataagcatagtcttcccatttgacattctgactttaacatgagagggagtttcatgcccccttggtaggacattggagtacttgttgcagcgtgcaagaagtggactttgtccagcttatatttagaataaccttgccagcacattccagggagttgatcaaggagttttgccaaactgtgataaatcagcacattgagcagcctctgatggctgataagcttgggagtgccagttaattgacaagaaccgcacttgtcaatcttttgaggtcatggaaatggatctcttgtctttctgcccttccccaagtcttcacccgcttgctctttggtagattgagcatggccttgcactgcatggagcacacctcccacctttgttcttgtgtgtttgctgagtaattaatctcattgtgctagtatggaaatagtctattaaaacattccggaggacaccatggagagggaggaaggaggatgaagactggcggagggagtagtttgctctgtttaattggttctttcacctaatggtagtttgtcaattaaggggatacttagagaaagtgaaattaatccatgtgggtcaaatgcagctattaatttttaatcaaaacacaatgttcaacaaatctgtagctgtgcttagtacaaatgtaagcatgccaccagcctcttcccaaaggatgtgggagcaggcacaggaaaggggggcctgttaatctagcaaatgtttgcctcctcccacactccctgtgaccctgaggtaagctccgcagagcttcgttcttgtctcttcaccatctattgcattgcctaacacatggtagatgctcagtgatattgctcttctggaactctttccatccctattatgtgcacagctttggagtacctcaaataggttttaggcataacagctattctctaagagctcctagcctgcttgagaaagcagaggaggcagttatgaatgcatccccaagtcactcagagcaacgtacaatcaagtacaagaatgtgtgataaaccgtggcatttgttgagcacttgctatatgccagatacttttaagcacttcacataaaccaagttttttaatctttgcaacaacacaataaaataagtaccatttttatcatcctattcataaataaggtcactgaggcccagaacatttaggtaacttgcctagggtctcacggctagtacaattagtctgctagagggttgcattcattacctaatattataagacccagagttgtcccaagagagctggcattgatcaggggttaaggtatgagtttattttggaaagtgccagaataagatgctccaggtagttggaatggtaatcagcacggttttgtggaaaaggagtgcatttctggttaactggaatatgaggttggtgaggttgaggtaggtctaggttaatacactttcagggtcttggataccaggatgagaaattttcatgtcggttattctgggatttctttattgtttatgggttgtttcactttggaggagcaagtcccgttcctctatttctgcacttgggcattgtgccctcatcattatctctcttacctcctctgcctccctccatctggcatctttcttctcatttatggcatccttagctcctcctgcttcccatttttagagagagggagagagaagagaaaatcaagaaagtacaccagccggcctacttctactgactttcagaggttgaatgaagcttttctcagccctctgccctcacctcagtttggtcctggaactttgagaggaaaaacaccagaaggacttggcctcaggaagttttcttctgcctccccttactgagcagaaagcaggttggaggaaccacttggctctgtgacatttatagtgacatggtttggagaggtcaggaaggactgtcccagtggtgtctcttcaggctgctcacaactgcctgaaacctctcagtaggagaggtttctcatgatccagtgaaaaatcaggcttcaggtgtacatagtttaggataggctacagggtatgttaaattccttcacattggccagaagctggagaaatgtgaggacaggtaaaatccttggatattttcttctttacttccaaggtagcttacaacctggcctcttgaagtcattgggctgatgataactggtggaaatttgcaggtaattgccaatgacaatgagggagagaattggggaatagaggggccctatgaagaggatcctctgcctcgtattccatgcagtcctatgggctgctgcagtaaacctgggaggtcatcaggattaccacaaagactcgtgattgggtgggtgtccctctgggcagcctagtttccctagacatacaacacgtgttcttctccagcagtgcaaagctgagaaggggcctgagtaatcgttctggtcttgctccaggaggcaaagccacagctgtctgtgtacccccatgcaagtgggcaggaggggttccagcaaggctgcttgctgggggagacagggtggagggaggaacagcgactctggatcatagagcagaggtcagggaagcacagttaggatggaaagtctcgggcagaaggtgggtagaggtggataggcagtgtacatggtgtttcaccatgtcatcttgaccaggaacacggtggagagaacagatatagctgactctgtgtgatcagtgattttaaaatgacactagtgtcagactcttaaccagcaagggaacacatcttgtaaatctgggaaaactaggtagcccaaagggacacccacccaaacaagagtccttcatgttgaagaagaagaagcacttcttgataaacaatgaaacaagctgatatggaagaaattgttatgtcatgggaaggaggacatttttggtacctaatgattaatatgaaataataattatgtagtgattatatccttgcctctcaatctaagaatactcagaacattgtcatagtgaatttcagtatcttctatgtgaaaagcagcttagctagtgatatctgttattcatgcattcattttttctttcctttgccatatatttaccaaaacctaatctctgctaggtagtgaataaggcttttgggatgcggcaacaaacaaaatgggcatgttcactgcccttaaaatgtaaggtgaaatacaacctttatagtgtccactttcctgcgatggttaaggttttcttcgtggacaaatacatgatcaattctatagctattccatgcacatataaagaaaagtgaataatacctgttcacaatctcaaaatacctgttaaataaaatgtatcaattttaaacattagtgtgagacaaaaacattaagtaacagattgtgtgcgtgtgtgcaggcatgtacagttagtcttgaaaagatcaattgggagtcagtggagcatttaaagcagggatagacatgatcagatttgtcatttaaacggtaactttggcagctgtgtggaggacggattgagggaggccagagtgaagatcagcagtgaggagagactgttacccaggtgagagaggatggtgactcagagtaggcaatgtgggggctgagagaagaaaaggagctaaattcttcttggagatcaaataagcaagatttggcaactgatggaagagaatgtaaaacaattatctacttcctaggttggttgtgggaactaaatgagacattattcgcttcattttacaaacaaggaaatagagactccaaagtgattgagataaacgtctgacttccacacagcctttgatctctctactgcacaaggcataaaaagggtgtaaacagaggtagattcacccaggctaatggctgaaagcctcaaggcccttcacttgctgggatctcatccaaggcctcatacctaattttatattcataactttgtattcattttcttaaaaagcaccctccacaagggtttaagcttcagactccaggaaacctctatctacctctggccaagtaagtaacctcattgggtaggactgaaacttgatgggatgagacctaggatcaaaatctgacccagcaggcagagaaagtagtgtgtttaggttgggatcaactgggagagaaacagatgccatattggaggcataacaaaaatataactgttagtgtttattgaatacttcttgtgtcaaacagtgtatttattgactttgattttttgggggaagtttcttgtattatatcacttaattcttatacaacccaacagggtggttgctttcattatccccattttatatgtgaggaaagtaagccctggtaagagtaagtaaattaacaaagtatcacaatactaagcaggtgagcagcactggcatcttacaggcctgactttgatgtttgaggctgtccttaacctccactgctagagggactgtggtccgaagccagcacctctgatagattcttgacatgtgctgggcatttcctctcctagaggttggaggaagcaaggtctaattctgtcctgctcctttccaaaaaggaattgcttggtgaaatgtcagtgggagaaagtaatcaccccaccttcagatacagagttgaggacttatctgacatgtgccggagaagacaagaagattctgaggcttgaggccgaaggagggcatcaagagactccagcagccttattttgttattatgcggttgttattttgactcaacagttggctctggtgaaggggagagatggggcttatatgcaacaacaagtgagggcgatttgagggaaaacatgtgacccagactaggagcattgtgtccacattaactgaagctcacagaaatcctaaggataagtagggttttcagcgtaattttgttttttatgttctgatcaagattaagaaaaggaggctttgtcctttgatggaaggtgtggtgttgatggatgacccagagaaagcagagaggttcacctcctgctctaccttcctgtccagaacatgatctttagaaggaaaggtatagaattttcttggcttaaagggactttagatccaagatcagtaaagagattgccttgaagatttaaatgagctcacgttttcctgacctggacaagttacctccccacatgctgagagatcttgtaaatgaaatcactgacccctccctgccagagatgttggagaaaggtgggacatcaggagagaggctgggagactagaggggggcaaatacattgcgaaatttttaaagagaaaggagtgttctgtagccacaggtcagtgagcatcaggtgctctacaggatcctagacccggtcagcatggagcaggctggtgaagaggaagcaggaatcaaagagtcgggtcactaagactggtcactggagcttagcacctttttttttttaacaagcttactaggcagttaccaaaagtggaaagggcagtcttactccctcttctcaaggtcttcgacaaggtcttttatgaagcctttgtggattcggtgggaaactgtggagtggctgcagcaaattggtgaatttgttgaactgaccaagttgatggtcgctctacagtttcgtcacgggactctgccctatataaaataatcgtcagtagttgggtaataattattctgcaccaaagttgcagaagacagaaagttgtgaggaaaacagatagcttcagatggccaagtcagaatttgaaaaagaaaactcattcatacagtcaacaagtatttgagtgtctgttacatgccagtcatatatccatcacggagcagctacttctgggttgattctcctagtatggatggtaagcaatgaagaaatgtgtgtggtgtctgcatgcaatgtcagatgatggtaaagaatatggaggaaaaatttaaagtcttaggagataagagcaaggtgtgaggggggtgctattatgatacagtgatcaggggcagcttctctaaggaagggcccaaataaagagaagctggtagatacccacaaatctgggggaaaactatacctggtataggcaacagcaagagcaaaggccctgaggctggaacatgtttggcatctctagaaagcctgagtagctggatatcagtgagagcaagcatgagaggtcagagcacagcttgtccttgcaggctatgggggatatcagatgtcctgagggagagggaagccactggaagcttttttgatatataattgataagatccgactcgtggtttgtttttgttttgttttgttttctttttaattgagtcagagtcttgctctgttgccccgcctgcagtgcagaaatgtggtctaggctcactgcaacctccacctcctgggttcaagcgattctcctgcctcagcctcttgagtagctaggaatacaggcacccgccaccacgcccggctaattttttatttttagtagagatggggttttgccaggttggccaggctggtctggaactcctgacctcaggtgatccgcctgccttggcctcccaaagtactgggattacaggcatgagccaccgcgcccagccaggttcatggttttagagactcagtctggagataagcttagcacagtgtgatgggctggctcttcaaggatagcatgacacacatggcttagcaatggtagatgcgagaaaggcctagaaattttagtaaaaattcaccctaatattagcaacagtgttatttgcctgaggaaaaaactaacagtattaaatggtatttggtatttacagtgactggtagggattggtttttaccctccctcccctgcccaatctctgaagtcttttaggataagaaccgattggttaacaaagcttcctggatgaactcagcaccttattcagctggccactgccagccccaaccaacagagaaaggagcatcagtgaaccagttctggtgaaccagttcaccccactgtgaaaactcaaaacccaggagatgtggtagatggaaataaggatgtttaaggtaaagagagcctcatggtcaaggtgaatcactggattcagatgtttggaagtctgctcaatagagagaggagattaaatttggccacagcagttagtactgtgacagatttcttttccatatataaaatatgcttcctagagtcaacgctatctaaacatggactgggcccacgcagcatctggctcatccctggacgtgtatgtaaactgaggctggataagctttgggtgcagttatgtagagacttaagtcagtaaatggacacaatgcagtctgataaaggaaagagggtggaggcggggagacaatcaggaggagaaaagaggcagagaagtagaagcctgtggttgtggagatggtctgtaaccccaccgggagcagcagcatctgaactggttctccccttgctcccctttcttttgccctccagccaaaccagtaacaaagggcattgtctagtagtctgtgtcagcaataaaagccatggggatctgacccgcggcagtgtgtttcagcctgcgaacttcctggatatctttacggggaatcattcccggggaaggaagggcaggctggaaataatataaggagatcaagaaggaagtcgagcaagtgacacctttaaacaggccaagcgagccgggctcttccccctgggacagttagagttatgcagagctgtaattaacccagcagcccactggatatgtctatttcaccgcacaaaggctgttgaaagaaggattcttgaagaaagaggttccaattcaaatggtatttgagtaagtcccttgtcggatatactgtttctagagtttatggctataatcaacaaaacatggccattctttcatgcaggtttctcatgactttctgaataccaatctttagaaagaaaaggggaaaaaaaaggcatccagaattgtctaggggtagaatgggggaaagggaaggagggggaaatatggctcgaatcaaattaaggacttggttttcttttcagaggatgttgaaaacatttaaaaagcaggtgtgtccttctttcataaatgaagactctgagatatgtaagaaaattttcagttgtgtattcaagtccctcaaaatcattttatcaacctccctaatttcaattaattttttaacaaatattttttgtatgcctaccctatattaggcactattataggcgctggggatattaatatctctctcctgccttcctggagctaatagtggggagagatagacaaaaacgtttaagtatgtagactaattggtgtgtgagatgatgtgctatagagagaaaaatagcagggagggaaatacagtggggagggatgcaaggaaggccttgctgagaaggtggcatttaagcgaagatctgaaggaggtgagatgtggatccggtgggtgtatgcgtggtggggtcagcgggtggggagagacagcagtgcaggcagtgtgcacagggattcgtaaggtagcagtgtccatggtagtgtgtgtgaggaatagcaagcaggctgaccgggccagagtggagagggggagagccagagcactgggagatgagggcagagaggtcagttatggctggagtctgcctttgccctcaataaggcacccattcagttactcaagtgggccagcacacagtggtgtgtcctcccacatgctctgagtactggccattcagaatggttcccatcacacttaaaaccgtagagaataaaattacattgtcactgtgctactcttcacccttggatagtcctagagtcctttggcgtagcttttacatagtgtgccacatcccactgtactccctttcctgagaacagactgatggaccgagttacgatttatatgagagaaccccaaatcagaattcctagccatgtctaatttatatatcagcaggcaagttgttttgtttcttgtttgggttttggggcttctgttttggggtggggtttttttttttttcccagtaccgtaacttataatctcagatcatggaagagcattctctaatgagctttctaaagccaagagctctacccagttgctgggtaaaggggggaacatggagaattagaatgtttacattgtaactgatttatgtacactatatttgcatgtaagtgtactaaaatattttttaaaattaccagccattaaaaatgtgtttgctaatggggataagaatgctggatacaatgaggtaagctttgtttaaaaggatttaggagactcacaattcataatcaatatttcaacacactcgtctgcatttttagggcaatagatctgtaagtagaaacaggcgtatttgaagaaaaacattagtttctgagatctggccagctcctgttcttaccactctgtcatctctgattggattagacgtcacagaaagggcctcagatccttgtttcacgttaagtttaaccactccagttgaataccatccttgtggagctcagtggagagaaattaaatttctatcaccagaagtatggcactgaatcaggtatcaagggggctacatcagtaaacttcgttggctacaagatgtatgtccttcctgaggctctgtagctgttaagttggctctttccaatcacagtctgatctttcattttcccgtaatgcagttagacaacctagttattcaggcatagacttctctgtttttcattatccctgaataacatttgatgctgaaatagggaagacgggaaggacgggggaggggagccaagcatttttcacagcttgtgtgaaatgcttaatatttgaacgtctttaaaatatactgtacacatacattccaattttataagactaacataacatgttcaaaagttttatgaatttcagcatgtaaccagagtaaacgttagcctgttttaaataagccataatggcctggcaacaaacctgcatagttagcaaatccctcctctgtttatgggcagccattcctcaccaggtcactacaaaatacaagttttatcagtttctgtggactccgtaagttggtctgtgtactgagttcagcatgaatctggttttaagagcacaaaaccaagggcatcatgatgaggtgatatttcgttttgattttaatgaaatggcatgaatctgacttgcttaagaatatgtccaggcctctcgtatcctgtgggggcaacttggttcctaaatgccttccgtaagcacagggccacacagacgtagcaggcttaccccttcctcactggagtcaagagagtgctttgtgcctagaaaatgtttgtttttttggtggggcttttttttttttttttacttaggttggaagcgccccccagatgatgctttttaaggtaggatctcctcttaacaagtgagagcatcaaacatgctgggtcatgcccagttccatcccatcgtgtgtcctgggtctaaggtattagacacagtcatgcctctcaatggtgaaggttctatgttaccagatcatatatttcatggaaatctgctagctcaccagataaaatcctcccagcttcttcaagcgtggcagaggagagagacttcccatgtgttaaaaatctgctaaactttgcagccccaactcttttgcccgtagactcaccctggcctcagccatccctcaggaatcatctaccgtagaccaaactggcttcaggggatattccaacccctgatgtactctggcatcaaaagctcctttaattacaaataggacaccagagaacaggttggagcatttaaataagactgatctaaaggctgtgggccaaagatttctcacagagggcaacacgtaattaggtaatctgactcacaagatgaagtttactcgctttcattgtggtgccccccagggcagccttccccacctgccctctaggcctgtgtccttgtagcacttaccacttgtaagcccagccttctgggagaccctcagtcaggtccagatgcttccagaggccgactccagactcatccagtttcttctctctttgtcttataacagtcatggtcctcattgctccctaaaacatcctacttagtatttagagctcactatacatctgttcaaagcttggcttttggaagtctttattgtaccagtcttcttacctcctgaaataaggaaaatataagtataactgcccacagaggcatataaaactcctttccatttacctcatttattcgtcttatttaggggaagcgcagttcagggtgggcagtctagtttaagccattgagtctagtttaagccgttgttcaccatcatgattttatagcctttagttttattccctgtcagccatagacatccccagagatgcaagaactcatgcaggaaaacccatttaattaggacccactgtgaaggaccaggaaacagaccctaaagcactttatgacggaagctgttgatcaggaaacaggatgttttcctttccctgggtttaggtctggctcatactcctttggggagatctgggggcctgtctccatctccacggaaacagaacctgtaaccttcccagaatcaggttaccctagagggcagtgacatttatatctgcttttttgtttgttcgttgttctctttcctaagacatgtaagtggcaggttttgaactcctggatctctgcccaggggcctggcatgttgtatatctgccattctgatgtgtggagggcctcctgtctacactctctctgccccatggctagagacagctcattctgagagattctttttttataggaaggcaaagctcacctatccctaacatgcaaaaattttcacttgaggaggcggggaactggtttagtaaagatctttgcgtgaaattgaatccagtccttgccatccttcatgttcaactcaagtcctccttctataatgaagtcttccccagccagaagtgatctttctctttccattacatcagggccttttccacattcccacctttcccccctcatactgttgactagttttatttcccattagtgctttgcaccctagtgctcctaggtccatttaaagacctaaatggctgggatcacatcttctacttggttatttcccccacagcattcgatcacttataaactgtgttaattttccccacagtgcctcacatagagtggtgctcaattacaacttactaagtccatttgaaaagaaatacactgttggtcaagaaatctgtgtgctgagtgcttcaagggacacaggcagtataaatgagacatcctgccctcagggaatgtatagtctgagtggggataagacgaggccacatgaaaagtctactaatagcggccagggaccatggcttcctacaatacaagcactttgggaggccaaggtgagaggatcacttgaggccaggaatttgagaccagcctgggcaacatagtgagaccctgtctctacaaaaaactttcccaggtatggtggtgggtgcctgtagtcccagctactccagaggctcaggtgggaagactgttagagcccaggaggtgaaggctgcagtgagccaagatcacaccactgcaatccagcctgggtgacagagtgagactgtgtctctttgaaagaaaaaaagataaaaaaagcaaccagtaatacaattccatataggatctgggccagaaaaaaataagtactgattgtcatgatcatggtgatacgttagttatcttgggtatatacactgtttttacccatccccataacaactctacaaagtagatggtgctagacattcttagtctcagctctcttgtctttagagtgaggacaaatgattcgtccagtgagtacagagtgctgggattcagacagctctgtgagccctcacgtgaggctcaccctgggttccaatggctcagagcttctcctcttgcttctctctcattacccttgtgccctgcccactcccaacctttcaaatatattaaggaggattaaccatattgttcactgctattaaacaagaccagagacagagtctttccagcagaggtgacaccttggtgtctgaatgagaaaggagttgtccaaagacatctgccccacacagaagaaaattagacatatcacatgcctgctttgttataatggcataaaagtatgtgtatgttttaataagtcatgtactgagtgtactcagactatagcatatccatgtgtattacggtggttaagagctcatctctttagtaacaaacaggggttcaaattctgactttaccacttacaagctctatagccttcagcaagctagttaacttctcaggacctgttttttcattgataaaatgagtggggtaatacctagctcaaaaatttgttgtaatatttaaatatgaatgtaaagcacagtgcctgaggtcactcagtgaactgtgattgtggtgagcatactgttatatcccttcctgagccacagaacttgaatttgtgttcagagctggagactccagaacatctcccaaagggaagcaatttaaagttgaagtagcctctcccttctgtcagtgaggatgccaggtcttttctgagtttcctgtaagtcctctaggatatgttactttggataaagtctcactactttgacctgtggaaagaaattactgtccaagtacacaatttattttgacctcccaacacctttggacaattccaggctggctccaggcttcatcagaacaattatgtcctctctgtggaaaacattcctttcaaatgaatcagtagttactcaccttttcttttcccagccatatttttcagttgccaacagtgggatcagtgaggggtagtggtgtagctaacattagcccaatatagataagctccagattatccgtcatcttgtttgaaaaaaggcaggcctgccaaatttgcctacagttcccagtgagggaaagaaacaacaggttctatgaagaggaaggcacagaactagtcgtggaagtcacttttccagactccctccgttactcaggaggaaacaaacccagagtgtcttcttcaaggttaaactccctagaagctgatggaacctggccagaggctgtgaactttgcacagagggcatcatcagaatcaccctctgctcagtggatcgctgccctcccattactctgctggcacgtacctgatttggttgacatttccataattaatttataacagcaataaccctgagatgagcctatttataggtttgtgcaagctaggtaagaatatagattaaatctcagatcattaacatacttaaaggacttgggagagttttgtgattgtcaaatgatgtgattaaaaggcctccaagcttgatgtgtactgggaatccacaagtttactttccttgccaagctcagaaacaacaaaatagcaaaagataagcttacattccacccattcaccaaagatgttgggtcatccggggaactggaccagggtcatcactgatggtctacagctgctgccccacagatgaggatctgtgagcgtggttctgacccttgatatgccagcaagtgtggcaccaagagtcccatgggaagaattgctgtgactgtccacagcaatagagatgagtgtgagaagcacacctattagttgaaaggatgctattatgacctggactgctgtgcagacccaatcttactttctttcctcctttttatgttctgttgttctggttgttaaccttctgaaaagtaacatggattgcttttctattataaaagtaagacgtgttcaatatcaaaaataaaggtaagtacagagaagaaaataaagatcactcataattccaccacccagaaatacccactgctgaatttcagtgtgcatccttctaatagagtcttcattctgacatcatgctagtagaactgttctctggacacagaggcctcccattcaggtgcttgctttgacagatgtgtttcctactgaggaaagcatcttatactcagggggtgagaatccatccatcaagaagaaggaatgactaagggactccctgccttgcctgcaggaggctcttcaaaaaactaccacccagaagtagttccctctctctcttctttttacatttacccagaccactcaaccctatttatccttttcttacctgtatatgcaaatatgatggcaccaccaacgtcatccacctctttcgttcaagaccataacttcttttaaggctctcatgagtccttcacaccaccctccagcatagagaagggctcttcacccattattcccattactagtgttcaagacttgtttttttttttttgctccagttttttattagcaaactagctacaaaatgctgaaaatcaagttaaagttaatacatataagatcatcataaatgattgcacatgtacacagataattattactttcatttgttttattattttaatctacaaactttgagctctttaaaagtggagattagatgttatgtcgccagacccttaacttcgcacttggcataatataaatacttgattaatatttattgaattaagatgaaaatgaagagaaaatttaattacccagtctactttttttttttctatctcagtagttaagtgcagagaaaaaggaggtcatataaaaatgatgaaaaaatagtaccttagaaccatttttatggtgtatcagtgcattttttgtgctaaggtatcactgttaaccctagtgtggaccctttttaatgactttttaaaatcttgacgatgtccttttcacttctttcctaaatgaacattaatataaagccataaaatgttccttggagggttttatgagttactgtgttgtaaggttggggaaaggacacttggagccatttgttttatggagcttgattctgaagtccagcaccgcccctgacccttcagaggcacgctctgaggcatgaagcctttcttgaggacagtgagcactgccacttctccccgaaatacaccagccacactcctacacttgccacttccccggagtccacagtgtcaacctcaagccctgccctccacgagtagcctagacaccgtggagcagacgttactgatgatgcattgaacagctcttcttccacagtgcagatggattttccgttcaccagcatgaatcgcttttgccatatataatatcatgtagtacctgaaaaaaaaaaatgatgccaaagactagagatttggtcgaggacattggtttttctggctctttttgcctccggaactcttcttcagtttatatcagatgtggaagggaagcctaatctataaaacaaagatgggggtttgagtccccggggtttcccctcaccactgtgctaaccctaaatcagctttcaccacttacttgaaaaacccagggcccagagaaaccaaggtgtgagagtgtgaaaggtaagtgcaggacagatagacgataacgagggtgatataaataataatagcttacatttttttaggtcttcttgtgttccaagcactgtgctaaacacagactgtccccccaaaatatggcaaattgtgatgcctgaggcagagtatggtatggctgtctgggaactcttgaaaaggatattggattgcttgcaggcaagaaacaggccagattatcttggcagatctcgctctcactgtggttcttagcctttattacactgttggaatgggtttctcacaagtgatatcaagggaaaaaactagacggatatgtccagtgtatgtgtacgtgtgtgtgcacatgcacttaggacaactttgagccaggagtgtgagccggattagcacactgagttgtactttattctaacacatgcagctcagtagaagtctcatcttaagggacatatagaatgttgaggtagaaatagctcagaagaaagttgataaagtaataggatacgtgcttttgccaatctacatggccatatccttgcatgcttattttgacagaagagtcacagaacagagcaagttcttaaggctcattcattcccatttccctcttgacattttgagcaaaggactggagggaccaatccataaggggaatgcacctggtcatcttttcctgagcatcttgggatcaggtgctcttgggaataagatgatacgtatacccaagagcacttgatcagtcaggcagtgagtccatcaatccacagccctgttctgtgctggatcccatacctttgtacctgtgtggcaggagacaggaaggatgtgtggtggaaactccaggaacttagtccagctgaggagatgatacagacattggaaaacataatggaccaccaggaaatgataagcttaggaactcagagaacatcatttctaggatgaccagagaaggcttcaaggaagaagagaaatttaagcagtgcctcaaaggttgggtgggatgtgagttactcagctggggcagggagtagtctttgcagggagggaaactgctgaggaaagatacggaggtgagccgtgcacattgttcctgttggaaccacacatgtgtaaaggctctgagatgagtttagtgagagttgaaggctcatgttgaaaaacactgtgagaggcacacccagtacagactgtggcaagtgttgaatgcctggcggagaaacctagagccttttaaatagttctgagcagggaagggaggcaaggaaagcagttaaactggttcagctctcaggacaaatgtaaaatgaagggctcatgcttgtgtgtcagattgcaggtttgcttagaaagcacagtgcagggagaaacccgaaggagcaggattctgtcttctggagccctaaccaagggaggccgaagttggtgctttcattgaacgtccatgttctgacatgaataaatgccacgtcatgagtttgtggtcaactcctgtggtcaacttttaagcaagctttaaaacaacagcaaattgcttctatggaatttctcttacagcatcttgacattctggaaaagccagtgcagcagtcaagggagtaggtcctgtcctgtcatttacccaggcttcctagattcaacacatccctgtgggtcccgtcacacatctcaccctggcccatttaactgagctgggcctactgcagaccttcagatatttaatttgtaaacacttaataaagcactgtcagtaggtcggcttgtcttctctgtcggccacatcaaaatcaatacgtcccctgtgtattctgccatgattgtctgggctggggaatctaataggattaagtgtttggggtcctatctgacgccacagtccacagtcctagttagatgaggttaaagactggcttgccattgtggaggcacgattgcttaggggtctgaaaaatcattaaagcttgtcctcttaaacgttgattgttccctggtgatttattgacaaaacacaaaaaagtgctctatactgcactctaattatatgtatgaggccataagatctcatgggaaattaaataaaatttacagcttgatggttttatgctcctgggagacataccttcttaataagatcttatagctgggaatatttatgaggttaaagtccgtaggcttgagcaaaagacctaacctttccatgggaggtggggatggggtgcgttttgatttctttgaagataaatgatcgtaatgaaattttcaggggtttaggaaaaagtgttcagtaagacacatcaagcatttctccttaaaacctctggaggacaaagctgtaagggcacggggatttactgcgaccatttgtctcacataaggcccccatagtcctactccccacctctggggcacttcgtcctcctcctgtactctctgtggcttcctcgtcttattagcccccatcacactttgaaaaggtggggaggatcctaattaagggcaatgatgtaagaggtcaaggaagggaaaggaatttgagtaaggaaaagggagaaagactgagagaatcaatacatgttaagacagcccccagaggagtcactggacatttagtattttaacgggtcaccttctctttatgttaagggatggctgaggaccaggctcagattccacaaggattatcctgtgctgttctagacaaagaatcagagcatatctgggataagagggatttggggggagggcctctgcaggtgtcatgaagatgaagatgatatttatttgttacctttcttgactctgaatagagtgcttatcccaacgtctccgtgaatcctaaacgaagcttcatgcttgaaagtgggctgtttcaataagagtgaggagcatcgtttatgcagccccattcctgctgctttctctaatagttctgaaatggcaagaaggaggtaggtaggtagatagagagctgtcatatatatatgtgtacacacacacacacataattcctatgtattgaattatatttttatctactcaaaggaggataattgtgtggaactcaaagcggttgggacatgtcatatgtgatctatttttctgtttattttttctattgagttttttatatgaaatctgcatggccccttctttgtgtggggggttggagatggggagggcattgacagaagggttggagatcaagctttagagggacttggaacagatgggcacatcacctctctggggcccctgaatttgagagctctgctcccagccttttcccaccaggggagctcatgactggctgtcttctactgtgtgctccagtttatctccaagggtcaagcaaccccaccttgagagctccctacctaggctcatgtgaaaagcaaaggactatgtgatgaggatgaatggatacagcgtttgacctgctagggtgaggcaagtgaattgagaagttcctgactttcctcattgccaactagtcatgttcctcggcttccctcttccagaataaaccaaaataaaataaaagggactgcaaatgcccatgacttagatgtgttagagtccagcttctgtttcccccatttggtcctgattttcgaagtgaaggggagacaggactgagtggcatggtggtgagcaacccgtgtgcttagcccagcggctctctggtttgtcattgtggtatccctctctggaccacagtttcctcatctggaaaatgaagatctaaggctaggtgattttaaagtccctttcagctctaaaatattattttacagttgtaggatttatggaggagaacggcattccgctctatcccttgctttagccttttgaatgaaagtgagatgtctcatcagctcagatagagccagctcaagcccagtgtctcagataaaaggagaaagaaaaaaaaaacttattaaagatagctaagttcccttgataagcagcaagtgagaaatcctgatttaatttaaatatgatatttctgtcttcattaatttaaagcatgtatatgataatgtatccttttttatttagtggtctgccctgaagggaaagaaaggcttgattgtgaagcagaggggcaaaagcttgggtatattttaataaagatgaatatccctaaaaatgcttgaattattatggaagtaagatttgttgcaagttacaaatcaaagcctgaattgtcacttatctcctaatgatacttctacacagattattaatttcattttagaagcccaatgaatgttatattttatgacattgattaaacatcttgctgccatctaaccatccatccttttcattttcaaaaatccatatcggaatttaacaaaaacagctcataaatttgtattttacagcctagcaaagttgactggttctctactctacttaccctcgggcccattctgaactctgggcttgggccatttccactcttagaagtcagcttttccaaactgacatcatgttttgtggtcagagtagtacttggggatttgtttggaagagcacgtgtggcttctggagctgcaaagccaccaggggagttctgaggtggttggggttagcccctgacgggaactcagggtctcagctttcattctcattcttagacaagctagttacctccctcctcagtatcctagggataattatgccctccccagggggctcccagtgccactgtggggatgaatgagacagtagatgtgaaaggtcttcttgctctttagaggcaagcagtgtggtaatggatttaagagccaataaagaacagtgagattgtaggtttaggatcaaccttaggcattataggaaaggtgtaggatgacttgaaagcagggataaaagccttttgaaaatatctccaccatgttattatttatcaaacgtttgtcaaaagaagtacctctggacatagacagttctcaaaaaagatatacaaacagccaataaacatatgaaaaaatgctcaacatcactaattatcagggaaatgcaaagtaaaaccacaataaaataccaccttactcctgcaagaatggccataattcaaaagtcaaaaaataatagatgttgccgtggttgtggtaaaaagggaacacttctacactgctgatgggaatgtaaactggtacaaccactatggaaaacagtatggagattccttaaagaactaaaagtagaactaccattcaatccagcaatcccactgcttggtatctatccaaaggaaaagaagtcatatgaaaaagacatggcgcacacatatgtttacagtagcacagttcacaattgcaaaaatatggaatcaaactaaatgcccatcaatcaacaagtggataaagaaaatgtggtatatatacaccatggaatactactcagccatgaaacaatggcctttgcagcaccatggatggagctggaggccattattctaagtgaagtaattcaagaatggaaaaccaaatgccgtatgttcttacctataagtgggagctaagctatgaggatgcaaaggcctaagaatgatatattggactttggggactcgggggaaagggagggaggtgagtgagggataaaaggctacatattggatatagtgtacactgctcaggtgacggctgcaccaaaatctcagaaatcaccactaaagtacttatccatgtaactaaaaaccacctgtaccccaaaaaactattgcatttgtaaaaataaatttctgaacccttcaaaaaaaaagtatctctggtttcacgagactcatatgtgtgtttcctcaaaaccactgtgggctcatcctttccctggattggctcccattaggggaccccgtgtgttcctgtcacatttccttctttataattgtgatctttatgattgctgttcatttccatccagcgagggtgctggcacctggatcgccatgcagggtgcagctgtggccagctcttcctccaggaaggagacctgaagagacgtattctgagaagcctgaattcgactctacattgaaaaattaaggactggcaaccaaaggctgtcacttgttgaagaaaaaaaccttaattaaaaaataaataaataataaataaataaataaataaataaataaacctaatgaagctgagggtcaaggggcatcgggataaactgttttgcaagggttgatgacattaggaaaaataactctattaaatcagaagtctgcctctgccaggtaatccttaccaaaagtatgcaagaagcttgagagatcagccctagaaggaaaggtgccaccccagtcctccaagggcacagggcacaggggttagcatgtaagcttgctagtcaggctgctgaggctcacatcttgtctctcgctgtacccttggggaagttatcaaaccttgctgatctttggtttcttcatcagcaatagccctgtcacctagggacattgtgaagattaaatgaagtaatagtagtatatgtcaagtgcttattagtgcagtgtcaggccaaagttagtgcttaataaatgttagttgttgtttggccaggcacggtggctcacgcctgtaatcccaacactttgggggctgaggcgggaggatcacttgaggtcaggagttcgagaccagcctgaccaatatggcaaaagcccgtctctactaaaaaacaaaaaacaaaaacaaaacaaaacaaaaaattagccgggcatggtggcacatgcctgtaatcccagctacttgggaggctgaggtgggaggattgcttgaacctaataggcagaggttgcagtgagccaagatcacgccactgcactcccgcctgtgtgacagagtgagattccatctcaattaaaaaataagtaaaaataaatgttagttattgttgtcacgcgttggctggtagtctgtggtggtggtgctggtggtggtggtggtagtggtggtagtggtccttttggtttcgtttgttttgttgtttttgtattcccccccccccaaaaaaaaagaagaaaaggttgcatatcatcactttaaaagctgaagcagagcttttctaggccccacagggcctttccctgtaggcatggtggtaaactggtgtttagggacagagcatccttgagtgaggttggctgctgaggacagcccctccctatttgggaggcaagggagttggtatgataggagcgttactgggagaggacggtagccgcttagtgtgaagacttctccagcatgttgtgaaatgttcttgagtgacacattttgccctcctttttctgactcatctacctcatccttctcctttcctcccccgcgcccccctcccagccaaccctccatagtgtgctccaacactggcgatgttgcataaagggaaaatatggcgtgtttacagagagaattttcaagaagtgttaatttaatatgctaaagtgttcccttcagcattttacctttcttgttgttttcacaaaacagccaagactaaataatgagcccagggctgtgccctttggtagcgtgatagctcattacccactagcggcctccatctgccctcatggctgcatagggagccattacgattatgatggaaatctcagaagccattaccaagatgcaacagagggcctactgcagacagcctaatggactaatttgtaattgggagagggaaatgagttagcgagctggggccggttttgatgagagtggaagtgcgcatgctaaatgtgataaatgaataggaatgtgtgtttgcacagtgggctctacaagctttccatctctcctggggactggaggcgtgctgacaagccgtgaggagcgaggaggaaaggctcaggggaggcaagcaagattcaaggagagtagctaaggataaatcggtgaggaaaactaatggcagtaaaaatccaaggaaatgactgcatctgccatgaaagtagtaattaggaagcattcggtgtgcatgtctttaaccgttaaaatagggggatgagtagatggaaggctggggcggtggtgggccaagagagaagcccctcgtagagggctccgaagggagagcatcctcagacctggtggtctgggcaaatgctgcctgctcagaacggagccgagtccagaaacaccacgggcaccgcccttcgaggggcttctggaacccagcaatgggaaggcctagcaagctcacaggcagccattgtgcaaggcaaggaggccaggctgcagtgccagacctgcagaacatctgtccttggagggctggagagtcgcttcataagccctcgtgcccggcgctctaagctgaggagtgctgggcaccagtgtggctatggacagatttctgaaagctggcctttccttctgtttgtcatttggctcccagcatttcatctgcccagcctggagagtgcgccaggtgccctcatggaggccggggcttttgtttccactcacactgatggacctggtgaagggtaatccccccagtcggtctgaggccaagtcctgcttggagctgtcctcattttctgtttctttttggcattttctgtttctttttggtgtatcttctcagttctgtcccctaacctccaagccctggtgttctttctcctcagtcagaccttcttagccctgaaagctgcaggccaagccttaatgggcctctttttcccagcaacctgccgtcctcaaccctttctctggatctcacttttcctcatgggccagcctgaattgagcctcaggatcgtcctagctctcaggattcctcctgctcccaaacattctcatctcttttcctgggaggacctttcagccttcctaaatagcctaagggaagacgcgtatcccttcagggaagaaggaagcactggaaccaattaactgaaccccagcccagggctcttagaaccctttcccaaggtgagacagccacgtagctgactctgcctgcagtcccacctctgtcccacgggctcacttttcccatcacattccctagtacacaggaaaagttcccattttcttcaccaagcactagaagaggtttctaattagctccctaatgggatgatgacagtcctgttcagcaaaattttattgtcagcctatttgattgattatgtgagtgattgatcccacctactttgaaaatgaatttgaggaaaccaacaaaaaacacagatacattgagaccccaaagcaactcattctgggagaaggcaatcaataaatacaaaaggcagaaaaacattctcaaaacatagtacaaattaaagaaagttattgaaaaaacacaaatgcggttctgctgtgacaagcagtcatagaaaaggaacaactggatgaatgtcatggattaacaatggaagcatattatttaatcaggggcaactgactttttcccatccagtgtccgctgttaagtatagcattggttatgtcatcaatatccctaaaccaagagcctcatcatacagtcccatcaatgttgtataaaagacctagattttctgtgtaaaggtattgcttagatatccttcagtaaacccccccagaatgtgtcaacctaggacaaagccgtagagagacgacaaaaatcaggttcctgctgtgcccaagttcccactttagtgacgtagagatttatacttgggtaactctaattcagttacacagacagtaacaaagcatttagaaaatgcacaggaggacatcatcaacacatttgacaaatgtttcttgagtacatcctgtgggcaggcactgagctaatcactggagacacagcattaaataagtgggagaacatggcccatatcctcatgaagcttatgatgatcgaattctgacccaaagaaggtatggtgtgaggggagtatttgagctgagctgtgaagctagaagttcattagaaatcaacaacaatgagatacccagcaaaaccccaaatatttagaaattaaacaacatatttctaaaaaatccatgggtcaaagaggaaatcacaagagagattagatactattttaaactaaatgaaaatgaaaatgcaacacatcaaaatctgtggcatgcagccaaagcaattcctcagagaggaatggttgtgttagattacattaatagaggaatgcttgtattagaatagaggaaaggtctaaaataaatcaaaattccaccatgaggaggtaggaaccgaagaacacagataaacccaatgtgagaaggaaggaaataataaagaaaatagcagaaattattgaatagaaaacaacagtagagaaaccaaagccaaaacatggttctttgaaaagattaacaaaattgagaaacctgtagctagaatgaacgagaaacaaataataaaaaaaagaacacaaataccaattcaccaagaatgaagaagatgttatcagtgcagatcttacagacattagaaggatcatcaggacaggagctcgacaagcagaggggaggtaacgagttgctagttctgtgtgggtttgtggggtggagagaaggagttgccatagcaggcaggagctgaaaagatgtgaaccagaattgttggtttctacagtgacccaggacctgtgtacacagcccagttgactgcaccctataccagcagagttcccaccgttgagtggtggtctaatgtgcatgttagaccatagatgccgagactgacaggtcaccaatggaccataatgcttggctttcagggcacctggacttgctcaaaacatcgttgagcattggccagtaagtcaatctgatagatctgggtccacagcccctagaacataggggactttatttctccctgccaacttctggcttctgatcattcagtctcatggatatcaaaactgacctgatgccatcctgaggccatgatatcatcctttccacagtttatatgcttctgaaaatggagctttctttttaaaagattaagtctgaatattcatggcagaagaagcttgccaaagctggctgctcacctccagctcccaagtcagtatcagcctgccatggcttattccagacccagacaacatcaagagagaaggcgggtgtggcatgggccagtttcatccactggtcacaggaccggcacctgtcagccatgaggctgtagacagggtcctaaagtgcaaagaaaaagctgtcaaagcttagttttctccccctgctcagatgtttacctggcaggagtgcctgccgtgtctttgtgtcattgttgctctttgtgcaactggccttccttattctctcattatcacacactctctctctctatctctgtctttcatctgtcctattattcatctgagtgtggactcaaaagaaccagattctgatcctgggcaggctccctttcctttacatatcttaatgtgaccatccataaaatgagggaaatgagagtgccatctcataggctcatggcaagttaaatgacttggtgtgtgtgcgtgtgtgtatacacacacacacacacacatatatacacataatatatatgttatatatacacataatatatatgttatatatacacataatatatatgttatatatatacacacaatatattatatatacacatatatgttatatataatatattatgtgtatatataatgtatatatattgtgtgtgtgtgtgtgtgtgtgtgtgtgtgtgtgtatttttttgagacagagtctcactctgttgtccaggctagagtgcagtggcgcaatctcagctcactgcaacctctgcctcccaggttcaagcgattctcctgcctcagcctcctgagtagctgggattacaggtgcccagcaccatgcccagctaatttttgtatttttagtagagatgcggtttcgccatgttggccagactggtccctacgtcctgacctcaggtaatccgcccgcctcggcctcccagagtgctgggattacaagtgtgagccaccgcacccggccaaatgagttagtatattttaaaagcactcagaccagaacttgacacctaggaagcactagatgttttaccaaatcacaggcctaggtgtggtgttcttcagccttcctggcgcctgtgttcctcaggctgaccacgctggattcctcttctgttggaagctcctccaccccacccctcccagtggagacctgcctgcctcactgcctgcaggcagcctggcccaacagctgcagtataggcacagggggcattgctcaggggtgcaggtgttccctaaccctaagttgagacctgagggtctcattaggtcctccaaacttccaagattgtatacttaatgaattggagggtttcaccttcccccaaatagccattgagcgaatccagccaccactcccgtcaggtcctggctgttcatgttgacactgatgctggcgagaggggagtatcttgaaagggcagaacaattggggtgaggatggggaagaaaagggagaaagagatgccctcaggtggggaatttaatttagtcacatgatagtagcatcaggcacttgtgttttacttttctcagaacattctcacatgcattctcttactgtatccttaccacaagtctgggagctagctgtggccgaagtgggtattttctctagaaacaaaagagctgaagcctaggaaggctgaaggacttgctcaaggtcatgcagctacctagagacaaagcggagaccataagcccagaagtgctgattcccagggctccctgcaggggatcatgtatagagagtcactgtgaactgctgtctgagcaaactacgtgaccccctcttggcaagacgaaaggccttggcttggagcaagatggatggagaacactccgggcccacactatgctgttttgaaactgtgccagagaagaggagtggcctggaagtgcagccccctctgttgggtgtttctgagaaagtgtttttctcctttgctggatttaatgaataaattataataacttttgcgtttttatccacattatgcatgtttatctgcccttcccccgtaaaccccctttcccacttccacgtagtactatatttcttttcatgttttatctttgggaacttgccactgataattatttttttaaaaagctcattcctagtgattgctggtaaagatgcacacctcttcattttctaaaaatgtatatgctcaggaccaaaaattcagggaggcatgtgtgggaaaaggtatatttccacttccaaagagagggtactttttcagaagctcagaaaaggaaaggggaaaatgttatatgagccctggtggtatgtgagctccttgggggaatacatggttgtcttatctgtctccagctctttgaatagatcttgcatgcagtagcatgtgagtacattgatggaatgcatgtaccaaggagcagctggatggctgatgggctggatggctaagtgagtgcatggatagatggatgcccaagcaacaaagtgaaacctcatttggcttgttgtgtcagagagccttcttaattactactctggatttcactgctatattctattctggccaagtcttggaatttctttatgttctaggtgggaaaagattacttctataattcatcaaggaaaatactaacttgctcccccagagagctgggggaaaacacattaatataaatataattgaggagtggaaacaaagtctaggaggagttaaagcataagtatcagcctggatgtgaattctaatataggaattagaattcctatattaaaaattgtattagaaacctttactttcttgtgatttctgttagttcagtaagtaacctttcttggaaggtctactaattcctttcaaaaaagatatttattttatatcttactataatatactaagcactgttattgctagggtgttttgaaggggcaggagatggtatttaaaactgagttgcagttctaggcagttaaataaaatccactgaccagaaaaaaatatgtaaaatgataaggcaggataagtattcactgccaaaaagtcaacaaagaaaatagtaaggatttatgttcagcaatccctgagattaaaatttaaaataaataaatagggatagtacgatttgaaatcggcgtcctctttgaactaggaattcaagactcagaataaaatggtccttttcattgcagagctgatctttgtgaccaacatcttgtctccaccaggaacattttagttgagaagcaggagaagtcattgctaagaagcttggattttcaaagaaacagatatcaaattgagaaatctctactaatctttcccttcagagtctaggcttgggtattttttttttcaaaactacatttattttacagataatcaagactctgacagagttttatgtctttttatcactctttatcttgaaaagcattgttggcctaaggttgaatcagccaaacactcagcctcatgaagagcttgtctggggcccatggcgaggaaaatgccagaatgtaagtgctttagagacgggagccataattgcaatgagaaggggagctgtggctggctctgactgccctgcttcccacattttcttttaacgagtgtccccacgtccccaccgcccctcccccccgacactcagatcccttcagttcccactggctgccattttcccttgctctgcagcctccaactccactccacttaagagaacagactggagactgctggaggccctgaagtgatttattgcttagcaggaacttcactaaacttcccaagttgattttttttagttttgaaaatcaaacaaagttcaaaaagtaaacatcacaggttgacatcccagcccaaagctgaggaaaaatgtctcttgttacattttttggcacataatagaatttatgagcattttcagtgttttgatttttttccccagtcactgttattccttaccctccagagttaggtgtggagagattatgttggcctgtttccatggtgacactgaagaaaagtaattttttaaaggaggtttctactgtgttatttcacatgcatgaaacatcaacatctatgctgtgtggctattacccctaaacataaagacacagaaatggttggagtattttatataaatagacaagtagggtgatattttccttggtctcgtgccgaccctagtaacaaaagtctctcagttacccagggcacctgggagagagtgagggaacagttctgttcagtgttaagcaagctcctctcctgtgaataaccttttctttaaaaaaaaaaaaaaaaaaaaaaaagctcaagttgaaagtccaccccccttctacttaaactagggaccagatgaaaagttccttttggggctcactgttcaaagaaccaggattaatctctgttttcgatgtagcttacttggtcaaccactgcaagtattccccttatctgtccaaggcgttgtctagaatcttcttgccccagtaaacagttgcttacagtctcctagagtgaggttggttagggtaagtatatacctttagcagcagaaatttggtgaaactctttccgccaccctacacatagacacacaccccccgcacatgcacacgtcacatcagcatcaatcacacaccccactcacacacaccacgtacacagtcgcacacacacaccccacacatgcacacgtcacatcagcatcgatcacacaccccactcacacacaccacgtacacagtcacacacacacacaccccacacatgcacacgtcacatcagcatcgatcacacaccccactcacacacaccacgtacacagtcacacacacacacaccccacacatgcacacgtcacatcagcatcgatcacacaccccactcacaccacgtacacaaacacacacacgccccacacatgcacatgtcacatcagcgtcgatcacacatcccactcacacacaccacgtacacagtcacacacacacaccccacacatgcacacgtcacatcagcatcgatcacacacaccactcataccacatacacagtcacacacacacaccccccccacacacatgcacacgtcacatcagcatctatcacacaccccactcacagacaccacatacacagtcagacacacaccccacacatgcacacgtcacatcagcatcgatcacacaccccactcacacacaccacgtacacagtcacacacacacacaccccacacatgcacacgtcacatcagcatcgatcacacacaccacgtacacagtcacacacacacacacaccccacacatgcacacgtcacatcagcgtcgatcacacaccccactcacacacaccacgtacacagtcacacacacgcacaccccacacatgcacatgtcacatcagcgtcgatcacacaccccactcacacacaccacgtacacagtcacacacacaccccacacatgcacatgtcacatcagcatcgatcacacacaccacgtacacagtcacacacacacacaccccacacacatgcacacgtcacatcagcgtcgatcacacaccccactcacacacaccacgtacacagtcagacacacacacacaccccacacatgcacacgtcacatcagcatcaatcacacaccccactcacaccacgtacacaggcacacacacacaccccacacatgcacacgtcacatcagcatcgatcacacaccccactcacaccacgtacacagtcacacacgcacacaccccacacatgcacacgtcacatcagcgtcgatcacacaccccactcacaccacgtacacagtcagacacacacacacaccccacacatgcacacgtcacatcagcatcgatcacacactccacgtacacagtcacacacacacacaccccacacacatgcacacgtcacatcagcgtcgatcacacacccctcacacacaccacgtacacagtcacacacacgcacaccccacacatgcacacgtcacatcagcgtcgatcacacatcccactcacacacaccacgtacacagtcagacacacacacacaccccacacatgcacacatcacatcagcgtcgatcacacatcccactcacacacaccacgtacacagtcagacacacacacacaccccacacatgcacacgtcacatcagcatcaatcacacaccccactcacacacaccacgtacacaggcacacacacacacctcacacacatgcacatgtcacatcagcgtcgatcacacaccccactcacacacaccacgtacacagtcacacacacacacaccccccacacacatgcacacgtcacatcagcgtcgatcacacaccccactcacacacatcacgtacacagtcgcacagacacacaatcacttcttgaggcttcagacaggttgctttatctagggcaagtcaaagtttggaaacagaagaggtcatgatggattgttgtgctgtttcccttacgtgtaaccatggttagactttcttgttatgtaactgagaatacttggtttttggaaaataaaatggagagcactgctttatcttggagaataatatcctcatgcatgtggagaatgcctttaacttttccaaggttcttcctacatgttatttgaatttcctaataattctgaaaggtagattttcttggcattccccttattttaaagctgcagggacagaagtttgcgttacctgttcattaggggcatagctgagtcagggattctggaccctcggttttcgctgaggtcctgtgttattaatcctatacttggcatcttccacacagccagtctgagaaagcacagggcctgcagcttcctgggacagggtctcagacacgcagagaccatcaggaggagttcactctgctattaacaaatgtttactgagcacctgctacacatcagacactactccagccgcaatagtccaaacagtcaagaatccctacattctatgagtacaagggaatggtgagtgaatgagtaaaacacataatgcatgtgtcagatggtgattagtgccaaggagagaaagaaagcaggaagaggggtagacagaatgctgggagtgaaaagaagtgggaagaggtgttattgaggggtgacattggaacaaagatttgaaggtgctaagggagcaagttttgaggatgtctggggaagagaagtccaggccaacagaaagatcaaggagtgtggaaaccggcatgcgttgccttcctgaaatccacagagccgcatactcattgcatgtgtgtgtgtatttgaaaacttcttaaattctgaggttggtacatggctttaatttttgccttaatggcttcctgcacttggggagctctttaataggtgcattctggtagtagtaatcatcagtcctgggctggtatcacattacctatgtggaaaaaagcagaattgctttggcactgattgggtcttggggtggtgactatgttttcctggtttttaatgcagatcattgaaaacatgtcagggcctggtctcaagtgtttctcttaaatgggatagaatcatgttcttataagcagagggtgtaggaagggactaggtggggggttggtgggcagaagggttcttatattttaaatgccagtcagctgcaaccactagttaactggagcctgttcaaactcatttggagaacagttgaatttttaaagtgccttttgattctctctttcatttattttaactgatctgctgggattaggagcttggtaggggaacaccagaatgcttgccaaaatgtgtgaataattagagctgcgatgatgtgtgccagatagaaggggagtattcacacttctgattagattcagctaaatgcagttgtaaatcactgctgccacagtaacagcgccctgtcaggactgagcacaagaggaggctcagggcagtgaagagacgcagggcagccccaaggcatggggctggaccgaacctttgtggaagaggagggcaaggagaatggctccagtcaccagcagcccctgggacattggttttggcatctctctttcagctcacttctaccgtgttgagtcttgctgggcactgaggtggccaccatctcagcaaatgcgagtaagacgggtccctgctctcgggatgcttacagtctcacggaaggtgaatgcacaactgtggttcagtgtgatgcatgtgtccgcaggacagacattgtgctaaagggtcccagaggaggaattgggcctgctgaagggaaaggagaagggataggtggaaaggcagttatttccttcagagataaaagttgacatttcagagtgctcagcaagataagttagtggctggaggagttccaggcagagggaacagcacatgcaaaggcacagacaggcaaagccccacccagtctaagagtgcagtcctccaggatggccggggaactgggaacaacatggaagaggctggcggtgcaacttggaaacactgcaaataggttgggtcagaatgtgaagggtctcaagtgctcataggaggaagctcttcttccaattacgtaccactcccaagatcccagctaccccttggagagggtgggtttcccacctcagccagagaaccctgccttagccacagtcatcgatgggaatgtgttagtattctttggacaggagaaataaatgttgagaaccattgctctcaccagtggagagtcttaggaggttaagaaggtgaagaggaactataagatggttaagttaaaaagaaaactggcagaagctttggtgtagaattgttagtttacagcaaggtaagtctgcaggctcccagatgtagataggaggttacagtcaaggtctgaccaaatgatagaatccatttcaagagagatttcagagtggaatccagtcagacttgttgaggaagactccagctgtgtgctgggtttcttgctcctttctgaaccatccttgcctgatcctgacttttctgtacgtgtggagtgccatagctcaagacacgatgtccttcggaaaatagacagtgagtgtatatgttttacagtattgcccaagaggtggaatcctgtcatttcctaatcacaactacacgtttcctccctctccagcactgctctgctccctttacctaaggttgctaaaggtactggtggtcttcaaaaaaaaaaaaaaacaaaacaaaaagcaaatacccacctcttactcaggacaccccagtcagtggatgccttctctggcccctctcccgtcctgttcttggaaaagcagcctactttctctgtcctgatcatgcaacaagttgctctgaaatgaaccagcagcttgtggtgggaataaaagcccaggaaaaggaatgcagaaggaaagtgatggaacggcatgaaacccaaagcaattgataaaaatgagcaccacatggagaatgtggaaaggagaggcaagcataaaaatcacaaccacatctgacatctctagaaatggagagagacaaatgaaatctcacatgtggctttcctcaagtcagaaagattccgcttctccattcaggggcgggatgaaggagcctctttggaagccgtgggcctttctcaagttgttctaccacgcctttcatttctcccgcttcagccagtaagttcaagtgcttagagaaatgcttagcctctagcaccttctccaggcacaaaataatgggttgaccaaattgataattttttttttttttgagatggagtccctctttgttgctcaggctggagtgcagcagcatgatctcggctcactgcaacttcagcctcccaggttcaagcgattctcccgcctcagcctcctcgagtagctgggatttcaggcatccgccaccacgcccagttgatttttgtatttttagtagagatggggtttcaccatgttggccaggctggtctcgaactcctgacctcaggtgatccgcccgcctcagtctcccaaagtgctggaattacaggcatgagccactgtgcctggcccgaattgatacctcccaaagtatgcatgaaggacaataatttgagatatgaggaaaaaatctaaaatgactttttctacttatttttatctcacctattcagatttatttcgtgaatgtgtattttagaaatacattagtatactggtatatcattaagcatatcaataagtaaaaatatctcgggcaagttaaatgagttatttgtctgtttttactctggggggcacatgatcagaatgtgtgaggactgggagagtagttagcagtgtcactagctgaatgtggggccaggaagaatgctctagaactgtgagtccttgtggaaacaggggcattaactggatcggctgcctccttctagcctatgagatagcctgttagcttcccttgtagctcaaagagcccctggaaatcagtagtcagaacccagagaaagggaagttctacccgtaaaagagatgcccatgttttcttagctgatagtcactttgcagagccacacccacaggtgacaaaagcacagtggaacttaccctcaggccctttcaccatcacaggcctctcttctttcctggttttgtcgttgggtaggggtggtggtgttgcctcccggaaccctcatccaggctacatgagacatgcagacatgctccagtgtcatgaacctccccctcaacagctccttcccccctttctccacaacacaaacaaaaccatcaaactccatatgattgttataatctaactgtggagtcaggaatactgtgctgccctacgtgatgctcttttcatttttgcagccatctagctttcttttccccctaccccagcaacccacaaacttaaactccaacctagttcaacctcagaaatcccattaatgtcttagaggcaggtggcctgaggagcccttcacttctgctgtcagctgtgtctccatggctcaggaacttaccctcccacccagccaggctgctttccctgtcaatagcattctcattccctccatgtctgttagaacttgaccattagtcaagctgttcctgagatgtgtctcttgtagagatgtacactggttagaaatggaagcacctccgtgactttcctctccctgtcatggtgacagcagtgtgacaggtttgacagttccagtttctaggacctccagctgcaagtgctgcttcgaccatgtgcttacgaattgcttcaggtccacctcgtaccctttccctctccagccatgtttatcttggctccgtattaatggcacaccttctgaatgttggacaaagatagtagctcttgtgtaagaacacactatcgacagcaaatggaagatgttacactttaaggctgccagttgtccccacttgtgccatactgaaataggagatggcctgcatctgtttgaaagaaattgagtgaaataatagttggtgagtatagtcctgaaggcagtgaactgtgatggaatcaaggatctcttcctgttagagtgacttttgcccaccgcttccagtggtgcttgtagaacttaggatctcaagaatattttgtgtcccctgcagaaaagtagcaatgcaggttgttcacatccagaggtcatgactcccaacagactttgtttatagcagcccaggctcagtgaggtgtatagtgggaagggcccagtaccacatgggcagagaagcactcattaacttcctacctggttgtaaacattagaaagttcccattcagaaaagtacttaacagcaaatatcacagctatggtatagtcctgttctgaagcggatgtgttttacaggtgaagacttcaggaaaacagccaaagaagatgtgatcttccaagatatcatgtaccctccattgtttgtcagtagaggagttttgggcatttagggtagactcctcccacacatcacaaaacacttagcaacactgctttgcccattaaataccagtatctatcaccatcaccttgactcctgaaaaacagtcccacacagttgcaagtgctccccagggtggggaggaaaggagcacttctccagagggagaaccaggggaaacgaggtagcagcacccataggtgtgcctgtgcactgggtgcagctagtcggttatttcactcagactcttgatgattcaacacattttggaaagagaaagtttgtccccaaaagaggcacctgactggcccaatccattgtcacatgttaatggctgtcacatgacagccagttgctggatctgtttatgtcaccaaatagtcactgtctaattagacttacaaattctaagtgtagcattagatttacaaagtcagtaaactgtgatgtgtgcctgtgttatctttcatgatctgacagatcatgtttgaaaattggcccaagctaggcccagtggtttgtacctgtaatcccagctacttgagaggttgaggtgggaggatcacaacatcctgggaacagagcaagactcccgtctcattttttttttttttttttttgagatagattctctctctgttgtccaggctggagtgcagtggcttgatcatagctcgttgcagccttgaactcccagcccaagtagtcctcccacctcagcctcccaagcagctgggactacaggtgtgcaccaccatgccctgctaatgttttaaattttttgtagaggtgaggtcttcttatgttccccaggctggtctcaaactcctaggatcaagtgatcctcccaccttggcctcccaaaatgctgagattacaggcgtgagcctactgcacccagcccaaaattgtttttaaaaataaggaaaaaaaaaaaaagaagaaagaaaaccggccaaaatgcagagaaaagtttgactatcaatgcagcattactttggttttattttacatcagccatctcccctccgctcaagatttgaggttgcttgttagttgaactacttggcaatgaatttgtcattgaaacaaaaattttgaatttttgaatatgagaatttcattaataagtcatgaattgtaagcttgggtgtgaaaatctttataatactttatagtgagacatttctcatctgtcgtcttgcaggctactgcacaggagctcgagtacatagatttgttgtcaattaaatattaaagctttataggctatttttatttccttctgcttgcattccttcctccagctcctaatagccacatgtccagtctttaaatggagccaggtttagagaggtctaatgaagagggtttactgaatggggaaagggcagccaccgtgaccccatatcacacctttgccacacaatcagagacctctgttgaagctattctggaaaagatctattcttaccagaagctgtcctgcgctgtcagtgaaaagacattaggtgcaggtgtcaaacatgactaatgaggcatgaggagtcgacagcaaaataacagagattatgggcagagaggacttgcagatgaaatgtgaatagcagtgtagatgtgtgagtgatgcaggaaggaaggggaccggcaccgaggagcagtagctgtcccacttgcgggaaggttggacaatatcagttacttgattggtatcttctcctttgatatattaagtggacaaacatctaatgttttcctctcgaaatcatgagtttcctgcaagtgtttggggcttggtatccacgtttctgtaatcttctaagacaagccagaatctttttctgtttttatatttacacaggttttattgtgaaattgtcaggaaggatgaggcatgtttcactcattaattttcattgtcatcaaaacatcagagttacagtgcagtatcctgctattccagggcccacaggagctctgattgataacattctaccttcacaaaggttgtaatctaaatggaagaggctggaaaaagaaaaaagtatgattagttgtagttgtgtcaaaagctgcctctgaacagaccaatacactaagcaatcagagatttcaagagaggtagcagggcctgagactctaactcagtgaatcttgcttcaccagatgtggagtctgtctttggtggtttcgcagagcctggccctgagcctccatccactcagcgctcaatagatgactgtaagcatatttctatgcgttcattagcctcagggaggttgatttttacctcctagaggtgaattttaaagacttcctttttggatgagaaagagaaggctggtagagaaggaggagcagaagcaccatgaaatcaggtgggtgatggtttcctttcctggtgcttttaaccagttctcccagagtggagataaacatgaagttaatatggggaatgttgatcttcctaaatgcagctccaaatgatagacccaggacaggtttccaaacagctgttattcagattagaggcaaggacttgatgtattgctcccattagaaagtgtcctaatggaaagggcctgcactttctcctggccccatctgaattaaacaattggagtattttaaatcaagggtcataagtgtcaacaagatggagagctttgcctctcgattaaaagaggcttataagttacttaggaagttcctgccgacacagattgcacgtggctcctgtgaaccgtggttatacccaggctaagtccagccgttgtcctaaggagggagcaggccacctcagacagaaaatgcagctggagaatttaagtctcacatgccaagatcctgctaaccagagggtttgggggaggtaggacctttcatgtttctctgccaacttgtccccaaggtagggaccacaatcctggcaggccgggatggggaccaaagtggcacttgcctttcataacatgtttgtgcttgtttccgtatcagtaatgtcttagctccttatcaggttaattacccaccccttctttccaggctccgagtagaagtcatgctccaagaccaggcgctggccttgaacgtgatgcctcctcctggtttgtaccttgtttgagatcatctcaggcacagagcactggaacacggggagccacgtgatcccaggtgcaggctgagccaagcatgatccctggggtgtctttttctcccctgggactgacattaaaggtgcaggagccaatcaggatcataacagaaggtagaagatttccccagattgagaggagaggagagaaagagcagggcaagggggtggtgaggagcgagagagcagagcccgaacagcagtagcgagggcaatgcatctggagctacaaggacagacgtctctaggtagatgcccttatggcagcgcttctggagagagaagaaaatcccagtaatattaacagggctacaacaaatgaaaattggaaaataaacagatggaacatgcctcatagtttagcttttatcatcaataattctaaatctgcaagtgaatatggctaactgtagttcaaaccatctgcctattactgcctctcacttgaagagactgtgttgcatcccactctccaccaagactgagaggaagggagggagggagagggagagagaataattattctcagctgttctgtcaaaacagacacgtgctccgcgcccagcgtaaaggtcaactgcagatacaccatctatctctggagagggcagccagcagtcccacgctgctctcctgggcttgtggggaccccttctggctgcccttctgagttcaaatgtaagcgtctaacaggcaggctctgttgtttatttcggggctgagattcagcagtttcttatctatatgggggaaattaatgcaggtacatgtatggtgtgtcccaacctactctgggccatgtggagtcccctctgtgcctttcaagtcttctggaggctcatctggggtccagaacagtgctgtgagagatgaaaggacacgagtgctgtcccagcgcagagagctcagaatctggggaagcctggctctccaagacagggaccactgatgctgagtgagcaccaacccaaattaggcctggtcttcaccaccctcttttggaaaatgaacattttattcagaaggcaatatggtaagaaccttgaggaaataagtgtaaattgtaaatcagccacaaactcagttttagcctaccttgccttgcgtattccctcttgcaagactaaccagagaaacacagaatcaagcctttatcatttggtaaattgtttcatcaagaatactggcccaagcatggtggctcacaactgtaataccactgctttgggaggctgaggcgggaggatcgcttgagcctgggagtttgaggccagcctaggcaagaccacatctctacaaaaatttttaaaattagaaaaaaaagaaagaataccatatctgaggtgcagatgagtgtgcaagtaattctttttgttgttgttttaacatgacaacagctggcttttttatggagcttccctgaacattaaaaaaaagtaactaaggccgggcgcagtggctcacacctataatcccagcactttgggagactgaggtgggtggatcacctgaggtcaggagttcaagaccagcctgaccaacatggtgaaaccctgtctctactaaaaatacaaaaattagccaggtatggtgacgggcacctgtaatcccagctacttgggaggctgaggcaggagaatcgcttgaacccaggaggcagaggttgcactgagccaagatcgcaccattgtactccagcctaggtgatggagcaagactctgtctcaaaaaaataaaaataaagaaaaagtaactaagacataaaaaccaacccaaaataagatggggcacctgaaaagtgtatgtgtacacatgtgtgtgtgcatgtacctcatatgggcaatgcatgtgtggacacaaataccaaaaatattccaaagacttaattttttaggtgttgactactgtttgttcatagcccaatggtgttaacaagcagtagattgttagtgacaatcacactctctccagcacttacagcagaaggcttgatttaatcgaagagctgtcatttattattctgttgtgcaattccatgggggtagctaactgatcaagctcgggctacggggagcagagggcttttttttgttgttgttatgtctaaatcctcaatacaaattacagtatttctggactcccagtgggacccattagagcctgtggggcattaacgatcattaatagtgctgtcaaaaaggaggggggtagggagagaaggaaagaaagggagggaagtgaagaaagggagggtgcagaatagtagccagggagaagtgtggctttttttcagaaatggaaaattaatacatctgctttgttcacagtgccgagcatttgatgtttattaacaggcatcttaattttgcagattagtaccagtcgggttcttacttccgcatattgaaatccttccattgcctcagatccttcttctcttttcctcatccttcctccgccttcccaaaatctttctctccccagtagtcagtcctgaatctccaactccaacaatgaagacagaaagggactgagaaaatatgagtggggagagtgtcttcattcagaacagagtgtgtgcgcgtacatacatacaccacggttacagccataattggcaatcttgcctgtgatatcccattaactgtggttccttgtaagcatttaactgtatagttagtaatcaggtagaaatgttttaatcacttactaactagcatgcttatcagtgtgatggagaaagggcaaggtattaattagttaggataacatgctaatgtttgcattgtaacacttctgctatttaaagcaaggaagaccctgagtttgagtcttattcagaactgaagcctttttctagaatttttgttctctccaaattccatatctatgctaagctgacttgccttttgcctccctatggttgcatacttttctcctttcattatatttttcctttcagtctcggactcttgagatctagtcttctacatccatgacattctcaaaccacagaaaggaattttcccacaataataataggtgtgcattacactttctttcttcgcagcaataagtgccattacttcattcaagtgttgagtacctgtgatgtgctgggcactgtgcttgacacagggaatacagcagagggaagaaagaaccaaggcaccattcctgccctcatggagcttctgctatggtgggagagagacttgggaatcccataagtccatttagaatcacagccatggtgtatgggagaggcattgggactatgagagattataaggtattctgacttgggaggaaggttgggaaagtaccctacggaaggtacagttgagcagatagaaaagaaaaatagattgctgattactttgttccaggaaccatgttaagtatttttccatggattatttcatttaatccttataacagttctagaatatagggaggattctttagtttacagattaaactaaggtttaaaagagaatgagctgctgcctgtctggcccacggtataagcctactgcatagctcattgatgaatgaaccccaggtatggagaatttgacccttggatagtaactcttccatcttctctttttcgtgtcttttgacatttttgagcatagataaaccaggctgaccaatgcagccattttactctcatcaaggactcagaatggtgtgggtactgtgcacttgtttgagacaatgcccttccttgctgatagcttcccgaattgagcaaagcagatacaaaaaaagtgagcaagactctcagcctacaatctctagtgtggaagaaacaccctatttctttgctttcttacatcaacttcattttctacttgaaactgtaccccctaaagggaccttgcacttaagtcgttcccagtgcatcctacatccctagagttgtgtctgtgttctgtgtctttttgccaagggatgttgaaggctggaagtcctctaggtcttaggtcccccagatcactgtgggaagaccccacatccccatccctgtgagccaccaggagcctggtgtggccatttctcctggggccttgcttcctcctgtgagccattccagaatagggtgtggggccctggtgctctgacagccacagcttcctctgcttctccattctgggtgaatcttttccttagcgaagcccttccccatatcttaggcactacaattctttacttaagctctcttaaactttatctttctcattccattagattttcatggccattgaacttagcaactgaagaaaactagtttccctttcctatagggcagagagagctttagtaaccaaatgttcctaggaggagtggggaaacatttttattttcattccagtaacacagtggttctcaaagagtggcccaggtacccaagggggatccccaagaccctgtcaggagttctccaaggccaaaactattttcccaataataagacattatttgcctttctcacttactatcattctctcacaaatacatggtggggtttgccagaggctacatgacatgtgatttaaaatattgaatgcaaaagcaaatatgagaatccagacatcttctataccagacattaaagaaaattgaaaaaaatgtaaaactcactaatttttttgttttgaaaaagttatttttataaaaatgtatttaacaggtaataggtttattgttatttttaaatgaataaacattttacagttttctcagttttaatttatttatttttatttatttatttatttatttttgttgagacggaatcttgctctgtcacccaggctggagtgcgatggcgcgatcttggctcactgcaacctccacctcccgggttcaagtgattgtcctgcctcagcctcctgagtagttgggattacaggcacccaccaccatgcccggctaatttttgtattttttgtagagacgaggtttcgccatgttggtcaggctagtctggaactcctgaccttagtttatctgcccgcctcagcctcccaaagtgctgggattacaggcgtgaaccactgcgctcggcctttaatttttaattagcatagcaaaagccttttggaagttctcaaaaaaaaatttaagagtataaaggggtcctgaggtcaaagcatttgcaaactgccacagcagagcaaaggaagaaaagaaaaaccaaacatcagatttccagacgaaatccaccatgccacaccggcaatttccaaatgcggaaactggattgtgtcatccagtgagagaaactgttacttggatactttggccctacctctcttattttttttttctcaaatttgaagagatcataataaaacaacctcctaaatctaggtaatcacacatcccagtttccctgggacagccccaacttctatatgccctttgtcctgtcataattttttatttttatttttttcattttaaactttttttcattttctttttttttttttttttttttttttttttattgagacagagtctcactctgttgtccaggctggagtgcagtggcacgatctgggctcactgcaatctctgcctcccaggttcaagcgattctcctgcctcagcctcccaaatagctgggattacaagcatgcgccaccatgctcagctaatttttgtatttttaatagagaccaggtttcaccacgttggccaggctggtcttgaactcctgacctcaagtgatccgccttgccttggtctcccaaagtgctgggattacaggcatgaaccatcacatccggcctgtcctgtcataatttttaagtgttcccactttcactcttcaaagtgtcctggtttgattgataaattaaaggtcagcctacctgaaccccacccaacttcatgagcttataaatgacaaagtaaatacaaaatttctatagtccagagagtcaagaaagcatcccatttggattgactggctgggatgtggcagagagcatgcatttatttgtctgtgaccttttcctgtttcagctgtgaatatgggtccccacgttgatctcagctagggagctgggtattaaccatcaaggcagtggtgaaccgggtgggcctcccacacaaaaagctcactggcaactagcaaatccagatggcgcacatatccatgtgatattagccacatagaggcctttgcggggctttttttggacattgctaagcctgctgagtctaagatttcaaatgctgttttgagctacttgatttagaggtgaagccagaccacttggagggaagtgtgaaattctttggagttcttcaactcacttgtgactctataaaaattacccgggggccagaagcaaggaaggaggtaacgcttcaagtggcccttctgcctccacagcacttttcagattagggagtgacaggggctgtggaaccgtttttccctcccgctcctcagtaggaaaacatcgaaacatccatactgtcagctgacatgatttggggtgagctttaaaggactaaaggactccccccagaaggctgaaatccttgttaagcaaggaactttcatctcaggttctaggctcaggagcatggaaattggaattctttttaattgaccatatggttagttttgcagctttgtgaagctataaatctttggtggagttgtaacccagcagaagtgtcaccagaggaaatttttttttaactttttcctcttgtttcttcccaaaactcacttaaagaaaaaaaaaaaaccatgcagcttttgatatatacacactggtgagtgaagtgtgggggggcagtaggtcttggacaagtgagcgtggcagggatctgtcaggcagatccagcagttccagccccattctgagagctcgcaatttagcttttgctggtgccagcaattataaaaggggcctactcagctttaagcactcaagtgttgatggacaaagtgctagtttaacagatctgcgtaatggggaacaggtggataaatacaggattagggagccctttacagtaacagccttattatcacatgttatgtggggtttttgccttcatttgacaacttgggttgtgtaaaaaaattttaagtaacacaacatagaggaaacccttcataacaaagcactgaaacaattaatcaagatttatgaaacctctgggtagtagtggtgtatcaaccaaagtggctatttctgatcagacccacagcctcctaaatgaataaatggagagcacagcaccagaagccacagcctccataagtggtacaattgttttccataattgaagatagcaaaagcctgtgtacgatcaaagaccattccattaggagagtgaggatgtaataaggggacagatttgagtctgcccagcctggaaggcatataatctatccccctgtctccaccacagcaaaccccactggtgaagcttactccatctcaaatggtggctgtaatccaccttttgcccttaggaaattgtattagtccagacctaacccccttattaagaggaagcacttttgccatagaaatcatctacttttctgtttccttttttttttttttttgagatggagtcactgttgctcaggctggagtgtagtggtgcaatctcggctcactgcaacctctgctcctggattcaagtgattcgcatgtctcagcctcccaggtagctggaattacaggtgtgcgccaccatgcccagctaatttttgtatttttagtagaaatgaggtttcaccatgttgcccaggctggtctcgaactcctgacctcaggtgatttgcccaccttggcctcccaaagtgctgggattataggtgtgagccactgtgcctggcccctttcttttaaatcaccataggatttattaaatgagcactgtatagatttgttttacaatttttaacctttatgtaaataatgtcctctcttttacccctttaaaagctgtttcttggctacataatatgttttggctgtttatctatatgagatagagctctagtttattttaactgctgtatattattttattatgtgaataaaccatactttattaatcctcctattggatatttagattgtttttcatttttaatataatgacgaagtccacagtcaaccattgtttctttatgccaaggattaggtttgctgggtgtgttagtctgttttgcattgctataaaggaatacctgagactgggtactatctaaagaaaagaggtttattcggcttatggttctactggctgtacaagcatggcaccagcatatgcttggcttctggtgaggcctcaggcagcttccaatcatggaagaaagcaaagagggagccaatgtatcacaggggaagagagggagcaaaagagatgccaggttctttggaacagccagctcctgtgtgaactaagagcgagaactcattcatcaccaagggaaagccattcatgagagttccgtccctatgacccagcacctcccactaggccccgcctccaacactggggatcacatttcaacatgagatttggaggggacagaacatccaaagcgtatcatggggtcataaggtgtgagcatcttcaccccaactgcttattgccagttgctctgcggtggttgaattcatgcgtgtgcctgggaagtgtctgagagttccctttcaccatatcttgctgaacattgactgtcaacagacattttaatattctcctgtgtgataaatataaaataccatctcactattccgatcatttggattttcccaattactagtgaaattgagcatctttttacacatttataggctattcaacataatatcctttgtccatatttttattgagttgtttatcttttttgtatttacctgtaaagctctttatatactctggatactaattttttttggttgtatgttttgtaaccattcattatttccttgattccctttattaagtaacagaagatataaccaaataggttggaagctatagcatatagagtcatgcaggtgatgctcaggagttaagagtctctcctgcaggcagtggggagccgttgagggttattaaaatgaggaataacatgatcagatttgctatagaaagaaaaggaaagcagcagaacagaggaggatggattgcagagaggagaggctagacggtggtgccaattaagaggcttttgcaagaatccaggagagaaataatgaggacctgaacctaaaccatgacagtgactcctaggaggatttccaaggatttccgggaactatttgagaatgggatgggcaatgctagtgagaattcagtggagcattttaatcagccctttcctattgattcacagagttcctttcccatcttgcctcggtgaggattgtttccatcatcccttggccactcaagtctacttaccgggttagagacttgttgggtctatgatgtccagttagatttcccttcaacgagacccagggggacattctgccagccattgacagatcttaattctccctttggctctcacttgttcccttcatgccaccttgtttgcctctccctgactctccctctctctctcttttctctttttttttaaattttatttcccatttttaaatcatgcacagtataatacaataagcattaaatcatgcaaattggtctaggttacattttgaaaaatgttaagaggaaactgttaagagaccagtttctgacaggcaatgcattttaaagttgagggatttgaaatatttcagcagtggacctaaaacagcattataaattagttcaacttatcagccctaaacagaattattcatcttccaaaagggtatttcatggccgctgggcccaaacgatcgttcaccttcatttctgccctgctctaagggtaggtctcactttactgaattctcctgattcattactgtgtgttactttatgaattttttatcagcattttaatagctctttcagatgattgaatgtaactgattcttgtagcagaacactgattgaacagagagacagtaatgtatgtcgtaggggttagcttcaagccaagcaacagagttttttacctataaagatgtgctttttctcccctcactaagagtctctgcagatagaagctgcccccctcctccttccacacacccgcaccttacccaccaggatttaggcaggaatctgccattttcagtttccggcatggtactgccagcaaagagagggaaaaatcagcccaagcctgaagcaccctctttttgctcatcaaaagtatgaaatgattaagatttcggaggttcttgggataagagaaagacattagactacctcagaccagcaggaggatggtctgtgggaagagcattggagtctgagccaagcatgaatctcagctgtcccttccttgctgtatcaccttgggttcttcgtctcattgtcctgagctttttcactttcctgtagatcagaataacccacctttcctggttattgtgaggattaaatgagaaattgtattagaaactccaggcacatcagaggcccctcaggaaatgtttgctacatatgaataacgtacacgaaagcacttgtgtggcactgtacaaatataacttattaatataagccacagtgatgcttgaccaagaaaagactttttataatactgtatgctaggttgaaccatatgagattctattttaatagacccaaaatggcaacttcatatggttcaacccaatattttacattgtttgatcatctgtttcctggttacaatgaaaaaaaaatgtgagggatttgtgtttgggtagtgggggaattatatagctataaggaatattagagataattaggtgcaattttctctcctgatgagaaacccaaggtccagaccacactggtagtaagaagtagagatatgagaacacactcagttcttcccaaatcccaggacttatgcagcatatcacacagccttcctgaataagggatttgttttcttataacaagtatataaccggacttgaaagagaatccagatcctcttcagccttgaccaggattctttcttctgtatatgctcacctgtgtacagcacccaacactggggaggttctcaagagggtttcttagacaactgattgacttcaaatggcaactagagagaaatcaaaatgagttgtagacattggtacatgggtttggtggtatcagataagtgaactgacacctgaatcttagctgcaaatcccagccatcatttgattcttggtgtgtcttctacctcaaaatgatacaaattggagttgacatgagtttttagggaatctacagaaccaactagagttcagtgttttggggcaaattgtatatacacatatatacaaattgcatatacacatatatacaaattgcatatacacatatatacaaattgcatatataatatatattataattaaataaaatatatataatgtattattacatataaattatacatgtataatttgcccagaaacaatttgtgtccagttaatgatagaaattgttcacttaatatacacatacatagtttgcatatgtatacatatgaatacacacacacacgatttgtgtccagttaatgatagaaattgctcacttaatcatttgtatgtatacatatatacatacataatttgtatatacccacacacacatacatgatttgtatccagttacattaatgatggaaattgctcacttaagctctgaaagtcatcaaccaatccagaaaaatacataaatggaagaatgggctggcaagaaatgagtggaagtgaaatgtcttatttggcaaatgaaaatatagccatttgggcagatacttactcatgaaatgctgataaaatacttgaatcaccaatatccttgtttgcttccctgtttatgtcaacatcttaatgtgaaatataattacaatgaacattcagaaacagaatggcaaagcctggctaaatttattctaatgtccattcttatgctgaaagctaggtctccaaatgtacttctaaaattattttttacaatatgtactttaataggattgcaggattgaaatatagcttttgtggggcaatcaggacgcaggggagaagttatatgaaagttgggtaaagattgggggattttatggctgattttcatgatcctgctaaatcatgtggtcacagtgggatgaatgaagaatgaacactagaaaaacgtgtctttttgggctgggtgcggtggctcatgcctgtaatcccagcactttgggagaccaaggcgggcggatcacgaggtcaggagatcaagaccatcctggctaacacggtgaaaccccgtctctactaaaaaaatacaaaaaattagccaggcgtggtggcgggtgcctgtagtcccagctacttgggaggctaaggcaggagaatggcgtgaaccaggagccggagcttgcagtgagccgagatcgcgccactgcactccagcctgggcgacagagtgagactccgtctcaaaaaaaaaaaaaaaatgtgtcgttttgtttgtttgtttgagacagagtctcactccatgacccaggctggagtacagtgatgctatctcagttcactgcaacttccgcctcccggattcaagcgattcttgtgcctcagcctcctgagtagctggcattacaggtgcacaccaccacacccagctaatttttgcatttttagtagagacggggttttaccatgttggccaggctggtcttgaactcttggcctcaagtgatctgcccacctcagcttcccaaagtgccgggattacaggcatgagccaccacaccccgccaataatatgtacctcttttcacccatgtagttactgcttatggacttttctccattaaaaaaaaatcaaaacactaaaagcctttatttacactgtttgctctttcttttacatctactctgtatcttcttcctaattaagaatagttgggaacctccagggtcaaatagaaatggtggcatcaacacggtcatagagaactctgatgttcaaaggacatggccatggaaaatcaaagggaagactaataaagttaaaggaaagtttcaggtttgttgggcccaaggactcctgaaaggataggattaatgtgttttttgagccaaagttctgcccttgaaagggaaatctcctctgagctttgagtagctggtgctgcatcctttaaaaatgtattggatggaattaatagtgagcgttgccacatcccttcttcccagcccaaccaagaaccagggaaccagtcattctgtcacaaaatgaatagaagttatatccaaatgccaataaaacccagttagaatttaatgtaggacataactagagtgttaaatatgacaaactaactttgagataagtctgagagctcaagttccaacagaaacaaaaccttttatggacaaatagcttcgtatctcatatgctactcccaacagctcatttagatgaataatacagattctgcattggatctgtattggatggaggaaattgagacatagagcagttgtgacttgcctgaggacacacaaagttagtgacactggcagggttctaccatatcactttacttaatatgagcagcttctacttgattgggtgttctgtcagctggccatgaggaggggcaaaggaagccattcaaggaatctgaattgccaatgaggctgttagctgagtctactttttgaaataacttcatcatgatataatttatgtatcataaagttgacccatttttaagtgtgcaattcaattagttctttatatattataaatacaaatcctttatcagatatgtgatttccagatgttttctttcagtctatggcttgtcttttcattttcttaatggtgccttctgaagcatgaaagttttctatttcaatgaggtcctctttatctctttttttatggttcatgcttttgctgttatgtccaaattcaaaggaatgttttttaaaaataagtattatcaagtcttgttctctctctttctctctgacacacatgcatacacacacacatgagcaagcttaaagtcctgcatgaccccagatttcatctggaataaaacccaagtctgttgctgtggcccacaaggtcttccctgatctggcacctgtgcctggtctctcctcagccacatgttccagcctcactggcctcatttttttcctggaaaacgctaaatatgttcctttctctgggcctctgcttttgctgttttctctgcctagaatgttgtctccagcaattcttgtagctggcttcctcctttcatccaggtcccacctttagatatcacgtgcatcatgatcacgccttagattattcaggagatatttattctactaaaagagccttcttccagccaataaaaaatacccttttaaaaatttccttcgcagtactttctgagattattttgactttttaaaaatttacatgtgagcaccgtggagaccttgtctgggtgctcactgcccctttcttggcaccttgagcagtgcctggtacaaatgagcggctgagtaagtatttgtggaatgctcaatgaatgttaaactgagaagcagttcagagatcagagtcactgtttaaacaaatcaggatcttcaacaattctttcctaatgagcctttctttgtcaaactcatttcattccaatcactcctgtgtttcccccacgcttggagaaacaatctttctggtgcttcctttcattttttttgcagatgtccttgcattggttcatattcttttcttccttggaagtttcccaccccaccccgaattaggaagttcctcagggacagaatccatgtcaactactttatcttctgtctctccatgcctagcaaatgctaggtgtttggtcactgagtagatgaatgaatgtacatccctgaccttcacccttgttccttgagtggagaaaaaagaccccaggctgtgtgtactcttcatttctggaatgagggttcttgtacatcccatcatcagctctcctgggcttttattctgaaggctagtggaggcacaactgcaaaagactttgcagatacgacgtgtgaaatgccaagaggaagaaaaattgaaagcaggagttgcatcttgccatgtgatgtgaatacctttctggcactatgacagtctcctcatggtgggcagtgggataccatgtgagaccaagcaagggcccaagtcacctgcagctctgagatgcctgcagaattctgtggaaaacttcccaaatgcacttagaccccagggttttgatgatgttgatggttctctgttcagttttttagtttctgtcaaaatgtattatctaaactctttactcagtcctacctacaaaatacactttcatatttcttactaatcactttactactgaagtaaattttactagttcacttttccagtggactttgattaggacatgagaagtatttgttggcacctataggcagacttagatgcaatgttttactttgatgccaaaagtgggggaaggccttagaccaatagcatggcgtttgttattttagtttaccattctccctccaaacggcccatttcactgagactggggctatcttgctgcagcttggagtcaaacacacatggatgtgactctgcctttgcctctcagagcctcagtttcctcatctataaaatgaggctaatagtacccagctgatagggctattgagaggatcacatgaaataacatatcagatgttcttattacagtggttaggtacagagtaaatacagaataaggggtagctttattatgaggatttatatgattattagcattattattgctatggctgcaaccagtactaccaagaagagaaatgccactcaagcgaggacaactcagtaggtgtgacgtttaaaccaacagagaaatcagtgcatttttacttatttatacctttacctggttccataaaagttttatccctgtttctaaaaagaatgcatcaaataaattgaagtgaacacagaaagaaaaaatagcaactaagaaaaaaacacagatatgggaaactttttttataatttcagctttcattttggattcagggggtatatgtgtaggtttgttacttgggtatattttgtgatgctgagatttgaggcatgaatgatcccatcaccagatactgagcagagtacccagtaggtatttctttagctcttgccttcttccctctctccactcctctagtagtccccactgtctgttgttgccacgttttgtccatgtatacccaatatttagcttccacttacaagggaaaatatacagtatttgtttttctgttcctgtattaatttggttaggctaatggcctctagctgtatccatattgctgcaaaggacatgattttgttcttttgtatggctgcttagtattccatgatgtatatgtaccacattttctttatccagtccactgttgatgggcacctaggttgcttctgtgtctttgctattgtgaatagtgttgcagtgaacacatttgtgcatgtgtctttttggtagaacagtttattttcctttgagcgtatgcccagtaatgagattactggatcaaatggcagttctaagttctctgaaaaatctccagattgcttttgctgcagaaaacttaaagatcatgtaattgccacaactgagcttcagattttaaactgagattcctggcagccaaggtcaacttcactacataattaatttaagaatgagaccgccatttcttcaggattcaaagctgcttctaaaactaatttccaagataactttcttacctgggactttatgcagtgaacagtattccaacaacatgttctcctcaaatgcaataacagattttttatggctgcttctggtagcacctttttgataatagcaaagcagcatggcattaaaatacaatccggtgacagcagttctgtgtggggctaaggtaatatggccctagtgtgtagctgtgaggtggtcagacttgatccagggatagaatgtagagtgttttgaagaatggttgaactgcttgtccttcaaataatcttttgtaaatattgcttttctcagcttgccttttgataggagttgaatagcagacagtttgagattgtattctctgacaaaagcctggtgtgtttgtattctctgttcctggtccagggcagagccttatgccttagaaatcagaagtgcaagtggtaaagttgacatcttactgtaaaaattggactcctgcctgaacagaaggccattctccctctccctaggtggagctgcaggaatacttgcaaacaaatctagactcctcttcaggaatcagtttgggggcgtctaggggtctagtgtggcattcagacttgctgccctgggccttattcagtaggtctaaactgcagtgcagcgcactctggttaggggtagattcagaaggtaagatggcgcaaggacaagctctagcctatagctggaaagtacaacgcaccgtgccccacagcaccctttgagagacacctgcccagcaggaaggaggctgcactggaaacatcacctgagcactccaggcgaaaaccggtgaatcagctctagagggtggcttagatctttcccgcctgggtttctcactgccctgccccaagcagtagaaactgtaattccttcacacaagtctaagcaacatgatttcttcataaacctggcagatcaactggctataaaattttctcttaagaaattaaacaaattaacctgttcagtgaagttattcgaacaaaatggttacatttggaggcaacgctactattttaggttgctgtagttactgttgagtcattctttctgaccatggatgccaagaccatttatctattgacactagtttatgtcaaggtctataaggaagaacttgtgttaggtagagagaaaataataaagcagaaaggaaccatgcagatgatccagtacaatcttcacattttccagaggcctggaagtatttcctcaaagcctgggggaagtcctgactctcccacttacaatggtcattattccatgtgaagactgtttccaccatatagttggtcaggtatgtgtattagggagagataaaataataaaatgaaggtggctgttggattccttagaatccaggggcctcatccacattgataaatatttatcttgttctaattaggacctacatgcctacattaactggtggaagagctctcagttgcattaagctccctggcagaaagaaatggcctggaggctgcttcctctcaagtgagaaagggtcttccaggactgttcgaacaaaaggcatcagggaagtacctcttgagtctgtcctgtgaaagtcaacccagtttcttggctttccaggcagcctcacattgccttgactattactccagttcattaaatgttaatgggttatcaatataggaagagtaatcccctgaagtccctttaatatgttttattcttcctctcaaataaatgattgattaacatcaataggaattgttcaatatatgctgtctgcaagactccttgctccttgaggctttctcctgtggtttatagcccagtgcagacgcctcgatgagatcttaaatagagagagtggtaaaagtttatgtcagctcgtcagtgaaatggaggtggggaaggatctaataagtgcactggcttgaggatgatggcattttcataaatcacactgttcttttccctcttggtcggtcctgcttgtagaatcatagtatcttagagatggaaagggccttgaggttattttttccagcttcccattcttcaaggaattccttctatagctttcctgacagacagtcggatagcacctgcctgtacctccagggatgggccttaccttcctcctgaggcacgccttcagctcctctgcagttctgctagtggaagattttccccattccatcagttgtcatagttcctattcctttttctcacgactcaggttagagttgtaatcttccatttatttgattgcctctcctaaaagactgtaagctccaggaggccagaggccctttccttgttagctggccattccatatcatgccttgcccattgaagggactcaatgtatatttgttgaatgaatgaatgaatgaatgaatgaatgcacttaagtttagaaattccagaaagaactaggaagatattacataacatgaaaatggaaatagagtattttttcccagataccagctgatgtgctcaagatgactttagggtgaatatggaggaaggagtgaggggaagtacccaggaaagagtgacgggttatgactgagcaacattcagagcatgggaaaaacaaaaggatcttgactttttaatgcagcctggtaaatatcattgagatttggcaggaccaaaactgagcattggaaaagggatggaaaagtcttccctatgaggaaaggagcccacttgtggagaagatgaacactcgcatggaagcccacagaagtgagagaggtggcctggaggagggcactcgagtgaggagatgggcacctccagccttgggtcagtcacaaaggaaggacagaggcaggaaacaggagcattctggacagggggccctggccgctgctcacagcagctcatcttctggcgggagagggttagctcctgcccagtgtcctcacgtacgagagtggtgagtttctaatgcatcacctctcaccatgcaccccaagacagctgctcttctgaatcctacctagagaaaaaaaaataacccacacaattctcgctgtctctcaacctcccacatctaatgagtcacccagttttgtcacttcatccttgggatgtctcttgacatgctttttcttcctttccactaatgtagctcagatcccaaattctctctgggaccatcacttgccatacgcagctgagtcacataaagaggttgcccttacacaacagatctctgctcactgttgcctaagacaccgcacgctctgctgacatcgtttattcttcctgaagagtcctttagttcatcacctggtgcttgctggccaggttctataccatcttcaagatcctgcttctgaggccgtgtgcggtggcttacacctgtaatcccagcactttgggaggccaaggcgggcagatcatttgaggccaggagttggagaccagcctggccaacacggtgaaaccccatctctactaaaaatacataaattagccaggcgtggtggcacatgcctgtaatcccagctactctggaggctgagacacgagattcacttgtctgggaggcagagattgcagggagccgagatcgtgccactgcactccagcctgggtgacagcaagactctgtgtcaaaaaaataaaaaatcctgcttctgttcttctcttcatgactgcccgtccaactccctctgccccctggcctgtgattgtgttcccatctgtaccttcttacacttacctccatctgccttatgtgtgcctttgaagttcctgcccttgcctcctctctcccgacaccctcaccagcctctgaatctctgaatggtcttagtcacacttgcttccagtcagccttacaccccagcattgtgttttacatacaggctgcactcactgaatgtttattgacttgaatgggatgtttcttcctaagacatcaattccatgtcttatgatttttcatgcttttcaaaatattttcacagagtctgtttcagatcattcttggtgctggtatcacacaagctgagctgccttcctggggttcaccctttgctctcctttgctcatctccgttgttctggtctcctccagaaatctgctgaggtgacatcgtctccagtgacctctgccaatttgttccaacatgggaatgacatgctgatttaaaacagttgaagcatactccagaatgactagaaatggtctcgtgtttgaagtttctgctcattggtggaagttaaaattccagtttctccagcaacatttggttaaatgtccctatccagcattggaactgctcactgatctctttttttgggggggttgaacccctgcccatcttctcagtatttcaagggcatagtcacttggctgtaataactgctcaaactatttactcaccagttttaagtatagatcagcctggtgtttatgtgataaaattctagaaacttcttcctttgcatctttctctacctgtgcccaccaagaaaaggagccgtacttcaccccatagccgtagatcaaatgaaaagaaataaatttctcacttgtctctaccctatgctaccttttcctttgttaaaaagggagataaaagagaaaagaaaacactggtctacataaatagcactaaatataaacagtggaaatgggcttctgggctttgaactctacagggaagttgttatggcaacctcaagttgaattcactgggggggaagtgtcagtattaatgagataagatcgaacttgtgactccaatggtaactgtattctccaaggtttttcttcttactgagacaagaagcaaagcctttattttatcagtgacatctagatttagaattgggagacaaattgtgtgggcattggggcctggagtttagtttccaggatgaggtttctatttctctgttgagaggaattagagccactcctaacacacctgctttagctattcttgttcaaagcctatagttgtaaatttagaggatgggtaacatagaccattaattccctaaagagacttgaagttcacttaaatttaaggattttttttttttttttttttttttttactggagtgttacacagatttttctatagggataaggtaataagatataattgatattgtaactgtccagtggaggttaagttcccaaaacagtgattgaccatgggtcaagattcccccaatgaagaagaaattctaaaatctgaagagagagagaaataaaaaaaaataataaaaaaaaaacccaggtaatggaaagccctggttgagggcgagaggaaagggttgcagagcacgctgagcaggtactgcctatggaagtactgactctgacttcagaggtggggagacagaggtaagagcatgaagtatgtaaatactcaaagtgtttatactgcattactttatcatggaagtaagtaatgtatgaaatttgcattatagaaattagactgagatgctaatcatttcttgttcctaaagctgaagacatctataaaataagtttctaattcggagaggtgagcaaggatccacaggttaagcagacttcaaaaatataccatctagtgccgggcacagtggcacacgcctctagtcccagctacttgggaggctgaggcaaaggatcacgtgagcccaggagatcgaggctgtagggtgctagttcagggctgttgtgcactatgattatgcctgcgaatagccactgcattctagtctgggcatcatagcaagatctcatcttaaaaaaaaaaaaggagtatgccctccatctagaaggggaacagtgagccccagggcacaaagagagggaacaaaaaagtaagggtgggcaaagcaaatgaaggaggataatagcaaccagaaaaacttcttcccaaatgttgtttatttgttgaaagagtaaactcattcataaactatggccatgtataaacaccactgtactaacccaaggagacataggagtgcctcagaacagcagttggttgactaatgccaaaaagggcctggagcctctcaaaaccccaccaccacaaacacatgaaagagctacttcttctgggcagacccttaaatggaaaagcctagaaaataccaacactgcaaactgaactactttgcaattctctccaaattctgtcttcaccatgctggaaaaatggaataaagaaccaaaatcaacgatagcagtgtagattgcatgtaataaagagctaaaaaatttatgtatttcatagcctacaaagccccttcataaataatctttgcaaagcaatcatgtgagctagacaggacagatagagtgactctcgttttacaaatggagaaagtgaggcttggagagccgaccagacctgctaaaactgtacagcttccaagggctaaacctggaacttgagcccaggctgaattctctgtattcagaccctctgctctttctatggcaaagtgcctcaagaaaccaggcaaatcgtacctataaaagaaatgtcaaatcacgcagaattcacataaaattacttgaaaaggctcctgcctttcatcccaggctgtccttcacgctgctggcatatcctgcaaatgtcatggcttcagtgcccagggttttgccagaaagaacatgctgccagcctgccgaatgaaggatgcgacttgagaagcagcagaatttggagaggaacaatggagttctccttctagggggtgggatcagtgaccatagttctcagggggcagtgatgaaacagggctttgtgtctattcaggaatagtatccagaagctcacttatttttgctttccaaataagtaaatatcagaaaggatagctgaggtcagtctagaaaattagaatttgcttgggggaaaaatatgttctggaaaagataaacagtagcttgcagtttcactgttggaacatttgttacaaggtcctggtattgatcttttatcacccaatttccactgggagccatgatgtattaccacactgggaagctctaatgcaagtgcgtgaatcaagggagattctagacaacatctgtagtgaggcagcatccatttgagggagggaagattgggaagggggtgttgctagctgcaaaattccaaggggagttttgcgttgtgctgtgtgcaaatgcatatccgtgctggggagtgttatgggtttatgaggagagtgattaaaattgtatcaaagaggcttatgaagcttatggttcaagttaactgtatgaagtaaacagcctttaacggcctcctgggagtgtgacagatagtctgtgggtgttacggcaacatggtactggtgaatgttctggccatcccaaactaatcaccatctgtgagcatgggtctctggggagcgtctggtggttggacaatcatggtagttagcatttttaatcagcttctgtgcggcacagatagaaaccttatgctcaagcctttctttttctgtctgtgtagaattacttatgatgatgatagcagagccgacaagggtttgggttgtgcctctgcaggatacattctgtggttctctgccctccctcttccccagcccccagcctgaccgtggaaattagcctggccactgcttatggtcactgcttttattacttctctttaccactagcaaaagggatgtcaggggaggggggatgtttctgggtttagtgggactgctgcctcgggtcaggatcttgagtttgagattcttctctctcctgctttcctctcctactgcttccttcatcaccaccacctctagctctgccccaacattcactcacccatcaggcaccaacttcttttttcttgttcttattatcgttgggaagcattacttgagggcatcgttggatgccctctaagggacccaggcaaaaggggaagtcaatggtaccatccctagaagtaggcaggcctcatggatgtttttgctgtgcaacagacttgagcagctgtgacagactgtaaggtctgcaaaactaaaagtatttgtgatacagccctttagagaaaaggttggctgactcctggcttagagtattccttattcttgagaaatatttgatctagcaaactgtactaagatgagacataaatatctaaatcagaatatacatttcattaggccagtatatgcacatttcatggtaggtaactaattcagtgggctgattaaaataatttattgtaacaaaagtatttggaactgcctgtaattaaaactaagatttattaaagaaacaaaagtcgccaggcctgcagacagctagatcctgtgcgtgagggttgtcttagtccattttatgttgctctaaaggaatacctgaggctgggtaatttttataaagaaaagaggtttatttgactcatggttctgcaggctttgcaagcatggtgccagcatctgctctgcttctggtgaggcctcaggaagcttttattcatggcagaaggtgaagagggagcaggcatgtcatatggtgagagacggagcaaaagaaagggcttgggggtggggttccaggctttaaataatcggctctcatgtgaactgatagaaggagagctgactcatcaccaagaggatggcaccaagccattcatgagggatccacccccatgaccccaacacctcccaccaggccccacctccaacactgaggaccacattttaccatgagatttggaggggacaaatatccaaaccatatcaaggatgaaaggagagggtgtcagttagcttttgttatataacaaacccccccaaaacttagcgactttaaacaactattttaagtagctcataattctgtgggtcaggcaggtgattgtacctctctgggccagctcagctgatctctgctggcttctgtcagtcatctgtggccagctggggttggctggtctagattgtttgacttacgtctggtgaataacaggctgattggtctggggatggtgctgggacttggctgggacagttcatctctgctccatgtggctcttacccttcagtaggctaacccaggcttcactgcatggcaatctcaggattccaaggagcagcaagagagcaggccccagtgaatatgcactttgcaagcttcagcttgtatcgcgttgctgatgagccactggccaatgcaagtcacaaaactggcccagagttaacgtgggaagtgaccccaaggatgtggatacagggaggcatgaccaaatcagaagccattacttcaacaatctctgcaaagaagagaggtttccttctcttcataatctctaccacctttcatggtgcctagaatttacattacagatttattcctttgggtcttaaagagtctgcagtcttcaagaggacccctgttatatgaaggtgtagttgttcaaccaaggcctacccagagcttagctgataactgagaacagggtcgataccagggtatcagacaccaagaaagaatatgaaagggaaggtgagaaggcactagaaaaaaatgaactattcctgcattcgcgtatccagctacccacaagaaacccctacgtggctgttcagggggcacagcaaatccatactgtctcagaccaaccccatcaccttgccttcttccttctctccaacatgatttttcattctcgcagcaaatacagtgcctcgtcttgaccagtgaagatggaaatgaggggaggtggaggtaaaggcctgcagaacaaaatggaagaaagggaatgacaggtaggaaagggtagaaaattattgctgagtctaagtattgagggttcaactcagtaattgattccatccaagtttaagacagtggacacattcctctgtttttttggttccttatcctttgcttccactcctgaaaggattataatcctcattcttgtagttgtggatggttatggccagagaaggccatagggacagtcatcaaggaaagcagaggcctctcactcaggagatgcctcagcattttactgtcttcaaagacaacagcccaagtgctggagcagccagaaaggaaccggcctgatttatttatttatttagagacttggtctcactctgtcacccaggctggagtgcagtagcatgaacacggctcacttgcagattcaatctcaagcaatcctcctgcctcagcctccctagtagctgggaccacaggcatggaccaccatgcccagctactttttaatttttttgtagaaacggtctcgctttgctgcccaggctggtctcaaactcctgggcacacgcgatcctcacacctgaccctcccggagtgatgggattataggcgtgaggcaccattcccagaccagcctgttttctaatgggtgtccacattaaatctgaactctgcctcaagttgtagctgctgctgagagaaccctggctctatgcttttctcacaaaagagctgttccagactgcccttagaatgttttctcccgtggcagaacagctgttttctgttcagctgtcccttacattgtagctctatgctggaactagctcgtgtttaatgctgtgttatgggtaaagccctcttgccttgtaggtgacactaataaaatcacagaagagatcaaacctagaatctctgccgatgcagacctcatagtcagacaaagagttggatgcttccattgctctcctagcttaggctggagctggaattctcacagcaaccagcagggagctggcaagtaatggctgctgtgtcctcctagaccagggccagcctttagtagcagctgagcgtgggagtggcaggcaagcttggcaccatgcagcagtgggcttccttgggtgctggaagtacagtcagggaacccttgttctgtccactctgcctacacaatggttgccttcagtctggagagtagtgaatggcaatgagtaatgagtaaagggggaccctcttcataatggcaggggctgggagccttctgggttgaatattttgtagcactcaaagagatggccaactaagaggtcgctctggtattgccttttctctgcctccacatcggcaggcttccagcaccccactattctggatctcaacattggacaagtgtactaatgttcaagcaggggcctgggtgagatggcctcatggtgccctgctggttgctgccttttgctgctcttttacaatccctgtactcaagggttgatttctgacgcctgggagggttggcactttgggaaagaccaatgagatttttacatttgagattttcagcatgtcaaacataggcaagacagaatatcggggagttattgggaatatgaatttgtttgtttgtttgtttgtttgtttgtttgtttgtttgtttgttttgagacagagtctcactctgtcgcccgggctggagtgcagtggcacaatctcagctcactgcaacctccgcctcccaggttcaagcgattctcctgcctcagcctcctgagaagctgagattacaggcatgtgccactatgcccagctaattctgtatttttagtagagaaggggtttcgccatgttggtcagcatgttcttgaactcctgacctcaggtgatccgcccacctcggcctcccaaagtgctgggattacaggcgtgagccactgtgcccagcctttttttgttttttaaataggcactaggagagcaatatctttacattttgttacctgtgaacactcagcacaggaccatataggtaatagtaatggtgattatggtgatggcagtaatgatgatgatgatttagtatgattcaccaacaggttataagacttcagaatgtcacgaactggtgaaaaaaaaatgtatatttttttgtaattgtaggaggcctgcatagagttgaattgctagctttttatattgccaagtaagaatttttttaaagtatgaataccataaactatcaccatctatttcataaaaaaaaaaaaaaaaagatgtaatgtactggttaagagttgtacactcaaagaaattctgatgatacctgggctagtaagctgtgtgaccttgggaaatttaagtaacttctctgcctcagttccctcattgtgaaatggggatgattataactgtaactaccttatgggattattggcagaattaagtgaattaatgaatgaaaggcactgagagcctggcacagagagcacttggtgcctcttatatttttattgttgtcactaataccaaagaacaagacatatataatattagaataagtaacaattctgcacatgaaaactgaaaattcactgcattgttgtgttgttttcttttttatttttatttatatttatttatatatttattttttgagacggagtctcactctgtcgcccaggctagagtgcagtggcgtgatctcggctcactgcaacctccgcctcccaggttcaagtgattctcctgcctcagcctcctgagtagctggaattacaggcacccgccaccccacccagctcagttttgtatttttagtagagacggggtttcaccaggttagccaggctggtctcaaactcctgacctcaggtgatccacccgcctcagcttcccaaagtgctgagattacaggcgtgagccactgcgcccagcctgttgtgttgttttcatcttacttggttataggccagtggtgatctgggagccactggtggaccacactggcttagttagtcttccttctttcctccaccaaaagacatgcagagcgttactgccttcccacccaataaagaggatggtaggtgagaaaataaagagctatactgtaagcagagcaactgggtttccaaggagggagtgtaaaacaaaggatctcagtgtgggagtgtctaaggttgaagctgtcccaaggcaataccttctacccctactctaaattaaaggagtcataactctttgtggttcctgtaaaagtagttaagaggccggcacggtggctcacccctgtaataccagcaatttgggaggccaaggtgggtggatcacttgaggtcaggagttcgaaaccagcctggccaacatggcgaaaccctgtctctactaaaaatataaaataattagccaggtaggcacaagaatcacttgaaccagggaggcagaggttgcagtgagccgagatggtgccactgcactccagtatgagtgacagagtgagactccatctcaaaaaattaaaaaataaaagtaattaagagtcaaagggcatcattacatagagacacaaaatgaaagtcagtattgtatgcgcctttgccctgttttagaccttcttaacatatgggagcccaagtagcccaaccatggtggaagagaagatttcatggcctttctcattggtcctcaccgtgaatatgcagagtaggcacacctctctgcagagaactcctctaagaaaccagattcaatgatctgatgatcccgcttctgctgatatgctagaagccaaggcttttttttttttttttttttttttttcagtagaagaatcaaaagtaggccaagcgcagtggctcacgcctgtaatcccaggactttgggaggctgaggcgggcggatcacctgaggtcgggagttcaagaccagcctgaccaacatggagaaacttcgtctctactaaaaatacaaaattagccgggcgagttggcgcatgcttgtaatcctagctacttgggaggctgaggcaggtgaatcgcttgaacccaggaggtggaggttgcggtgagctgagattgtgccattgcactccagcctgggcaacaagagtgaaactctgtctcaaagaaaaaagaaaaagaaaaatcaaaagtaataacaggaaggaatgtgttagcaactgtagagtattagatgtatggctgaccttccaaccagctagctctctggtccccagccccactccacaacacatcctcaggttcccagttcaaaactttaaggccgctgaaacccaggctccatgcacattcatcattttagccccactttcagacatttatatgttggtgctcatgccaagccaccttggaaaacaaggacaagtatatgttcccctccacctccttcccaccagtacccagcgtgaggtctgtacatagtagatcctccataaatctggtgtaaaacaaaataaaagcaggtgaccttctgtaaccaagatgtgtgtagctacatccatccactcccagtactacaacattggatttttgttgctgttaaatcaaaattttagtctttcagaattaattctctttgcttaaaattaattatgacaggttgtgttttttacacactgctgaaatgtgtaaagcagtttgggagaagagggcctcctttcctgagttgatttatgttatatatgcaaactctattaatgttaaaccatgcttttcaatgaaattaagactttccagcaagcagctctctccattttatttaaagatcctagtgactgatgcacattgtgcccctgttgctacgataggagcggaggatgttggatctgagagatctcatgcttaacccttaagtgagaagtagcgtgtggtgtgggaaggtaacacagctctctcctgtaagcagaaatcaagcggtggtctactgagagccattttattacttccagagaaccctgaaggtgaaatgaaggaggaaatgaaggcaggtgggaaattaaagaaagaggagcagaaatggaagtaagaaggacgtaaaaatttcagtatcttgagaaacctgactgccgaacaaaatgtttgggctgggaagatggagaatgcacggaggcctgcaagaacatgggacagccatgacatgtgggctttgttcttccaaagagataaatgaggccaggcatggtggctcacacctgtcatcccagcattttgggaggatcacttgaggccaggagtttgagactagcctgggaaatatagtgagaccccatttctacaaaaaattttaaaaactagccaggtgtgatggcgtgcacctatagtcccagctcctccagaggctgaggctggaggatcacttgagctcagggcatcaagtctgtaatgagtcatgattgcaccactgtacttcagcctgggtgacagagtgagaccctgtgtaagagagagagtccaggcgtggtggctcatgcctataatcccagcactttgagaggtcaaggcaggagaatcacctgaggtcaggagttcaagaccagcctggccaatatggtgaaaccccgtctctactaaaaatacaaaaattggtcgggtgtggtggcaggcggctgtctgccacctgctacttgggaggctgaggcaggagcatcgcttgaacccaggaggcagaggttgcagtgatccgagatggcactgctgcactctagcctgggcaacagagcaagactccgtctcaaaaaaagaaagagagagagagataaatgaaacatctgctccttaaagcagtaatagcatagtctttaatatcaggaggaagcgttatatgttttatttaaaggttgttgatttatgaactttgtacctgtctattaagagtctggttcttgcatggttaatgtgtgaagttttaaaatttgtgcttctcatgtttaaagcatgatacccagcaaggcttctgacaccagacctttcccatattccatttcatagagcatttcatagaaaatgtttcatagaacatgtcatagatatgttcttttcgtagaacagttatatattctttccttcatcaaacatggattgaacacctattgtgtgccaggtatagtgatgggttctggatgaacaaaacgggttttctttagttctttgtaagtctttgaccccatggaattaaccgcatagttaattccacaggcatccttggtaacatagccccctctggtaacgtagcagaccacagagtgacaggtggaggggaccgaatagtgagacagtcacctgggattctatgattccacgcccctgatgctttgggctgggggagttggctgctgtcatttgtgaggtagagtcgcaacctggtacagcactaagaatccatttccttcttctcagtgactcacttcccaccatctccaattgctctctggtcatagttactatgttgttgtttgccagcagaaacagccatgttgttgtttgccagtttggggctttctgtcaacctgaaagacttccttctctccagccagtttggtcttgcagattttgttgtgaggccaacaaccaggctgtgaactgcctaagcccagccagcccttctttgaaaagccctgtggaactaggtcatcaggttgttggatggttcttacacagactgtgctgtgctgcaacttttaatgtgcactgtctatggaataccaaacttgtttccaaactaaatagtttccaatgaggatttaatgggagtttttcatttgaaatggattgaaaacaagccatttcctactcccatttcaagcaaattttggtccaattattttcctttttttaacataaagttaaatggactattctgcccatccctgactgagctgaaccgtgatttctcttgattatgcttttacactgcgaatcgcgaggctccagagacataatgggcgtctgtgggagagtggcagcaatttttaaaatcctgccagtgcttgtcagcttccactctggtgtctgctgtgcgggaagaaagcaccccaccaaaagaaaaaaagtctgccaacaaaaccagcgctgcccgcctgttctgtgggggttggcacagggatgggctcctctctgcaaacctatgtagggcatattctcagccactgaggaagcccggtttccactcatccagccctactcctcccactgttttccagccattagctttttgtggtgttgaaggtttctttctcccttttttttccttgcctcaatttttcttggtttcacttagaccatagcctcagggaaaaggagctcttggcaccctgccttccacttggtcctttaccttcagcagcccagcaaaatggaaaataagtgtctcatagtccttcttgggtggtaggttatttgttgttgtgatattgttggtggaggtggtggtcattctcttggatttgcagaagtttacagaaaactcgggagaagaaaaggcttcttgctaccatcctctctctttgggaagggcagctacccccctagcagatatgtggggagcctactgggcaatgccttgtaatgggaacagcctctttgctctcttacccagcagtgccaagaatttcactaggcccactgaagaagaaacacccttcaccccagctaccattgtagctgccctaccattgtgtgcagcccgggggaagcacacagtcgtctctgggtttctggtgaaagtccattgtgcctgctcagggctccttggtgcaggagcagtcaagccttcctggaggttgaagatcacgtgctgtgtttggtggctccccacttgggtttccatcgattcatggtattggtttgggaggtgctcacatcctcctgcaagtaccctgtagtgaggcttactctgaggatgcagctacatctcaaaacatgactccacctcttcctgcaaaatcctgactggtacaactgccagcacatccctttgaccttgagaagggtaaagcacagaggtggtaggtgacttcattagcatgacagaacgtcagagttgattagcactcaggaaaggttgtctaatgccagcctctgcctttgtaaatgtcttcagcatcaccagggaggggttgatctggtctctgcctgaacttgtgctggaaaacagttctgagcaggcaccccatggaaacctctaattcatgcaaaagtccccccctatgaagtgaagtctgtttctgttgctttttcccactggtgctaccccttcctgagtccacgaaatctaaatccagtcccctttctacctcttatccctccaggcatttgaaagcaggtacttattcctagctaagctttccttctctaggcctgctttcaggtctttcagccatccctcctattgcttggtttcccagccctgcatccttctaattgccttcttctagacatgttctgatttgttgttctgtttgttctgagctctgaggtacccagaatgaggtgagagactgtcacagcccttgacagagacccatgccaccttttagtgaaattggctgtttcgatagccttaaaagggtcgttcatttatttcaagtttaatcgagtcattcttcacatacataactgctcaccttatctgctccacgtatatgtgtgatttgtcattactgaacctatgtgcaaaccacatttattcctaaagatcatcttatcaggataagaaggaacatattcatttctttagtctgcaaagatatgttggatctgtgttttatgatccaatatactgctatttccagcttcacatcatatgcaaattcagctcaaccactgtgtgccagacattgtgctgaacctggggatacagcaggaaatcagacagcacagttgcttccctcacaatttattgggagggacagacaattgactgtgcttttccaatccagggtgacagcacaaaagaggggaactgcagaagcgtagaggaaaggtgcttcacagactcaggctttctaggaaatgtgatattgtgagaagttggccaaggaaagagctagggattaaagtttgaggtaggcagaactacatatgcagtgtttgaaaggtgacaaaaagcacggtgtcttcaacagcttatcaccaggtaatgctcctgatcctcatcagtggctgatgtgaatgtggaacctaataggatgaaagaaattaccattagaggccttcatcatctgccttcgggcacatcaaacatttatgaactcacctaattgtatttttgtcacagccacgtttctctgccttgaccacttgaattgcatgtgaaatgtatttatgtctcactgaatacagacctgttctgtctatgtcattgctcaagtttaccaatctaaaaaaaaaagacttgttcttatgacttgttcttcataacccaggttggctttgagtgatcctaaaagcttccttccttcctgagagttcactagctctcttcctaataatctgttttattttccaagtcattggttaacgtagtaggttagtggcagagttgcacctagaccccaagtatctgaactcctagtctagacatctttcctttctattgctctgctcccccttggctcatctttccagagcagagacactacacaaggtttttttaagagcagctggtcagtccctgcatccaatgtaggaggcagcaagcaaggctagcagttacgccagggagaatgcaaagtggggtgtcctctttccaggcactggcgcaggccagctacatggcatttcatctccttagcaggcctctggggtaaactttatgtgttaaactttatggttaacagagccccctgctattcattgtctcctttatttatcaaccagccccatgaagtcagtggggaaatattcttgttcccatttagcagatggggctcaaagagtagaagagacgtgcccagaggcacacagttatactgagtagctgagccaggtgtcttaaatccaggttgtctgacttctggtgccccaagctgacttcagatttcttttcttcttatatcaatgatggcatcaactccctgacctcccccttctccagaatgttgcctgggtgattgggtaagaggatataaatagtaagtgaaaaaaatagattcagttccaagcactaaggggctgagacaactagacactgtggcagtgctacagacctttagatcatttttctgacactctctagctaaaaaggaacatggacaagtgacacccaaaagtccctaggcttaaaccaactgtcttgtggaaatataatataagtatgagctattctgagcaggatgacaggattggaattcagtaaagttttagatggactttgagatccaaataagggaggagtattataaagagctctataaaaatggtttaaggaagggtgtggtggctaatgcttgtaaccccagcactttgggaggctgaggtgggtggatcatttgaggtcaggagtttgagaccagcctgaccaagatggtgaaacctcgtctctactaaaaatacaaaaattagccaggcacctataatcccagctactcgggaggggtggtggcgggcacctgtaatcccagctactcgggaggctgaggcacgagaatcgcttgaacccgggaggcagaggttgtgctgagctgagatcgcaccactgcacttgagcctaggcgacagagtgagactccatcttgggaaaaaaaaaaaaaaaaggttaaaaatgccaagctagcagagagagggactcagacacacacacctaagttgttgctccagcctaagctggcccaccactacctgactgcagtttgttgcctgtcccgtcatgcttgccttcaaaatgcctttggattgttcacaagctcaggagccatgggcctcctcctgttgaggggtgtttattgtctaaatcccttacatgtgaattaaaaataggcaaaggtaaaaaggcaggagttttctaacaggtatgggagtgctgtagtaggccagtggcaaagactatcgccattttctttgcctgggacttgttgagtctttgaagtctacctgaattccagagtctagggcttcttgattccttagcaagagcaaagggatgtgtaccctctctttcaggctttggtgaattagaccttgagacttcataattaaaatggatttaatagaggcagggaagctgggatgtctgccccagtaagcaggcatcttctgtcagaaggagaatgtgtcctttgtatttaaacggtttctccaaaaggctctaaatgagatttgggacttaaacaagatttggtgtgatttgctaattacccaagttactattacctgattaacacaggaatcctcatagtctgttgcagtgcctttcttccgggtgccaggaggcttgacatctgtcacctgttcacttggaggcattttaagtaacccaaattatgtatgtcttttctgctttaggatttggtgcctgatttttacatttaaaagttaataactacctaaaggaggtttgctgccaaaatacaagagtgaaaactgacaaatctgtttgttgctgacagtgaggtggagatcttggtttattcattccaactagttaggccgagaaatgatacacaggacagtacagagctcttcctggtgaccatcacaggcatcaggaataaatcccctcaaatctcactttgccccaccaaccttaattgaggcctccgcttgagcagtgacagaactggaagggttggaaccagaaaagctaagtgtctttctcaaaatcacacaggcctgcagttaggatttgtctttcgttgttttttattttcaagataataaaaggtttccactttgaccaccaggagaccatgctgactttcatttcagagatggggcttcagtgtgataaagtgatctaggttagagtcttagcaggtttcccttgagatctgaatggctgcggggtgtgctgggggctctgtacagcagctgttaacagttttctccttcccatgaagacggcttatttacctgggtctcagttctgaagattgtttccaggtatgctgtgtactgaagggactgagcgtgatccaaggagcctgggacctatgtacttggtgaccagactctcctctccaaaagcagggacccaggggacctcatccagcatcctgagaagcctcgctttggacaggcctgaaatttcccttccttcatcctagctctttcatccaagacagtgattcgggaaacagtatttcaaaattgaaattcaggccttgaatttcaagtctagaagaactgtccaaatcatcggtaggaagagcttggaagaaagggaaagtcccactgtaatgctaaaagagagccacccagccagggatggtctgcatccagaccagagcacaggtcaaagggaaagccgagagcagttccctaagttctggcatggcttttggacgcaaagcagctgggctgcgggcatgctgtaaggacagaggaccctttagggttccatctcttcggagagaaagtccctgctgttccagttcactgagtgtttaagaggaaataacggcctgaggcataagccactcacccatataaagtgaatacttcctcaagggcacaaagagaccacttggtaaatgacttcacccacctgctttagatggtgctccagtgcactgagaatgttaacctcattcacccttctgtggatgagcagattattcctagaaaatggtccgttcatgtttgaccaggcatagccccactgtgaatgacaaagtcttttttgacctcccacgatctttctccctttctgtctcagccaagccttttcttctggaaggagctactctcttttggctagacgatcattcagaggagtcacctctgtccctccccctactgatacatctcagggtctcagagccgtttatgttcccatttttgcatcttgacatagggatgcaaagatgggaacatcaagcatcagttcttccgagccttcatagaaggagtggggggagtgggtagacatggagatgaaacaagactggccatggactgatcattgtgtaagtctggaaatggttgcacaggagttaatttaactactttgtttactttcatattggtttgaaatttcccataacaataagctaaaaacagatagtaagggatctcaagtgtcttgggcagtggttttcccattgccacaatatatgtggtgaatgggcattatctgcttggaaaattaacaaaattaaaatttacatatagatcagtgaaaacactgctacagagttaacttaaaattttagctgggtgtggtggctcatgcctgtaatcccagcactttgggaggctgaggaatgtggattacttgaggtcaggatttccagaccaagctggccaacatggtaaaaccccatctctactaaaagtacaaaaattagccagacacagtggctcacgcctgtaatcccagctacttgggaagttgaggcaggagaatcgcttgaacccgggaggtggaggttgcagtgagccgagattgcaccactgcactccagcctaggcaacagagtgagactctgtctcaaaacaaatcaaaaaatttaatataatatgtgttcattataaaaatcattcagggccaggcgtggtagctcatgcctgtaatcccagcactttgggaggccaagatgggcggatcacgaggtcaggagattgagaccatcctggctaacacagtgaaaccccgtctctactaaaaatacaaaaaaattagccgggcatggtggcgggcacctgtagtcccagctgctggggaggctgaggcaggagaatggcatgaacccgggaggtggagctttcagtgagctgagatcatgccactgcactccagcctgggcgacagagcgagactctgtctcaaaaaaaaagaaaaaaaaaaaatcattcaggtacagccagagagagccactgtagatagtttgaaatccaaagacgtcttatgtgggcattacccacagatgtgcatgcctgtgcagcttaattttagattttgttttcttttgctttgttgttttgtgtgtttgatttcttttcaaatcagatttatgtttcttaccagctcgttttaacaactttattcaaatataatctacatgccgtaatattcacccgtactaagtgtataattcagtgattttttagtaaatttatagcgttgtgtaactattgccacaattcaattttagaacattttcatcattccagtaaaatccctcatgcccatttgcagttagtccccattaccactcccaggtcaaggcagccacgaacctattttccatctctctagatgtgctttttctggacatttcatataatggaacaatacaatgttggtgggtttttgttttgggagactgagtcttgctcagtcgcccaggctggagtgcagtggcgcaatctcggctcactgcaacctccgcctcccggggtcaagcgattctcctgtttcagccttccaagtagctgggattacaggcgcccgccaccacacccagctaatttttgtgtttgtaatagagacagggtttcaccatgttggccaggatggtctcgatctctccacctcgtgatctgcctgcctcagcctcccaaagtgctgggattacaggcgtgagccaccgtgcccggccgtaatgtgtggtcttttgcatgtggcttctttcactcgtcctaatgttttgaggttcatctacattgtagcatttatccataatttgtttccgttaattgctgaatagtattccattgtatggatataccacgttttgtttatctgttcatcagcttatggacatttggattatttctacttttttggctattattaataatgctactgtgaacactcacatacagctgagtggacatgtgttttcatttctcctggtagatacctaggaatgaaactgctatgtcatgcaataagtttctgtttaactttcttaagatactgccacactgttttccaaatggcagcttcattttacatttccccagtaatttaggtgcttctgatctccacatcctcaccaacatttgctgttgtctgacctcctgaacgtgaagtggtatctcattatggttgtagtttgtatttctctaaggatgttttgaaatggggaactgtgcgtcttccaactttgttctttttcaagattgttttggctttgtttcctttgcatttccgtatacattttcatatcaccttgtcgatttctacccgcaccccatccctccccgaaagtctgctgaataagggtgttgagcatcttttcatttgtaattagccatattcttggatgaaatactattaaaatcttcttcccactttttaagtgggttgtttatcttctaatagacttgtaagaattctgtatatattctgtatataagtccattatcctgggtatatgatttgcaaatattttctcccagtcagtggcttgacttttcatatccgtaatgctgacttttgaagcacaaaaggttttaattttgttgaagtccagtttatcagttttttttttatggatcatacttttgttgttatatctaagaactctttgcctaacctaaggtcacagagactttcttctaagaagttttataattttaactcttacattcatctatgtggctgaggtacttttttgtgtatggtatgaaataagggtctagttctgtgttcctgcatgtggatatccagttaccccatcactgtttatcgaaaagactattctttccccttgaaatgcattgccacttttgtcaaaaatcatagacaataaatacacaggcttatttctggactttcatttctattcctttgatctatatgtctatccttatgtcagtaccaggctgtcttgattactatagctttgtaggatgttttgaaatagggaactgtgcgtctcccaattttgttctttttcaagattgttttggctttgtgtcctttgcatttccatatacattttaggatcatcttgtcaatttctaccccccccccaaaaaaaaaaaagtctgctgagattttcatagggattacatttaacccacaggtcaatttgggcagaattgcctttttaacaatattgagtcttctcacccttgaagacagaatatctcttcgtttatttagatctttaatttctctcaacaatgtattatagtttttggtgtgcaagtgttgcacttcttttgtgttattgtgaataaaatttttaaaatttctttttccaattgtttattgctagtatataaaaacattgattttcatattggtcttctatcgtatgacagcccaatttttttattagttttaatagctgttttgtaaattcctttatcagatttttccgtgtacaggatcatggcatcttggaatagagacagttttgcttctttcttgtccatatgggatgacttttctttttcttgcctgatacagaattttaggaattaaaactcatccaaagtcatgccaaagatcagtgattatacttatgatatcaatgaggagacaaaagaggcaacttttggaattttaaatgagccttacagaggcaaagggaagaatgggtgactgcattagcaaggaagtaaaaataccactctacagccagacatggtggctctcacctgtaatcccaaagctttggggcaccaaagcaggagaatcacttgaaaccaggagttcaaggttacagtgagctatgatcatgccattgcatttcagcctgggcaacagagtaagatcctatctcttaaaaaattttttaaaaagccacttcgcattgactcaggtttcacagtgctcctcttagtgggtggttatttcagcaacctgaccagaacagacaagataagccctgaaacaacacgaaggagccctgagtaggaaaaggtagacaccacacactctccaggctcatttatgtaacccactggaagatctctggtctatacagaacctcatcttcatgtctacctattgttttaaaaagcattggcacttggttttctagcttgttgatggttttgttttgtttttgcagctatactttaggaaaggtgttagagaagagacgaagtaggacttgaacataaaggatgccaaaaagtgaaaggacagtagctgatagtgagggggcatattggaaatgcatttaaatatcccatgtatatttcctggacacctacagggacaaatcttatgctcaagaatttaaaagcaccactggtaggtcagtggaaggcaactccccagacttgataaggtctgaggacattggctgagcaagccaagactccagtgacgccatccatttcttttgtggctgatgaatcagattcaagtacaatgctttataattatccctatgaaattctagcatgttagtgtcgacccattattctagtccttcggcacctctttggattctgattctggttttatgagttgaagattaataactaagctttgaaggatggggggattgccaaaaaaaataagctgaacagtgctttttttgtgataatcctgtgtcctcaaagaagttaagccccatttgctgcagaaagaactcattagctcctgtagcttctaaggaggatcctcatcaaagaatcttttttaaaataagtatgtaataataaaataaaacccaccatctagccaggcttcttgctattggagtgggaatttacagataaactagggaggaggctacactgatgcatgtggtaatgggttagagttaaaaatatcagtatgagctcatgtttagcttaacatagatacaaatagtcacatatagaaatctttacagatctgtgcatataaaagggttagtacccatatgtatttctgtgccctgacaactgagatggcctgaaagaaacggacaccccagtgtcaacaagcacaccttcatctagatcttggttcctattaccattctccaataaaaagaactaggactcctgagtgaaatggttgcttctggaactcaggcaggaatatacaagatgaacctggagtatgttatggtgccagaaagtaaggaagtcctaaaacaaaaaacaaaactcacactgataggggcacatcaaagaaacacagaggccaactgaaagagctaatggccactcctggataattagagcaaaacaataaggaagcatcggattataacccaaagtataaaataaatatccatgactccatactgatagaaataaataaatggaggagaaggaacaaacctcccacacagaagaattccaagtaatttacacagatacctcaccctcaagcaggggaagcataatgccccactccctcaatgtgagttccaggtagtggctccttcccaaagagtagtaggggagggggaggggagtccattgacagtggagagaccttcaacctggtgaccaaggacaatatcagtagtcacaaatcacattaatagaacagaccattgatacaatgtgaaaacaatggcatttcacctctgtagtcttcctcccaaaaacctctcaacccagtcttaatcatgagaaaagcatcagacaagtttcagtaggggggcattcctatagaatagctcaatattcctaaaaaatgtcaaggtcaccaaaaacaaggaaatttgaagaaactgccaaaagaaccctaggaaacatgacaactaaatgtaatgggccaccctagatgggatcctgggacagagcaaagatactaagtacaaattaaggaaatctaaataaactatggactgaagttagtagtgctatgttagtattggttcattacttctaacacacatgacatactaatgtaagatttagtaataggggacactggatatgaagtatatgggaatgctctttgctatcttctcaatttctctggaagtctaaaattgttcttaaaaagaaagcctatttaaagggaaaaccaccatcactaccaattttgataaacttgaagggttagcatcaattatctggaaaatttatttgtgagaaaaccttattcctttatgatcattgataagtgaagcattgctgaattatctctgcctctctgagcaagttaatactatatttttaagagaagaggagaagagaggggagggagtagggaaaagagtatgtgtatctttgtgtgtgtatgtgcgtgtgcatgtgcgtgtgtgtttaaacaagagaaaaagtgaattctaaattgttaaaaccttggagtggaacttaatctaatttatacgcagttccactagagatgtgcaaggatttttttgttgttgttaaagagaaaaactagtttcaagcattattaagcttttttccctcccagaagctaagaaaaccatctgtgagaacctgtttgcatgtttgttttctacaataaaatgcaaaatacttcttcctgttagcggattataccatatgtctctccctgtaacaaaatcagcatgtttattaatgaacccaatcagaggcaaagatttagaaagatttaaggaactgaattttccattcaatatttcagcaaaagaaacttctggttagacatcgttgttgtgcttggaaaatagaaggtttgtttttgctttgaactcaatttacttggcaggggacagagagcaggaagagaggcctttgaaaattttcgtaaaaaaggtctgcatttagaaatggcccttcctgcctaatgattcccctacggatttagacctacagtttatatgtgactaatatttaatttgatcagttacatttttccagacagactaattaaagtgcttgatggcccagatcccccaaatctgaagcagtaacaggcctgtgggcttcctggagtaacaggaagtgaatgaagtagtttcagccatattgtcaaagcaacccccatggtactcataatggaaacatgtgaattttccagcacaaacactttcctcacagccctgttgaccatctgaataatcaaatagattggtagcactaggtatagcatagtgtattagaaagaaatatgtccagccagacccagcactgcagttaaagtactggtgctgtcacgagccagcagaaggcctggagcaaatgacgtactctctctagaccccagcttactcctctgacaaatgaggatatcagctctgctgttctcttgtttctgacttgtagaagaatggacttgtcagcagagaccgtaagcagtggaaatcccaaaagccagacagaccctgtgcgtattttaggggatacattctgttctggtcattcagccttcacccaagccatctttttttctatttggtggcatagacacagcccagccaacctaattctcattttattgcattcattgttcatgtgccacagttttttagaaatcttacaagaaaatgaagcacctattaccaggacaccactgcaagggggaaaatgacacttgggcacctggaaggacaaagacaggcagtggaggcatcatggggttggattcgagtaaccctctgccttcttcctggggtctgttggcagtgtttttgtgctgtggtcatgatacacacaggtctcacaaggcaggcagccaagtgttgactctgtctttgtaggcaatacagaaaactgtctacttgttccagtgagctaaatcaagtgagaacaggaaagaggtttgtgcaactttggcaactatagcaggaaccactttaaatgggacagggcaagtaatgctaaatatttgcaaggtgatttttttttttttaagactttaaaggttgtattgggagaccttgagaaagaggcctttctttcttttttttttttttttttttttttgagacggagtcttgctctgtcgcccaggctggagtgcagtggtgcgatttcggctcactgcaacctccgcctcccgggttgaagcaattctcctgcctcaaccctcccaagtagctgggattacaggcacgcgccaccacacccaactcatttttttttgtatttttagtagagacggtgtttcaccacattggtcaggctggtctcaaactcctgacctcatgatccacccacctcggcctcccaaagtgctgagattacaggcatgagccactgcacctggccttttttttttttttttgagacggagtttcgctcttgtcgcccaggctggagtgcaatggcgcgatctccactcaatgcaacctccgcctcctgggttcaagtgattctcctgcctcagcctcccaagtagctgggattacaggcgtgtaccaccacgcctggctaatttttgtatttttagtacagatggggtttcaccatgttggccaggctggtctcgaactcctgacctcaggtgatctgcccacctcagcctcccaaagtgctgggattacaagcgtgagccactgtgcccggcctcttttttttcttttcttttctttcttttttttttttttttttttgaaacgaggtcatgcatgcaggctggtcacaaaccaaaaaggccttttgacaattcaactacctcaactctgggatgggcatttattaataacccccaacccacccaagtcctccaaataccctgccatccaggggaaaacacataaacatcaataaactgcatgtccccaagggatgctctttgccccaggatagtctggcctctcgggagatttctcttacctccagggctttgtttcaccagagaagccagcctggaggtagaaggggaagatacttagcagcaaaatctgctgccctgtgcagccaggccaggggggcagtcaggggctatacaggctgaaaagctgtccaggacccagagctatgtgactcataaaggcaggctgcccacccactgaaggtctccaagtggcagtccagatggacagtgatcagctgtcacattggacggttggcctcctgtgatgacaacactgtgccaaggaggcctgggttgaagctttgagcacatgttaattggcttagctctattccaccactgtagaattttttagttcaattcagcaaatattccctgggttcctgttctttgccaggtaatagagctggacactgtgaatgcagagatggataaaatatgtcctttagctgatggagagaaaaacatgagcaaataaatgtcatttactatgaaagatactagagtatctggaaagaacagtggagacagagaagggatggatggctgaaagtgtgtggttaaaacagtgcccacccatcttgcccagacacaaaccactcaaaaccaagaccctgttggaggaagcattcctgtgagtttattagagcaggatttcctgaattcttcctaggaatgttaaaagataaaatttgaaaaaaggattccaagagcaaataagtttgggaaatagtgagttaaagttagacaggttgctttcattggtagctcatgcttaagtgcagaacttctcaaagccttgagtatgctgagcacattgtgtgattaccccaggggaggagatggtattgagaattttgacttgggagcctttttccagagttacctccttggacctgggaccctcatattcttggaccctggcacagtgtcctgtctggagctgagagtttgcagagtggccttctagtcccagcactcccactgtgactgaaactgtttggctttgggaagtctaaccttctctgatgttgtttcctcattgtgttaggcaatttttgcatctctataaagaaatacttgaggctgggtaatttataaagaaaagaggtttcattggctcctggttctgcaagccataaaagcatggcactggtatctgcttggcttctggggaggcctcaggaagcttttttttttttttgagacagagtctcgtcgctctgtcgcccagctggagtgcagtagtgcgatctcggctcactgcaacctctgcctcccgggttcatgccattctcctgcctcagcctcctgagtagctgggactacaggtgcccaccaccatgcccggctaatttttttgtattttttaatagagacagggtttcaccttgttagccaggatggtcttgatctcctgaccttgtaatccgcctgccttggcctcccaaagtgctgggattacaggcatgagccaccacgcctggccaagaagcttctaatcatggcagaaggcaaagcgggggtaggcacatcagatggtgatagcaggagcaagggagagagagaggggcgatgccacacaccttcaaacaaccagagctcatgtgacctcactcactgttatgaggacagcaccaaaccatgagaggtctgccctcatgacacagatacctcccatcaggtcccacctccagcattggcaattacatttttaacctgagatttaggcagggacaaatacccaaactatatcactcatctagaaaagaagggaagagtgacatctgcctatcttgcagtattgttgtgaaataatagatgtgaaagcacttcatactcataaggactgggattgtcattgctgggttgtgacaatcgcagctgtgatcaagtcttcgaggctttagttacttgactgccttgaggttgtggcctcttgttatgcctggaattctcccttccttcacttctttacccaccccttgagatacttcttataaccatcccctaagttcaatgttggtagccctgagacttctgtccttggatcccttctcttgagaccatttatctcagagctccatgtgtcaacattacctgtcttctgataaccacccagttttctgtctctagcctttgcttctcccttaagttctggatccaaatgtccaacttctccccagataccttgatgtaattatctcaagctgcatactagtgcctcaaactgcttgcccttccccacacactgtgttccttcataactgggtgtcatcttaaaagtacttctggtaaactcctgctcatccttcagaacccaactttagtctagtctcctcttggctgacttcctcctgtgcgctcccagagaactttgtacctacacctaacatgccacttctcacactgccactgtggccattggtgtagttttcattaagtcaaggactgtgctttatttgcctttaaattctcatccttgagcagagtgcagggcgggcagtaagtctaattggatgcatatacctcattctagtcatgcccatgcagcagaggggagtttcatctttaatgccacatctggctttacactagaggcctgaacctgccggatgcacaattttgttcttttccctgctggctaggatttgcaggcacccagaagctgaagaccctcggggtctccagaggaggtcacatgtgcctctggccacagccacccctggactttcagctggccagtgctcccagctcccagcccttggctggcagaggtgagcaggagtcccacccactcctccccagcttagccgagtcatgttgatattctggcggcatagtcaggcttgttattgagcacatgctttgcagattagcctgtttgtatagccaatcgaacatgtgctccattaaaaattaaagcatcctgttttaaggatggagcaggagacatcagctgccactgtgtagcagacatgcaaagccccagagcccattaccataggttacagcaaatgttaatcagtgccagtgcagttaaataatgcagtttgtgcagatggcagctactacatctcctcacagatgtgtcctcaagtcccggaggctgctgtatcacaggagttgtcgggagcagtcagatctgatgctgactgtcaatatcaccttttgtgtttgtgtgcatcctccagccagctgagaggcaacgataggatgactccaggccctacttccagcagcccttccagagctggagcagggggtctgtgcagggctcacaggagagcagaaatatttcactaaatcgccaagaacactcagagtaaagctctgcagtctgctccatgaaactgtacccagctgcatcctgcaagaggcttcccagccaggtggagtggggatggcgttcccaccttcactcttcactgctttctgcttgctgatgggcaagaattccacaagtattcttcctggcttccataagcacagggacacctcactgtatcagaagttggagttctgacagcacctactgtgcacagggcctgattctgaatggcaaagtgctgttcccgaagcccaggcacttggctctctggtccaggtgtccctaccctccagcccctgaacagatactctgcgtaaaatttaggaacaaatcgccactcatgctgccagcagtaagcagcaactgttgtggcaagaaaagaccaaactgtttcaactgtcccagctcttctctctctctgtgtacttccttactagcagctgtgggggacccttccatgaaggggcacctagagcactgacatccacatgtgggcacctgggggcattccatctcagccactgtcaggagcaggcacagtgactggtccccatgaaggtggcctgttatcaagagaagatgaaataaagctcgaggtaaccaagtgtgggaaacttgtatggaagcaggggagattgctcttgatatagttaagtgttttacttaaaggtgtaagcctcagctttctgaaaaatatgctactgtagaacaactcatttctgaatagcatcaaatatgtgaggtgaaaatgtacttatgagaaaaatagttaaaagtttattcatcctatttcctttctaggttgtcagactatgtgctattcttcattcctagatgggaaacattgcatcttatgaatgtaacgtgttgctgtagacaaatattcttgtggagtgaagcccagggacaagggtcttttgctttccttgcaaaatgtagagacattattcctgtttcacctttgaaggccatgccatctgataggccatgccatctgatatggtttggctctcaccttgaatcgcaccttgaattgtaataatccccatacgttgtgggagggacctggtgggaggtaattgaatcacaggggtgggtctttcctgtgctgttctcgtgatagtgaataagtctcacgagatctgatggttttatagaagggagtctccctgcacatgctccctctttgcctgccgccatgtaagatgtgcctttgctcttccctcatcttctaccatgattgtgaggcctccccagccatgtggaactgtgagtccgttaaatctctttttctttataaattacccaatcttgagtgtatctttattagcagcgtgagaacagactaacacaccatctgatctgatggcttctacccttcctttctttctttttttttttttctgaggcggagtcttgctctgtcacccaggctggagtgcagtggtgtgacctcagctcactgcaacttctgcctcccgggttcaagcaattctcctgtctcagcctcccaagtagctgggactacaggcacacaccaccacacccagctaatttttgtatttttagtagatatggggtttcaccatatggtcagcctggtgtcaaactcctgacctcaagtgatccacctgccttggcctttcaaagtgctgggattacaggtgtgagccaccactcccagccagcttctactctttctttacttcccagtctcaacatcatttgtggaagattttagcaccgactcactcctttccttccattaaactcagcaatgacatgagcagctcatctgagccccaggcctctggattcctaacctccttacctccagtggtctttcctttatccacctctgccccccattcccattgttatgccctacgtcttgtcactacctataatgatgtcagtttcaaaattgtgatttccaaaccattagctgcaaagagttcaaggaactgagaggccaggatgctcaaaacccaccactggcttcacaccacacttagaacaaaggtctttcccctgctgtgagcctgcctactgctctgacttcgtctcccactactctgctccagtcacgctggcctttggtctggccttccaacaagctgagctaatttgcaccacagagattggttccattgcctgaatgctctatcccgttatatagatggtcgcttggcttgttctctcacttcattcaaatgtcatctccttggagagacttccctgactaccctattaaaacaacaacagtacatcccccaccccaaatcactctatctacttatccagctttgctcttcttcacagcactgagccaacatttagacagacacacccacacatccatatacatctatattcacttacttactgcctgtctgctccattgaagtgttggtgccacaaggacaggggttttgtctgtcatattcgctgctatatctgatgtgcctccaatggtcttccattggaaaatcaattgaatgaatgaaggaatatgtttgggctggaagcaaatgttggaaatggagttttaaaacaacagggttattttttaagctttctaataaactttctatcaaaagcatttttcaattattaacacttcataaatgaacaaatttcatcttctcaaagttacacttaggtgccaactagagaaagcagaagaattcattttcttaatattttgtgaaatccaggatagattattatttcaagctataaggcttccagcattagccttgaaacctcatctttattttgcttcactgctaggtgtctccttttttgtttttcctagaacttttgtttgacttctaattttgtcctctgattgaggactgaaacaacgtgtaataatctcacaccaggcaaatatagttgaaatttttagtggatttgattacattcttgaaagtggcaaaatcaagtaaaagcagatagatcagaagattgaaagctttggcttacaatcattctttttactttttaggatgtaaatcatcgtattggtcctttttactttagacaaatatgaccccataaagttttaaaagtttgtgtctgtgaaaaaaagcaagatgaattgtctctcacttccctggtttggaagagaagttccaaagcagggctgaactgtcatcatcatctaataattttcctttagttttcatttttcctttctaaatcttagcatgtgagatcacaggctccctctccaaactcatcagttgtctcttgttttaccagtaagaactgaacccctcatctcaaccagtctgtcaccaaggcacttgctccaaagactctgtaccagtcgagatgcttttagctgcaagtaatagaatgcctcatccaaagtagccatagggtagccatagggccaagcacagggactcacacttgtaatcccagcactttgggaggctgtggtgggattgcttgaggccaagagcttgaggccagtctgggcagcatagcaagatcctgtctctacaaaaattttttttaattagcctggcatagtggcacgcacctgtagtcccagctactcaggaagctgaggtggaaggattgcttgagcccaggagtttgaggctgcagtgaactataatccactgcattccagcctgagcaacagtgatgagatagtcagaggtaaccagatgtgtattaggctgactcctaggaagctttacgttaggttgataagatggctacaagcatggtatctccacaccatatacccaaggagggaaggaaaagggcagacctactccttaattgtgtctttctttttagcaggaaggaaaatcctttccgggggtcctgcagcagattgccccttacagataatagccagaactaggtcacgtgttgataaggtttagatacttgttcccttcaaatcttttgttgacattgcatctccagtgttcgaggtgggcgctgggaggtgtttgggtcacggggtggatccctcatgaacggcttggtgtcctccctgtggtaatgaatgagttctcactctactagttcacacaaaagctgcttgtttaaaaaagcctggcacttcttcccctctcaccacgtgccctgttgactacccttgccttctgcctcgagtaaaactccctgaagccctcaccagaagcagatgctggcaccataattcttgtacaagctgcagagccatgagccaaataaacctcttctctataaattatccaccctcaggtattcctttatagcagcacaaaatggacaaatacacatgggtgccacaaaccagtcactagcaaatatagattagaccacttggttatctcctggcctggacacatgtcactttcctacctgaacaaagttgatgttttctaataacagagaatgaaggatgacaagctgccagggtcgacaactaacaatgtctgctacagcagtacaacccgttactcctactgaaaaaactcactccaggtggaatagtagcttatgtcagggtctgtattgataggccagtagattataaagtatttggaagtgatcttagaatctctgctcatttatgtcaccactgtttcatttacatacctctaggatagcacttaccacgtggcatcatgattccatgtccacaggtctgactgttcctaccagattgtcaccaggaaccccttatttctttgtgtccagagtacccaggataatacttggaacttaatagaggtagaggctcagtcggtgtttgctgaacaaatgaatgaataaactaacaacaaataatgaataacatattcctgaagccatgcgttatgaagaacagttggaataactataggtgtttacctggggaatgaatgaatgaatggacaaatgaataagcaaatgacaactaagagatttttggagcggtgtccaatgaactgttgaaatgacgagaaatgttgacatggagaagagatttgaggaatacagtgactttttgcaacgcaggatttaaaagccttttaagtgaaagagagatgagacttactttgtgggatctttaagggtagagctaggaaaagtgggctgaaactacaaggagacagaattgtaaaactaaaatctaaaagtggagctatgtaaagatggaatagactgcctctggaaagaatgagctcactgtcaccaagcagagagtggctaggcatactctcaggcagtggtaggattttatcattgaagattggacttagataagaatgatacttattccctggtataactgggggtcctccctcgtagtgagggtattctctgaaagtatgaaaaattaaacttttaccacttaatgttaacatgaaggaggtatgtggtagccctttccaaagtaccaagagactttatgatgctatgagacatcttggagtaatcccatctgtctttattattcccaattacatgtgccatttccctgttgagctcatttctgatagaagaaatgttttttaaaagaaaacgatgttaatagatgtcactggttttgtctgtcttaacggattctgtttctcacttcaggacattatccagtttatactttattaaaattggcctcatgcacccttgaggtgagtgggtagagaatgaggagaagagcctcacttcccggagatggcggagagggattgggcccaccaggtattctttcaaatgggctgccttactgcccacctgcaggactgaaaatcagagaaaagcggtggaaattgagaaactgtaggacatcattcactctcgtaattacagtgaggaagtgtgctgcatatgtatgttccctcagtaaaacaggtgttctgcccttaaaatgctaattatagactattgcagatcaatgatcttcacttatttcatattgctgctccattttttccacatttaactaccctgtgatatagaaagcttgctcacccttgaaaaaatcaaaatgcatatggattttctgaaataagccccttttctggaagtattttgtggttagtttcaaaatgcaatatcctgagaaaggtttaagtcggctttttattttaatatataataaaaaagtaaaatcactaggcaatgagcaattttacttccattagcctaatgtctttgtggtttcatctgaggtcactagtagattatttttcttgcattatttcatcagctgtcagttctattacaatcatgtaattcattcagtgctgtgatttttcaaagacataactgtaagcttagaagacagttttttggaagtttatttagatgattgtagggtgtcagactgcctcaatcttctccatgctcagtgtctgaagggtcaccaacagattgtacatgaccttagatgctcgagtaattatcaccactatgtttttatacccagcacataaaaatatatctgcactttctttatcatcatcttttgaaagactgtggcctgcctatgggctgggcaattaggtttactacttagattacaggatacatgatacagctcttatttaacaccaacaataactctttttaaggtggtttcatttcaagcttagtctattaatatattcaccattgggctttgattacaataatgcagtttatttatgtttgcatatagtgggtatcagtcaagaaatcatttgaaaatcattcactgaacaccagctactcacagcttgttagtttctggtggttataaaggaattagaaattctctgctcttgaacatattattgtgatccatcaaagcctctagcaaagtagtcatttagtttggtttttgtgaggtttttttagtacgaggataatttttaaatattaaaaaaattaggccaggcacggtagctcacgcctgtaatcccagcactttgggaggccgaggcggatggatcacaaggtcaggagttcaagaccagcctggtcaatatggtgaaaccctgtctctactaaaaatacaaaaattagccgggggtggtggtgctcgcctgtagtcccagctactcaggaggctgaggcagaagaatcgcttgaacccgggagggagaggttgcagtgagccgaggtcgtgccagtgtactccagcctgggcgatagagtgagactctgtctcaaaaaataaataaataaataaaaattagaactctacatagtaatagtttacctttattatcttgtaattttaaaagtacaaaatgcacatttaagatacatgtgcataaaatgatatgtctgggatttgttttaaaattatctggaaaggtgggagtagtgggaatgggtagatgaaataagactggccatgagttgataattgttgaagctgagtgctggtaggtagcagtttattatacagttctctctacttttatggaaattgttcatttaaaaaaaggaatagaaggttactatgcacagggagcagtggctcaggcctgtaatttcatactttgggaggccaaggtgagaggattgcttgagcctaggaattcaagaccagcctgggcaacatagggaaaccctgtctctacaaaaaaatacaaaaattagcccagtgtggcagtgcatgcctgtactcccagctgctcaggaagctaaggcagcaggattgcctgagcacaggaggttgaggctgcagtgagccagggttgtaccactgtactccatcctgggtgatagagcgagacactgtcaatccatcaaacaatcaataactatgaattcagctttgcttttaaaaagaaaatatattttaatgatcattgaagcatttccatatacttgaaaaatattaataattgtatgagaatagcatataatttcctgagactatagacagagctttgtgctcatggactctgaaccctttgttgtaactattagaatacaatagacaagcaagttcaaggtagcttgatacatactgtacacaaacactgagcacattccaagggatgtgaaccttaactacagaagcgtgtatggagctgctttaatttactgtgactgtgttgcatagaaaaggaagacgaccgtgctgccacttaagtactgataacatttaacactgtgtgcataagattgaggcagcttggaaggtccagaatatgaagcaaagaatccgatccattcagaaaccaagaaacctccaaataatagcactttcactctaattcagcctctgccaaatttgcctttggccaattgtcaccagtgccaaattaccaacagacttccttttctggtcttagtcatgttgacctcttccttctgtctcctagtcaagcagaatttaaaacatttacattgtatttcaatttctatgaagatgggagaggaaaggtgtatttcttgtcttttgtccctggccagcttctactgggaacttatttccttgaaattcctgtcctgtaaaagcatgcagatgaaagtatctttaatgtataattacatttttatatgtgtataatcttagattacatgggaattgagtatctggaatggatcggccttaggaaaatgtttctttttaaaaactattaaatattggaacattatacaaaaaaatagcattgaaatatttaatctgtggttcaggtctgttgttcatttaaaggtttaactgtttcccactgtttaaatatctctatctgatctttcatgctaagttagcatgtccaaaatattgaaaaacagatgaatgatcaaggaacttaaggaatactcctccagtgaagccagaaggatattcttgaggagaaaaaaagaatgcatgaaacttatttaacaagaaagatttgagtcaggtaatctacataatatatccactggcattaaggctgtcatcttggtattgcatttctggtacgaatttcgcaatagctgtctttcactgtcggttctaataaagagtgttggtcagcttaaattccctgggagctcagagttatgttttgtgaactgcatgtgcctgaggcctctcatgcatgatttaaactgctttgtaaatgtcaataggtggaaaagcattggatcccttgtagatttctccaaatcctcaaagatgtgtatgccatgtataaaccatgctgcactctcaaggccattgccgttttttatacttgcctaactgggggtttaaggtattgctagaagcaaaatatcagtgtgttcatgtctcgatccaactggccaatgaaaccctttattaggaaaacctttgcaccagagaaatgtctccagtgacctgaaatgggcacacctcatgaatgttgaatgttcttcaaactctatttcttcattcttgacttttttcaaaacatacatttgacttgattgaatttactgatttcagagtactgcatccattccatggacagcagtatggggtcatcaaaaaaaatttccattgagagtgcccagacctgggtcctatcctggttctgccactctctggctctttgtccttgggcaagccacttaaccttttgggggccctgcttttctgatccattaaataaaggaggttgaattaaatgatctctagttatccctcacagctccagcatcagtgattccaagagatagtgacagaaaaccagtgtgtcacttttaaagccagggaacacatgtgactttttaattgggctcattccactctctgggcagtacacagtgccggcagaagccccaaaatggccagcagcaatggcgtagggaggcctgagtgttagcttgagggttcatcaactcattttcgttcaaagcacttcctggtgattgttttccatggacctgggaactgcactaagggcgctcctcccacagtgtgccctgaccccccaggtgtgttctttaggtaaagctgttttttaatgtctgaagaggccaaagcaaatgccagtgagggtatagctctctaggatctccagaatagaggcaccatatgagcaacaacactagactgggtttctcagagtctgtttctcacacactttagtacctctcagcttaacatggtacctggagatagaggtgcttaggaaatgtatgcttagcaaatgttgcagaaagagtttattcggagtcatagagccatcggagcagatggtcttttttgttttcttcttcatgttttgactcctacatagttcagaataagtcactttggtcttttctttgcacatgttcactttctaatatagtgtcttcttggggagactgttttatggggaatatgtgagttcatgtgttagctgtggagccagcctgcctgaatttgaatcctgacttttcctctaactgtgtgaccttgagcagtttccttaaccattctgtatctcaggttttaatctgtaaaataaggataacgggagtacctagctcttcagattgtgaggattgaatgggatatacacataaagctctcaatgcctggtgtgttaaagtgttcgcagttgttacttttttaaatgtttttactacttttgaaatttagtgttcaaggtgaactttttacagaagagccagggcaattggatgcactttgggggaaaaaaaaatcacttgcctcatccccatcttctccatcgcagtgaggactgttctcaagtgggcacacaggacacctgtctccttcatctgcaaggccccagtggctgtgctggggtttgaggtctctcgttcagaccaggtatgtgagggcttggttatcatgcactgctcctgaatccaccatctccatgtccacatccttggcagggagaccagagccaactgggaactctgccacctggagagacctttgaaacactgtcgccaccagtgttccatttgtgtgtttgcagaatgccaagtaagcacattctttttcaccctctgacatgacctcagggttactttctgtggctgttgacaaatttttagacatcccagttttatcagcggaaaccttgaagagtgacaaatggttcttggaagagttggtacatactataaaaatgtcagctggctcatttataacccagtgatgtccagtgtctgagccgtgctatcagcatggtctatagataactcaccctcacgatgctccgctctccccaagtactttgtgcagctgttctggttgaagacccagttgacatctataatagatatcaaatggagagcctcttattttatcactctctgtgtttcagcactggcggtccccatggactgtcagaaacaggcagccagcacgttatgggaaaggtgacttgctgagtccctgtgccctgaggacattattaagtgctagggaaccttgttagctcataaagttggttcaaaccaattattgttctgcgaccattaccattgccaagaatgtaactcttttaaattcttgcccataaagccgatctttccattacattatatcatagagcaagacttctgatctggccgcacttgtatcccaccggctgcaaagactaaacattgcatttgctgctcaatattggttacccttcagtgcttcatggaggcagcaagactgctatttatagatttactttctgtctccctagttcagcacagtcagttttgacacactgtcccagtaatctgatcagccatgctgcttttaaatgaaggtctaggccttggcctctgcagagagggtgacagctgtcagatacagatagtaggctacagatcctggctgctaaaaccctctcattcattcctgttacagatcattgaccacagcttgaagccatgctttacagttggccgattagttggcaagagatctacatactgtattagcaaggtcaaccactgagataaaggcaaaaacgtaaacccctgcactatttttaaaccagtagccatttgttaaagctggttattttggtacttgtctccgttcccctcttttttttttctcccaaaacaaaactcaagaaacttgttaaaactcttcggcagctaacgaagatgcctcagataatgagatggttcaaacctgagaaggaaagatgaggtctttctcagaaactcatttaggaacctcggataggaagccgtgttagctgtgcttataccttgttttaatcagaacgtgtctggaaatcttagtccagggagacctggatgaaagtgcagccagtttgagtgctctggccatgacagtaggttaggcaggtctggcctagaaagaggtaagttatgattcatacaagtttaaatcctcgctcactcctgaatgaggtggttgggcttggttgtcagctcagatgattggacccattttgtaggtgtttccttctccagagtccttccttcccccagcatcttgtctgtaggtattctaaagccaggcattattcaacacactatattggacttgtgtaaagagaacttgcaccctgggaaaccttgtgttaaagtgattaattgacttcttcatattcagtgaagatccttgctgtttcagaatcgacacaaacgaccaaaccttcaatctcatctttactcagaaaggggtccacctataagattttgaactctccttcaccatctgaccagcctcctctctgctttcacctctcctatgccttcactcccactgaacgttcctttaacttcatgacagccaccttcccctttacccttctctgtgtcctgctaagactatgtggacccagctggggttcccattctttttccaggttatactctctatggtctctattttgtgtcctcctccctctcttctgtgaccttactgcatcttcctgttgcattcccatctcccatctgatctcttgtctttcactctctacctcttgttgacttatgaccaagcacagtttccttagtgtacaggggcacccaaggcccttgacaatatgtctgtccaccatcttgtagtcttgcctcctgctttgtttcttctccacctctctaaggccccatgcacacatttgctgaacacaccctgccctgtcaagcttctttggctgcctttgctattcctccaccacgtaggtcctttagaatggcaagccttacaatgtatagtatatttagtatacatacccagtaaatatttgtaggacgagtgcatgaataaaagcacaatgtttgacattgttatcagcattgacccaaaccctttgagctagatgagcaataaagattagaagaaagaggttaggtataaccacaaacaaacttgagattgaaggctcgctagaagtagaactttgggtggatttctctctgtgacttgattttcttgcctataaagtgaggtaagtgatatctgctttataggttgttgggaggatcaaagaagaaaaaagggaagtaaagtgcctaacacagtgtctggcaaatggaaggaacttgatagatgttaattacctagctgtgccatataactcccaccccatcttcagtgttctgtgaaatgtattttcattttacccttggaaaggtacaggacaggatggaagaccagtttgatgggagagaaggctgggagttacataaacccccatggttttctgacttttcactagagtcaataaggagatgtttaaacagactttggcccacaaaaggtgactcactctcacattctcagcttcctgctcagggaatcagtgtggaaactgggcttccacttctcagcttcaaactggagctgggaaactttcgcctctgtggaggagccttggggaaatctcagcccagctgccatgaggtgtgcaaggggaggacgtgtcagccctggaaactccacaggcctctgttccagatgcacagggcagtcacgtctttgcaggggtgaagcaggaggacaccctccctcctgttctgttctagcagccatcatgaggtgggacttggagggaatctgatcctgttaggggaacgatccagtccggtgcagagcagctttggggtattaatgactgtgtgttccacagggggaacttgtccatttcatttatttgcaataaaatatatgagaggaacatctgcaggcagcttatatatttgtcaaatttagaagtaattcaggcatatgatggggagccatggcgattttatgaattttctattgttatgcattcgagttcccatggcatcgtttggcctagctatggcagcccagagaacagaggcggtgctagcagacccacgtgacacatgccgcgggcttgggcggatgcctggcatgtgaagtgatccagggtgctggcagatgcagacgaggtgggagggaggtggaggaggggcatactcatgttttaggaggggaaatacagggtcacctttgtggacggcaaatagccaggtcctgaaacttgcttctaatgaattccttacatgctgttgaaatggcaggaatcataatagcttatttcatgtgcctttgaagggttccagcaaatggagtctaagagaaggcagggatggggggtgggggtggggaggcaggaaaagggggggcgagagtgaaatattactacttaaaacatattcttagacataataaagcattaaagttaaaatattgttgagacagctttcattatgcatgttccaggcctcattatggaataagcagaagtgactgtgcagccgagacctaacaatatctgcactgaattcctattatgtaagaaaggctttctagtccctgccagtgtcgggatgtggtggttggttttcaataaaggtcagaatcggtgccacactgaatagagctaaaagtgtgtttcattcttttgtaggccacgggcactgttggggattgatctgaaaatctggtctgttgcgggcctttgctctcaagggagattaatattttagctattcctttttgttcagtgcttctaaatgtatttggaatgaaaagaaaggttaaagaggggctctgggacggctagcttcagagactagatcatttcatgaagggaaatcaattaaaaaaggttgactgtgaacatttatccatttagcttagccgctattgaattttcatgatggacttcgactcttcggagagaacggagttaatggcaattgttcctttctcctcaaaatttattatctggtttattcatggaaaacactccatcaaactagatagaggccttaggcctattgatagatttgcctgtgtggggttggaatggggaggtttgtcacagatgtccagcctttgaaggaaaattaaacaagtatctcattacagaatgcttcactggtccccggaggtggccacagacgcagtggatttaatgagctgggaacgtcaatgctgccaaagtttacctcgacctgtctttctgaagaactcctctatttaggcccactcaagcaaaggagaaaggcaccacgctgttttctccctttcaactccaaagaaggggataatgcactttttgtgccatgcatccagaggaattatgtgtgctaatttgattaggggagatttgattaactggaaaatgagggctttgctaagactttcacacgcttaatttatcccttgcaaagcagacgcaacattgtgtcatgaaactcagaaggcatatgggaacagtattcagtggttagacggcctttcagacccaacaatatcaaggattgccacggttcatattgggataatcattttagagcattcgctttgctgcagaatacaaattgggtttggcattgccagttaaacggttcaaaggataatgagattaatatagtaggaaacttagctgagcaaaaagcttttttttttttttaacaccattgcataactagttttaaggggaacttagttgaaaaatgcttggttttctccaaagaatgcattaattatgttttgtggttccatacactcctggtctttcttgctaaataaacatatcgtgcatcatccagatcttgctgaaatttgggggatatgcattgaagcagcccctgtttctccatgaaggtgtatgtctgtgagcctggctgtgcagttgggaggcctgggggagaggtcatgcttctaccatggcgttttccattttccttaaaatgtgcctcagcaacaggctgccaagatctaatcctgttcccctacccccatagcagttggggaattaccaacaaagtctttaccatctgacattccccaagggctgtgtaagggggcatcttacccctgctttcttgggagtatatatttttaaaaagttgaaaggagaccagcaatgccaatctctactaacatctgaaaaaaggtcttttttaaaaaaagcatttcacattcagaagacacctggaaggtccctgcagagagagctctgggctccatgtgccaacgatctttgaatagaatcccttggagtttctacccgtatgtcttttttctaaagatccccttgcccttgatgattgcaaacttccacatagcttcagaagccatcttcattgtgccaagtttatttacaagcagatttggccctctctgtactttggcctacatagtacaagcaacgtttgaactcctgttttgctcttagcaccagaagtttgggcttttccattaaaatcagtcaatcaggaaagagtgcatgcatgctgggttttaactttaacacaggctgggtttcaactttcatggtgaattaggactgtctcctgccattctcccttggcttgctgcactgtagaaaactgtgaaaggagccactaactagggcagaccactggcccaatttgaacaggactgctttgttttagctggacctagaggtttaaatcacaagacggctactggattcccttctccccgaccccctcatggccaccaccactagccctctgtaggaggagaacttcactgagcacctgattacctgttctcgctttaggattagatcaagataggacagagaggttgttcatttgtaggcttgttgccttactgtaggagtagttggattgagtcaagccatccttttccttgggaaacaggcccctgccgctttaagtggagttgctgggtaatcgttccgctcggttgcataaccagaaagggatgtgtcaggactgggacctgcagacagcgaaggctttattaaaacgctcgcagagacctagacagatgagtggtctccagttggagttctttccatcttccccatctgttcactgcagttttaattaaatctactgagattatttttggccttctccaggaacagaaagccagcctgtgccaatgtccactcgtttctgtgctttactgccagccactaatgagcaggcacatggggcacccctgcctgtgtgcacccccttcctttgccagccatcatgagttgctaatagggtaggaactaaaagtgccaagcccaggcctctccaccttctcccacctccacccccaccctcagccccaccttggtgctaaagaaagccagctaacgaatgattccacttgtggttagctagctaatgggaatgacaggcttcaaataaccttaaagcatgcagccccaatgcttgtctgtctgatcagggcccttctgctggcacctgacactttcaataccataatggcattcacatgcattctttttgaatgctgtcatatagcaagacctttcttctcttcgtttgctgggaggatgcctggcaaagctattaagtctgtgatgggaatgacagttaactgcgggcctgtcagtcccactttggaagtcagcacatccttatacccattaggagcatatcataggaacttcagaaataacctgctgcaagataccatcaggttgttgcgctgcctgcaaacataccacccaacgagctttgcacatcattctgccctgcctctcattaagggtctggtttgttgatatttggtagatatttgatttctgaatttcagattgggacatagtaattacttctggaaggtagcatggctgtccccaggtagttggcaggtggtggttcttcctatttatggtcagtgcttcatggatttgaggacttctgttagttgggtttccaagagaagttgtgtcttggaatccatttccctaattgaccccctaggtttccaaagcagactctaggcagatgtacattttttattgcacttgagtcccaaattctggcctaatcaccaacaccagtgcactgggcaggactgtgagtgagcctcagtttcccctcttgccccaagttcaaggcctacaagagacccatctgagtggcccaccctcctctgcgctccctaagaaggaaaggggtcaaagagagggatccgagtggtccagagcaactgctgcccctgctgagctgtgtttataacttctcattcctcccactgatagtctcacccctccacagtgatcccttgctctgttcttgaagactccattttcattgacccatatcagcacttgcattttggggttgatgttgtggaacctaaacaattagaaggttggacttagagcttttagagtcttgatttgtccatacatacagcttgactttctgctaagacacacgcttccactcctaaccagcaaccgagaatcaacatcttctgtgtaatttccaggaaatgcctttcaaactcactgccattaggtagctctccaaacttcacttagaggaacaatgttttagaaggattccaaaaataggaataagtgcagtcctttttctctagattggcattttctgaaatgtttcctggaatagtcttttcgtaatatattaatagacgccactaggataaaggattttgtttgaaaagtgttggattagatcaaattaagcaaagcagtggagagggcaatattatgctgtgtttaccaaacagctttgaccacagaacacctaggaacatttcatagatcccttggaacacagtttgggaaatgctactccagaggatctggagtaagacaaaccagcagagaaccagagttagcctttctggtattccagtttagaacagcaccatatgctctgcagatagaggctctaataaccctatgacaccaatgccaggacttttgaatgaatgagtagaaaaaaatattatttagtgtgctatgtgttgttttgcttatgtagatccttgggagaaataacactctgattgcagagttacgaataattgagccttttttgaagagttggttttccttttatcttgcaacccccatgaactgtgcaactgcttagcttcccatcatcaccgtggctgctggaagcctagagccagcttcctggcccatctgttataaataagtggttaagtgatgggcagacttcatttccatctccactgtgcatacccacatggtttatttttccttcttttctaccaataattttaaaaatcctcccccctccctgttatcttttaaaggtaccctaaatccttttggtcctttaaggtactttaaatcctttatccttttggtcctttaaggtaacttaaatccttcggtgtagggaatatgtaagtgatacataacattacctgttaccagtcttagctacttaattgataaattgacattggcttgtctgagattattgtcattttgggttgatcaacaaggttgatgagcagttgatgtatagccacagctacggcaacagtttcttagtttcagaacataccatgtgttttgtctggagactctctaatcactgaaacatgaaaacaatttactaagctatgtttttttccccaactgtggcaacatcataaagcatttttgttcatatgtgttttattgggtttttttttaatttttttctttattttttttttattttttgagatggagtcttgctctgtcgcccaggctggagtgcagtggcgtgatctcagctcactgcaagctccgcctcccaggttcacgccattctcctgcctcagcctcctgagtagctgggactacaggcgcccgccaccacgcccggctaattttttgtatttttagtagagacggggtttcaccatgctagctaggatggtctcagtctcctgaacttgtgatctgcccgcctcggcctctcaaagtgctgggattacaggcgtgagccaccgcacctggccttttgtccatatgtgttttgtcctcagtagattcctagtagaatatgaaaataatttgcagaagatatcctagaaagttagagctaaaagggaccttaaagatcatctagtctagagatggcaaataagtttcgattgtcctgctatctatggtttgttagttggctgcctggaggcttgtattgaagattctgggccatgaaggcatcaaaggctaaatcgattagtgatgtctgccatgagcatggcatgaaggcaaggaagtgtgcatgctgcacattttctgtccctagtttctcccttttgaccaatgaaatcacctgagacagaggtggcactagaaatcacgtctttattctaagtccaggactctttgtaaccccatcttgctgaagtaattatttttcttccaactataaacgttagtaaactagagcaccaaaacaatatgcttcttctagatttgccattgagttcactgtaaagtgaaatacaaaaccaagaatcagtccccctcttcattatttttcccaacttctgatatagttgaggaacgaggcctattctatactgggacctacccaaatttttcttgtttatacttagccatattatcatgatttggttttttttaattaagactgttttggtaagacatattctccagcaaattcattttccctgggtccttctttggttaagcatgttgctagctatagccaaaccaacaggtctaagatgcctaagttatattatcttttcttttcttctttcctttctttctttttttttctttctttttttttttttgagaaacagagtctccctcctttgcccaggttggagtggtgcagtggtgcgatcatggctcactgcagcctcaacctccccagggttcaggtgatcctcccacctcagcctctcgaatagttgggattacaggcacatgccaccacacctggctaatttttgtttttttagtagaaacagggtttcaccatgttggccaggctggtctcaaactcctgagctaaagcaatccacccatctcggcctccacaagtgttgaggttgcaggcatgagccatcatgcccagccttatattctcttttctaaaaaaaaaaaaaaaaaagatgaagggaggaacattttagaaaaatcaagttaggcagctttgctatctcagtatgcaatgctgagaagtgtcactttaacagacttaatcctttcaaataataattcaaatgaaattgagatgaacagtttggctcttaaggactttttttcttgagacaatgggattcttttttctaagcaattaatttgctaataaaaaaaatggtgctgccctgttccttatttgctttatttcatgagaaatcaggttggcaatcttgttcacatatttacccatggaacattccattccatctccttcaatgctgaagacatgggtttcaagcctaccctgcccagggataagacagagcaggtgcaattaataaaccatcttttcaagctttccttccagtggtttgtagactgctttctcctgacatgagtcaagctatttaatgtgatggaattcatcttgtaaggctctctccattcaggctaagtgattgaattcacaattcctctgatttagtgcctcgtttgtcactttcttgaggagaggtttttggacccatttagttgggagattggctggagcaggaagtcggggagaatctgcccctaagccaccatttccttccacttcaaacatgattcataatcagtctggaagaagcaggaagatagaggatgaccaactgctctgagaagcaggctgctgtgaagttgattacgtttgcaggacagcctctaagatgtcttcgaggccaggacacagaccctctagaagccagccattttagccacttggggctccacaacacagtgccttcgaacgtaaccagcactgactcggtggtgtgcactgggcctcaaagcacattcccgtctcttatcattcagtagcccagtgccaattagagtggacgtactagacggtttcactcttgcaaccctgaaacagtggagtttcagggctgaaagccagtctgacttcatcctgaccttcagctatgcacatgtgccctgcgctgtagcgtggctgcctgctgaatgggaatggggtaggtgtgcttgtcccagcatcattgacattccaggaggctgcttcctgccggtcctccccctcaccaggtaccatgtttcctattagttcttcaggaaggaaggcaggtcaaaagggtggatgaagtaggtcagaaagagggcagtctctagtaggaggggacacagacttatttactggtaggaattctctcctgtggaaaaacagttccgaattcagcctcaggatacaagccccacctctggaggtgctcaggccatgagggctgcagctgcaggtcttctgttcgtcaacctttttctcttgagctgaacacaccagactccctgcagaattgcttgggtgtgcagggagagtcaggttattttttaattgaaaaagacattttttcttgagaacatgggaacactacaaaccttcaaggcaaatggaagaacaaatagatgttccagtgtctaggcccagaacaggaagttttacgttgtgtttaacagatacgacaggatttgcagaggaactttaaaggagcccaggagtccgctgaaaatgtatttaaagttttgtttgtgtgcttgtgcatttgcctcagaagatggttcttggctttcatcagattttcaaatagaatctgtaaccaaaaaaatagttgaggctgggtgtggtggcccatacctgtaatcccagcactttgggaggccaagacaggaggatcacttgaggccaggagtttgaagctagcctggacaacccagtgagactcctttgcttcaaaaaaaattttaaaataaggccgggcgtagtggctcacgcttgtaataccagtactttgggaggccgaggcgggcagatcacctgaggtcgggagttcgagaccagcctgaccaacgtggtgaaacccccatctctactaaaaatacaaaaaaatttgccgggcatggtggctcatgcctgtaatcccagctactcgggaggctgaggcaggaaaattgcttgaaactgggaggcggaggttgtggtgagccgagattgcgccattgcattccagcctgggcaagaagagcgaaactccgtctcaataaataaataaataaataaattagccgggtgcgatggcatgtgcctatagtcccggctactcaggaggctgaggtgggaggatcgcttaagccagtgagttctaggctatgattgcaccactgcattccaacctgagcaacctccaacctgtttcaaagaaaaaaaaatgttgagattcattgggctcttaaccagagactaactatgcacacgccactttggaaatgtatgctgtttgttacccaccacagtactctcacccacctgaccccttctccctatccaaccttagccttaaccaagaacagacctggttcctagtaagccatgtttccattcaccaaggtttggggagccttccctgactataaaagagactctgctatcacttttatttcatcttaattcaggcatttttttaatgtggtgtagttgacttgtttctaaattcctttacattttgtattgttcacacagtaaaaatgtctattttaccattccccattctaatttttcatcatttagtcaaaggtggggccaaaattgagctttagtctatgtatagtaaggttttgtttcattttgttttgttttctttcaaccagaagaataaaatcagaattttagagcttgtcttacccaacccacttttttttttttttttttaaccagagatgttaagtcgtttttcaaggtcaaacatctagttggtagtagaggtaatgagttgttttattctttgctcttatcgaagaaaggaaattatagaattaatggaattttatgaagttgggggttttctttatcgttatcattaaaagaacgcagtgtggttttatgaaagcctcacacaggctgtcttctcagcccttttcagacccgcactctttcctccatccacatcctctcccttctccccagccccaacccttccttccacgtcaagctgagtatacaaagcatcccatatttcaggctgaggcctacggagtgggttcccactggaccctctagcagcctgcattctccgacttgaatggctgcatgtggagagtatgtatatttgttcagagctcttgctttaagttaccccttcccaccacgttgcccaaagaaataggaatgtgaggggaaaaggaaaggaaaaataccacaggtattttcccctctggggaagcttgggactcaccacttcacagaattcaaggtacagaagcatcttttcatttagcagaaggctgcaaagtgtgggtagaatgctgagttttgttaatgaattgctgttcatttccctcttcatcgttcttagtagcttttagaaaatgtgtctgcttttgacttgagccttctacaaggccagagatgtttctacagagagcccttttcttgcaaataagaactcctttcacttttgttcatattgtcccaccatgttgctgcctttaaaaaaaatgtgttgtatatataacctagattatgtccctataaagtgagtttgtaacgactccctcatgagcttagcaaaagtatgtctagacaattttttttggcttttccccccaaacttctttgggttaaaaatagggaaggacttgttttaatacagtgtagtactgtatctttaaccttttgtccaaacgcatattgcctgtttaagttttatttagagaaagtgtgtaacttataaaccagctcgctcagaccttggggccgcccctggctggtcttcctgctgcccgtggattagcctagtctccagaagtgttttacaggaagcttaggcggagggaagcacttaattattatccaaatttttccctttagttaagtcttacggtaagatatcccagagattatatttttagcaaccactttaaagagactggggagattaatttaaaattgataatcgcatggcagcaccacagcctaacaagctcaaggtctgccttgtggagctggctgctctctggggaccccagttcaattctctttgctgccagttgaaatcagaaatcacaaccgcagtgattagcagtgaattccctgatctccctgctcgaggcagagggagagggggcctgttttctaagtagccagtcgttaactctttcatgggaggggcggaggcagaggtagtgattcatgggtgtgaggtggggcctagtaatctacaccttcacagaaacttcccaggtaatgcttagagtccccagctctgggagcttctgtttttaggggagtggtggacagtgagtgaagaaagagccttttgggcccatccaaggctgccctccaggcaccatgaccgctgaaacccgcaccgcacggctcaggcctctgccgagcaactctgtccttctgggcgagcctttctttgtggaagaaagcaaaaaaaactgccttctgtccctcttccagcattcttcttttaaaaatggcctctggctaccaagtggacaattatggatagctctgtagagcagcggtaagcagtgttaattagctgcaggatatcagaaacaaaaatgaaaatattttccctgtgggccaaacaaaattaattttaaaaattaatgtaaaccactaatgctgcaagtgcctccattaaattacaggactgtgacatgtacaatgctatatttttgccgttgaatttgttatctaagaggtgttcattgtttgttacggtgtgaaaagctgttttcctccagataagcttgttcattaggaaactggatctctgccaccaccctgtttcttcgcactgaagtaatgccctgtagcataaatgtagacagccgcactgcatttaatatcagaaatgtaaatcaaaagcgtccagtctggttttaaatggcttcagtctttcccagggtgaaatctggggaaaaatttcttctctgtgcagcttctgacaccactgctttagcagacaggccctgaaagcaggctgataattattaaacaaagtatcttgtttcccactgaggtctccggatcgctctgtcattagactggatttatttctagggtttcattcacgctgtgacagcttgggatttataagttctgtgttttaatttcaggcagaaatgaaactggtcaattgcaatttgggagggggaagaacccttgataaaagggctgtgcatcctaatgcctaaatacagagccagaataaagaaggcatcttgggtggcatgctgcgacttcagccacagctgccagcgaacttgagccagccctgggggcagtacagagacaggccgagaacgccatgcttagtgcagccccagagcaccccttcacaccacaggcccctgttccagggaggcgagtgctggccttgctctgaagaaggaagggggagcaaccaggaggaatccctcgtcctgccagccacgaagggcgtgtgctggggcagtgactgaaaacttcagtgtttctctggctctgtcttcattccagaagctctggcacacaggtggaagcctggcctcacccagccaggagcatgtaggttctccttgaacctctgcaccctgcttttcaaggtgttgagtaagctcagtgtctgatttctttttttcaaagggaaaccaaaattattaactcctctgatatcctttctggctcctatttacttacttagcaagcatctaattcagcactatttcaaatctgaggggtgtgttggtaaccagttgggagctgagagaaaacctgattagcagtaagcttatttccatagaaacaggccaattaagatgctgtgtgaaaaagcagtggagagccctgaccagtcaacttttgggggtcctgcagggggcaaactgtccctgccctgctgtggaaacagctggactgacacacagagaggagactctagtcctctggggggtgctgtggctttctgcggggctgctggtgttttcttgcgctcagagcactttacaacacaggcctgaaacagagcagcatcaggagggtcgctagagctacactcccgcttctcttccagaatcccctatttgactgaccaggaaactgaggttctcattaatgacttttctgccaaaagaggcacaaacaaatgaactccttccgagagccctatcagatgttgcaacgtaagaggcttctagtcggtcatacagatcgcgtatattaacataggaactgatctgccatcaccaaggtgaccataggtcctggtttgcctcaaacagccccaatttatgcctgctgtacttgttaacagtggatatcttcactcttaaaagtatccgagtttgaattctacgggatgatcaccctcgctattacccacaatctagccagttggttcaaggcgaataacccctaatgggaccagtgaattagaatctcttgtttaaaagttgtggaaggctacatgtgggacaaaaccaatgaaataaagatttatttatttatttatttatttatgtatgtatatatgtatgttttgagacagtgtcttgctctgtcgcccagactggagtgcaacggcgcgatctcggctcactgcaacctctacctcccgggttcaagctattctcctgcctcagccccctaagtagctgggattacaagcatgcgccaccatgtctggctgatttttgtatttttagtacagacagagtttcaccttgttggccaggctggtctcgaacttctgacctcaagtgatcctcctgcctcagcctcccaaagtgctgggattacaggcatgagcgatcgcgcccagccgaaataaagttttaaaacactcgaaacaatgctacatggcatttgtatctatgtacaaatatagcaaaagtataaatgccataccgtgcatgataaatatcaaattggtgagtgtgtaccctgcgggaagatatctgaaatatatatttctccagctatatggtggctctacaggttttccttacatgtattcttatgttatcctatacttttcctgtagtccaaaaatatttcataatttaaaaagaagcaagcaggccttcagccaacagagaatggtttcattaaagtaggggagtgtatttgttggggtgcatgtaaggaagggaaggattctatttagggttaaacatctcaagaattgctccaggaaatgatgcgattgggagcatgactgaagcgttgcattgtactctgggatagcactggtagacaggcactccagaaagcacaggatgcctgcccattgcattgatgtttctcgagttctcagcactaaggcttgcatcctaaactctggtgtgggaaagctagctgcatatttacgttctgggtggatttgcctccggagaccctgctgttcaatcccattcagtttgcaggttaacatttactgttcctgtccttgaggtcagcacttgcccacagattttcctaatttctttattttactcttcctccaacaattgcaataacttggatactttctcttcactacttgcaggaaacaggaaggaggcacacagtgtgatacacagtcttgggttgatgtctgttttcaaacatgtttttggaatctccatttgagtagtttaggtctaattccagtcataccaactggcttataaaagccaccaggaatgggtaaaattgctccagaatgggaagggagcagcattccatatggcaagggatttttcttttttcttttttgagacagagtctcactctgttaccaggctggagtgcagtgatgccatcacggctcactgcagcatcaacccccctggacttgagcaaccctcccacctctgcctcctgagtagctggaacaagaggaacataccaccatgcgggctaattttttaactttttgtagagatagggtctcactctgctgctcaggctgttcctgaatccttgggctcaggagattctcccatcccagcctcccggagtattgggattacaggcatgagccaccacacctgcccaggaagggatttttcaagaggaaatgagacagaaagagtttggactgagtgcacatctttctctaccctcaatgatgtttgttagcactgcatcacctggcctagatggtccttggcaactaggtgactgatctgagtattttacattgcagcatctgtacacaggtgatctgtatacagcaagtgattcctgtaagctccttgacaataacagcaataataacctttactcagcacatgctgcatcccaggcactttggtgcagcactttacatgactttctgtcttccatcctcacagtcaccctttgaggtgggtattaggatgaaccatgtgaaactgccatttttgtaggtcaaaaacagtcaaatattggcaattgtatgtggtccaatctaataatctttttgtaatcaaaaacagtcaaatattagcagtcctatgtggttcaatctgatcatcttactgtatttgctttgcaaatagagaaattcagacattgaaacttgctcaaagtccacccatctaccaggtgccagaactggaatttgaacaaggtactcccctccacaccctcacactgaactgccgccgcacagtgctgtctccttgggtggaagaaaaaggcatatttttgtggcctaggtgttaaataggttcttcaacaacacctcggccaactttgagatcaaagatggttggtcagatgaatcaaatgtttcctggagtcttgggttacactcgtaatgctctgtttaaaaggaatgatatgtagtgagcacatcagaaatctggaagatggaaaatctctctttaggatctctgctcctctctcgagcaaagaaagaaatcggtgtggtgccagcagaggtgttctcagcaggacctggcccattaaatgaaagacttccatgctgagccaatcaagagagacctggacaaaaatcagactctttcctgccctggaaacccatgccttgaatctgtaattcatctgttaaatcaagtgtgcagccggtggtttagcacagagggggacgacggggaagagagaggggcaggagctgcagcacttgaatttccagcatcagagtccagttagggaaaagaaacagagctgtgatagcttcttggaccttatgtttccagcaaagagaaagcagcaggaaagatttttgaaaacagatgagctggtggaaggtattagaacaatggcggaagaggcagggaccccaggggctgaacaaaacacagttccgctgttgcctttcaacaagactgaataaagtttaggattttttttttatgggacttgtagccgtttttaaactttcatttttcataatgtcacagataatctttttatctattatccactggctcttttctgagaggcatttgcatcaaatagtgctgtacagatcatgactgtctctagtggggaaagcagcttgaaatgaaaggttattcactccctctgctttcgctggctttgttcttgattctcacacatttttttacatctgaattcgggtatttctggagtttttctttagaaacccttccattctgagatctaagcatattcagactccgatctatatatcaggggttacaaagcttatgcctactgaaagtgaagcatgtactttgaaacatttgttggataccccatggtttccaaaatcccttcagagcatttcctacagaggcagcaaccgtaaaaagcggccagtcacacagtgggggccctttccctagcactggcctcctggtggcagtggagcagtggccttccaagcatgcactgcgagacatgagtggggcaatccgctccttccaactgcagggagaacgggtctgcagaatgaattctctttctccactcctcccatgtggggaacaaacgagagccctcccagggggcgaagtggagctgcaggagagcatggtggaaaacccaggagccacctgggctaacagggaatcaaaaatgacctttttgtgcacaaaaccccctgggaaaaaaaatgacctagaaagaagtggggttatggccaggtgcggtggcttacgcctataatcctagcattttgggaggctgaggtgggcagatcacttgaggtcaggagtttgagaccagcctagccaacatggcgaaaccccatctctactaaatattcaaaaattagcgggatgcggtggcagacgcctgtaatcccagctactcagaaggctgaggcaggagaatagcttgaacctgggaggcggaggttgcagtgagccgagattatgccactgcactctagcctgggtgatagaatgaaactctgtctcaaaaaaagaaaagaaaagaaagaaagtcgtggggatatgactgatagtttctgttcagcttctattatagtttcttaactcatcaccccaagctccagggggactctgggggaaggttgagaccaggtttgttctcaggcctgcctgacagagcccctcaggaaagcatcatccactccagctttctcctctgctgttccccactcaaacactcctgccattccctctcagaaagcccagaaacctttcttcccctccccaggaggagggagagcagtctgcagaggcaaggcctgagtggccacaatgacttaggtattccagctgtgcccagaacttggtctcagacaagtgcacccaggttagtagtgacctcagagaacagtggccaggaacttgtttttgcatttgtgtgtgtgtgtgtgtgtgtgtgtgtgtatgtatgtatatatatatatatatgtataaaataagggggcactggcccccagagaagtactgacaacaacctctggttagagggcagttctttgcagcttttgatgacaacctgcgaggagagaatgttgctctcaattgttcaagaaactgaaagcttagagaggttgaagcgatttgccaagttcacgggctggtgacggagtgggcctcagaactcagatctttctgactcaaactgccttgttcttaccatcccctatctccctagaggttgttagaacttttgggggcatactgttcctttattttagaaactctttggatatagggtagtggttgaagcagctctgaggatctgttttgaagagaagggtagcattgttagactagtagggtaatttccttttcccaagctcgtccctccagacctttgagccggtcatcatagttttatattttatgaccgaaaagaaacttctgttaaatcgtaaatacactaaaagccctggtgcctaaacacatgaacgtattatctccttgagcctggaaatctcccagcaatgtggcaggaatgtagaaacagtctgagttgtcaacaaaacataacagatttcccagttgtaacaaacatacgtgtagttgtgaatggaaaactctcccaataagcaaaataatggcctttttcgtgttgttttcctcatttaccatagctgtcctttcagagtgccatcggtttcaaatgtttcattgtattgatatttataacacttctagtaagcagagtgcccactacattatttttatttaactctctccagagttaaaggaacttgtagttaaggtgtcatctttcagatttacaattttacctagattggcaacatgggtggcaaagtgcttggaactaagacagaaaagttggttccagtcctggcctgcctttgtgtgtgacttgagtaaggctcaggaagagaggctgctgatacccaccccacctgtccccaccccacctgcccccaccccagatgggtcccaaggcaaatgtgaaagattaggtgctcctgaatgtgacaccagacgtggtgtgacagagcccatttgtgggtgtctgtttcaaagcttttggttcataggccatgctgcccgctttgctggaggaaagttccaagacccacaccaggctactccttgacaggaagcttttgttcctagcaacgggtttacccagtctttgtttgtttgtttgtttgtttgtttgttttgagacagggtctcactctgtcccccaggctggagtgcagtggtgctatctcagctcaccgcaacctccacctccaggttcaagcggttcttctgcctcagccacccaggtagctgggattacaggcactggccatcacgcctgactaactttatatatttttagtagagacagggtttcaccatgttggctaggctggtctcaaactcctgacctcaagtgattctcccgcctcagcctccgaaagtgctggggttacaggcatgagccaccccgcctgccccgactctcttcttaatatgctccatgcgtttgtttatgctccccccacctgcaacatactttgtagtctacgcatgtgtcagggctatttgctggtctcttttctctcaccctgatctggctgtgagcagataatcccccattcctcaatttggctggtactgcagttggcacggctctccaaactctgcagccaccagacatgtagaaacaaacctctaggcttcccaggaggctcacggactgcctcatggctgagccttcaatagagatgatcatctatgaaaataataacaaaaaatgttgctggttataaatgcaatatatgctcaatagaaatagtagtctataaaattagaaagttatgctgttataaatagaatatatgctcattgtaaaaatgtagaaaatgtaatacatattaagaaaaaatattcatatttgccatcgatatatattttacatatttgtatgttttttcagtatgacacatcaaagaaagggcagaatcttctttcttctcttaactttttgtcgtgagcaatacagtgttaagttcagggaaggaattgagttcggagccaaactgcccaggtttgaattcagctctgccacttgctagttgtgtaatactgcttttttgtttggtttggtgtattttattttatttattttatttttttttgagatggagtcttgccctgttgacaggctggagtacagttgcacaatctcagctcactgcaacctccgcctctgggttcaaacagctctcctgcctcagcctcccgagtagctggattacaagtgtgtgccaccatacccagttaatttttgtatttttagtagatatgaggtatcaccatgttggccaagctggtctcgaactcctgacctcaaatgatcccacccgccctgtcctcccgaagtgctgggattacaggcatgagctaccacgtccactgcctgcctgtcttttactgaagttgtagatgtcctctttgcctattctctgaattctacccctaccctacccatggtgacccacagagtgctttgtatacaataggggtgtcattaatgtttgttgaacataaatgaattaaaatataacatcctaaaagtgatttcaaactttggaatttaggttttgttgtttttgttttttattagagacggtcttgctctgttgcccaggctgcagtgcggtgccaccatcttgactcactgcaacctcaaacttctgggcccaagtgatcctctcacctcagtctcctgagtagctgggactacgggcacaatccaccatgctagctactttttttttttttcttgtagagatggtgtttcactatgttgcacaggctggtcttgaactcctggcctcaagcgattctcctgcctctgcctcctaaagtgctgggattaacaggcatgaaccaccatgcctgacctgactttggacaagttatttggcatttataattccactttctcatctacaaaatagagacaataatagtacctacctcatggggctgttttgaggaattaacacaaataaagcacttagaataatgcttcgtgctgtgcagtaagcactcaataatctaagttggtaatattcctgtttttatatcgtgttttaataaatgagaacataacattttaaaatcaaggagctgtgatttcatgctctgcacactgcctcagtgacataaagactgggactgaagctggggcatcactccctttggtttcccctctcctaggcccttagtcacatacaccttggagaacaggcacaaccgagaggacctgcatttcagtgatgtccgaggccaagggacaaggccagattctagtcaggtgataatggaatgagagtgttcactgcacatgtcttaatgaatggagatgataaggggtcaccaagccctatatatttatagtgctttatttttcatccaaaaacacaaagtgctgtttagtccccacaacaatcaggaaagcgaggaactattcttcccactgaggggatgggaaagctgagtccccttggtgggaccgggctgcaggcgcagggacttgctcccctcaaactgttgtggtctcaccacagtcaggaccagtcacttgaacagctcccatttccccagaatgattctatagagaggcaggagaaccctggaccctgagcaggagacttcagtccaggggccagcagcgcaagcacagcgtcatagaacatcatagaacatagaacattattctgctcagggcaaaataatgtgggctgcacagtctggcccaggcagccctcagtgttgtgccctcaagtgttgagatgacaggaggatggggtcaggccagtgatcctcaaagtcagaagaagaatactatgcctcaatcctactcatttcctttccaaactctccctagagggcctctaactgtggctgaggggaggggcggcactttttgatacacggtgcaacttgcccactttgaccctgacctttgctctgtccccttcaggtgaccctggcaagtagctttttagagcagtggttctcaaacttgagtgtgtgcagaatcccctggggttggggggcagggctttgaaaatacagattgctgggccccacccctagagtttctgatacagtggctcagggatgggcccaataatttacatttctgacatctgggttcctggatgctgctagtggagagaaccggtgatttgatagcattggtgagctggctcaactctctgctcaggaaagtgacaggatgcctcaaatgctgagtgctgcgtattcaaattccaaacacaaggcaactaggatgggagcccttctagactctgtgtattcaaggaccagggagaggcttagcagctctcagctctcctggcacagagagagttctctgaagcttgctgtttttctctctcctactttgatagtttcctccatttgtatgggcggaggttgcaaaggccagaatagactcagcgagagtgggagatgggggtgagtgagtgtgttcacttttgatgaggagcagatgtgacaagcactaaaatggagtgggcaataagaattattactagctgaggccgggcacagtcgctcacacctgtaatcccagcactttggaaggccgaggcgggtggatcacctgaggtcaggagttcaagaccagcctgaccaacatggagaaaccctgcctctactaaaaatacaaaattagtcgggcgtggtggcacatgcctgtaatcgcagctacttgggaagctaaggcagaagaattgcttgaacctgggaggcggaggctgcagtgagccgagattgcaccattgcactccagcctgaacaagagtgaaactgtctcaagaaaaaaaaaaaagaattattaccagctgctttgtggtcaggatgtcccaagctggcactgcagcaaccgctgttagggggcttggtgccatttgcaaggatgtcatcctcagccactggtttctaggcagcccctccaggaattcctcttccatgcacctccttgggcagagcgttgaggtgtggtggctgaaattcaggaattattgtggaagcttgagtttgcatgcccactccgtttcctactaactagctcaggggcgggggagtttctgaactatgttggcatagttcagaaacttaatgtttaagtgtcttaatgtatacgatggagataatgctctctgatttactgacctctcgggttgtgggctagacaccagagtttcagagttctcggtgcactgctgtgtattcctgggaatgcccctgagggtggagctctctgtaaggaaggcagccccaagggcagggctggtctctttagaaagactaggaatgaggacacccggcgtccaggcctagcttttccacccactcaccttcacagctccttcatcctttctgcttcagttccctcctctgtaacatgaagttggagtagatacttcattcagagcatcttccggctgtaaatggcttgagcccattgtcaactggaagacagagtgtgacgtctaaaaacccaaacagcaaagagcatctcttccaaaccacccaatctggagaggtggggcagttttgtggttccggcaccgacaccgtccctttcacacggtactgagccgcgggctgcttcggggcggccctccccgccccgtgccttgccgggatggcagagcggatcagaagctgcgcgcgctctgcctgcgcgctttgcctgcgcgctttgccgccgcaacccgcgcagcagccaatccgctggtgcactgcaggtgacctcccccgggcccgggaataaattgtcaagtttccccaccgtgggtgtctttgctagccggcgagttgcagtcttctgagctaattaggagacggtcatgaggagcgaggcgggccggggcgctccgcgggccggggcggggctggggcgggcggcgcgcagctcctgggccgaggcatccgcgagccgcgggtagatcgctcgcgtctgatcgccgcccgggagctcccgcggagccggctgccaggactcgttccagctccagtgcggggctgcccgggcgtccagaggcggcggacggcgtgccggcaagtttccccggcacctgccagtgcccgcgaacccacctcggaagccagacccggggaggcagaggcagaggccggctggctccagccgtggtaccgcacggctgccaccctcggacttccgtcttgagtctcctgaggctgagaagcagcagatgccgaacctgccccctgacgtggacgtacacctcaagacctaaaatgcgccctgcctggagactttgaacttagtcttctggaaatgcggagaccgcttcgggtggttttgtttttgcatcctcttcggctaggtttggctttgggattctctggctacctggatacgcctttcctttgtgggcaagtctcccgcggatcgcagcaccagcagccaaccctggggcacaccagcctttaaaacccccgagcctggagacgcatggagctagagaagaggacccaactcctgaccacgtaaggactctgattccacctttcccgtgatggagagaaatataatttcatggcagaattttctttaagcacattgtctgataggattggcaattactaaccaggaaaatgagtagcaattaggagttcagtaataaatggaagtctattgtcctaattgagtggaattactgactggtaatggcaacactgaattcttcagtttaattaagagtttatataattatagtgcactttttatttcttgggggagccatggggtaggaattaaataaccagtgtgatggttaagaaacccatttaatgggtaagtaaccaatgagttgaaatgaatgtgagtgccttgctcaagcaatgcaaacttagatgaattcctgataaagagatgtaacagcttgggccaagcaagactttcagctgctaattcctgtctgataaaaatctgaacggcttagaaatgattgggtaatctctaaaactggcacactgaaactgttttagagataccagagctccctctctcctgccggggtattaaccccgatttgtgctctctgtcgctgtgttttccacattcttcaagagtgaaacgagtgggtcatttgagagtgcttttgcagcctggggtttctgtatggaaaatcttgtgattgagctgttgagctgtaaatgttgatagctgaaggggatagacaagcttcatcgaagttactcaaattcaaagcagagtgagtatgtaggtgtgcaatttgggaactaatctgtaattataaagatgttattttcctctttggtggtgtattgtttcctttactattatgttctcaagaaattgttccccttgtgggaagcagtgaaattggagagaaatccctgctcagaggataattacttatatttttggtgtaggtttctgggaatccttttaaccctacattgggatgcacatatttatttccataagaagctccagcaggtttggaaatcactaggttttgaatacactggtagataattagcacttcaagtaacaatatttatgccactctgtaccttgacttctttttcttgcttacacgaggtctagattttcaacaggatgatcagggactaccttctctagagagcttgcatattgcaagtgggttcagggagcaccattatagttgcatttcactccagaagagacagtgagtggcatggaaggggcattgcatcttgaatactgcatgcgttttaaagtttgcagagcttattcataaatccgcttggttaatgagaaaaaagcaggtatcgaaagacgtttgctgtatgtgtgcctcccagtctcagcccttccaggtgctttgcaggtccctaagtacagagtgtcactgtccagaattttaagggcttacctaccctggtttttcccctctcccctagtcctgttttgtcattgctaccatgaaaatctagcaaaagtgtagaaagttgtgtccttccagaaccacggtttctcagtgcaggtttactgtattgagcgcccactccttttctgtttgtattctgcccaaggcacagcagacattcactccttttatttcccatgaaattgtacaacaggcagaagcttgaagatacaacacggatggaaatttgagccttgtaacgttcaaaaatgacacaattgccaagtttcctaacttttcctaagagttgattaaagatcacaacttcatatcgctcctttttccctatgcatttgccgtccatcacacacctgactgtgagctgttgtaatagctagatgaggtttaaaaaaagagggagtaggggctcaaggattgctgtcctctcagaaatgttgcccaaggctaccctaaggctcagcctacccccagattctctttctgacaagtgggtgtttggtaggatggtgtgaaagtttccttctatgataacatctttaagatttgtttccaaattcccttttttttctttttgtaacctgctgagaatatgagtctgtaacctatgtatttatctgaagtcagcctgaacagatagaaaaactgagttacaaggtatgggactcccagtaaattaggaacagatgtgggtcaaaaacagatttccaaactctttatcaaatgatcccacttggaaacaagacatgaacaggcctaactactcttaaaatgcaaggtttgtctgagggcaaacatgctggaaaagatggtggccaccaccctgcctctacttttcttttcctttcatctttcttcccaccgtctttggttccctgcataggctgtgtagtgggtatcagtcagcacttgtctgctggttgcacaatgcagattactcacttctgcccaagtaactccctgaagccgtactgtaacaatagagcatataaaaaagaaactcaggttgatcttggcccctgtccaaggggattagctagggagcacctgaaaggcctgtgttgaacacactcacctgtaacccagttccatggcctggatctcaaggacagggtaatctcagtaccttttaatgacctagtaaatgtggtatctttctgtctttacactcgacctgatggctcatagagtctcctcattatggagctggaggagtactttgaggtcatctaggccctcactactcaaagtgtggaccatgggtcagcagcattggtatcaccaaggagcctgttagaaatgctgaacctcaggtccatccctggatttatagaatcagaatctgcgacaggttccccagatttctcatatgcattatgacaggtggggttgtcccatgatccaactctgagatggagtttagccagtggcgtatttattaaggagtgccctttggatcaatacctatgggaaggaggaggaaggaacaggaataggtaggtagagcaagaagtcaagcagcaatacaggcccagtgacagtcatcactcacaacacgggaagctacacagctaggtcagccttctaagttgtctgtggtgggcagggatggccaggcctttcaactcactgcagacagcactcccagcagtcagcagcaagtctgtcattagacagggatctgggtagctcatcacagtgtccaccacatgcactgaagttgggagaagctctattctgggtcactggttctcaaaatgtggctgcataccaacaggaccttcagcaccccggggactcattagagatgcacattcctgagccccacccacagctactgaatcagaaactagggtggggctcagcaacctgtgttttcacacgttctccaagtgagtgctgcatgcccaagtttcagaaccactgctccaaggcagccttttttctgtttgttttgttttctaattgttattgaaatgattcacagtccatcttaataataaaattcaccactttaaagtgtacaattcagtaattttgtggggtttttaggttttttgttttgttttgttttgttttgtttttgagacgaagtcttgctctgttgcccaggctggagtgcggtggtgccatcttggcttactgcaacctcttatctcctgggtcaagggattctctcgcctcagcctcccgagtagctgggactacaggcgcccgccaccactcctggctaatttttgtatttttagtagagacggggttttgccatgttggccagactggtctcaaactcctgacctgaagtgatctgcccacctcagcctcccaaagtgctgggattacaggcacgggccaccgcgcccggcccaattcagtaatttttagtatatttataacctgtttagtatatttgcaaccctcgcctttacttccagaacattttcattatccccaaaagagatcccacacccattagcaatcactctctgcaccccctcccaaagtctggcagccactcatctgctttctgtcactgtgaatttgcctgttcttgatactttatttaacttgagtaatgcagtatgtggcttttgtcttgtttcttaacgttttgagagtcagccaagctgtaacatgtatcagtactccatttccttcatgggacaaatcatattccattatttagacagtaccacattttgtttctttattcatccattgatggtcatgggttctttctactgtttggttattgtgaataatgctgctgtgaacattggtgtacaagtttctgtatggacatatttcttcaattctcttgggtcaatacctaggagttgctcagtcatatgttaactctatgtttcactttttgaggaactcccagactgttttccaaagtgactgtaccatttgacattcttacaagcagtttatgagagttccagtttctccgtattatctccaacacttgttaatatctgtcctttttattatagccattctagtgaatgtgaagtggtatctcagtgtagttttagtttgcatttccctaatgactaatgatgttgaacatagttttcatgttttcattggctatttgtacatctgctatggagaaatgtctattcagatccttcttagggcagctctttttgttccttaaggaatccctcagtatgtcagctttgtgtccagtcctgtgcaggtgttttaggatttatgaaacaaagcctacaacctgtggccattacccactggaaagttctaatcagatgtgaaactgtctaaaaaggggaaaggaggacaggagagcccactgtcgagggttagcatgaagagattcacattctattacaattcgtgcttcagaaagacacggtgtgacttgctaggatagagtggtgtgtgtcagggatgtggcggctgcagactgctggagaagactgggaatgttgagaggaagaggaacaagtagagaagcggggacaggaagttgtgggcagaccttctagtattcttttatgggttacacacacctgtaagaggggatctcaggagcccaagatttctttcaagatcatgaccttcaccagcctcagcaaggtgaagcagttcacctttttcttcatttgggcaaaaatgacctgcctccaccatttctcagagtgtttgtaaagactgattataatactctaaacaagtgcttgaagagtgtgatttattctacattacaggtgagaaaaaagtttgtaggtgtccttaaatagtctctgattccctattagcagatcctcatggtggcagtgccatgtccatcccaaccccccagggcaggtgcctctctcaagatacctgagactaccaggcacatcctcagggctcccaggcagcttctctttatggttgcaacacaccttgaaaatgacatattggggcaaaagaatttcaaaacagcaaaacctttgccatcatcctctcacatagctagggcctctgcacgtatgataacaagacagctaccttagacttatgtcatgccatctaacttacaaagtgctctctcaaccttgcaccagaggaaaccaaagctccaggaagtgacttggctaatgtcaccggttggactgtagcatgatcaggacctgacccctggtacattgacacctgacccagtgttttcatcgggcacttttaccttacaggttgctaaggattaatgatgggatgttttgattcttagtctataagtggatcctctcccaggaggctccaggtctccggatgccaggcactcatgttttatttggtgttgcagctgtgtttcattgtagtaacatattccaaatgctatgagatcaccctgagtctcattgaagaaaagtgtttcaaaagtatgcagagaggtcaaagtattaggaaagttctagaatgtacttaaattctcagtttcttccaggagcccctctgtaacaggctgggtcgtaattagagtatttggatcactgtttcttgaacacattcaacacaaaactgtggcaatgcagaattcaaagagtggatcaggacatttgtgtactaagtagccctgtacatactggataatgattttctttcgtctgttcgccctgagttctctagcgtataccctgtcttgggtaagaatatatcctgaaaagtcatgtgtcaggttgatgtcctttgagtcctattttaaattcacaagtggtatgtgctgagaaaaagcagatcctctgataaagcaaagaactgtgttgtgaaaaaagttattctatccctactcattcatttcttctgtaaatcaggattttaggtatttttttccttaaagctagttatatctacgtagaagatttctgcatacttctcttttttgtttgttttgtttttgaagaacaaagtatataaatgccctctagagtcatagacacagattgaaggtggcaaggtgagcaaaattggcattttgtcccattaccccattttccttttcttttcttttttttatcctaagcaggagagaagtgatctgcaagtttctcaggatgcttttgggtaagagtttcaccataaaaatgtcttcacccacactcctcccagtgtcagtgtgccaggtaccctgtcacctttggttgatgtcctgatggattaagctctggacagagccacacctttgaagaggcttcttggccagattaacacaccaaggaaagtgcttcagtctagaacatgccccgtcgctggggtctggcaccctggcctctgtgctgtgccctcctgcagcctgtgctgtgctctcctactccagtgcttagaaatgccaagtcaaggatgtgggggcaggtgcttgagagagggtcaaagtgctgtcattgtaagaaattattcatcaacctcagatagtatcttccagtaacaaaccatacaagaccctggccctcgaggaggagcctgcaaatgttagctcccctgccagccaaagaaaatcaggaaaagagcaacagggaaaatactttatttttaaggagatattttgccaataatttaaattgcagctttcttctcttaatgaagaaatatgcatttcgtgatacccagcctcccccagttcctctgaagcagagataataataactactatttattgaggactagcagccaggtgcttcagcactttagtattttctgccactcaaaaaatcaatgggattggcatataatgatgccaaagcttggcaaggtgattttgtctgggtttaaacccgggtccctctagcacagtgctttaaaacgtgcctggcccacaatacaaacacaccgtgacccggtgtaaggtgttttgtggaactcaccaaaccactcaataaatatcgactgcatgaaatgaatggctgaacttcttaggacaattttattctttttgatggtcatttcaggtgtcattcctctccacagaatggtagttatcacttacctttttatatccgcacagattaaaagctttggtgactgtcgcttggttccattttgtgctctcctccaggctggtgatgggctggggtgggccgagagcaaagtgtcagtgcccacagcatgcatgagctactgctttcaggcctggagatgcagaaggtgggccttacctagctgctcttttacttgctgtgattgtgtaaggcagaagttcacccttgctctgcagcaaccatcacagagagttgcaccagccagatttgcgttcagcatgcccaatgatcaacatgctgttgaaaatggaagtttgaaaggaattgaaagtagaaatattcaccttacaggacaggtaacacttgcccctaggccctactttaaggatttggctgttccccagtatagaattagagaacgtcagagcttgaagggaattagagagcatctagcccactccactatccctgctcacctctgcctctgctgacagagaagctatggacaagaaaggagaaccgaaccactcagaccaccacagtccttggtggcaggccttacactggaggccacagctctgccttctggtaccttccaccatgtggcatctagctgcaagggaggctgggaatttaggttctgtccttacagtggggaaagagacttaacccaggagtttccccaaatatgggaaatctgatataaatgggcttgcttaataattattgccattcttacaggctaaaataaaaatcagatttcttcactgtgggaatagattttcctgagatgttaagggagctcctgctttgtatgcccttaatcttttcttgtggtaatgttttagggcggttccattaagcacgcaaatggtcatgatatcttttaagggttcctcctgctctatgagtcttcattttcaacacgtgaagaattcagtataacattttccatttttcactaaggctaaacttatacacactgacatatccactttaaagcatcataaaacagcatttgcccttgctctgtgctcaatttttctttccttggaaatgctgagaagtcgttgcctgttcctggtttttgacgttggctaaccacctactgctaaatgagacgaattgaaataatggtctgaaaactgaatcgtatggcattcatgttcacaggctgaccaagccaggagggactggaattgatatcttccatggaaaagatgtctaacaacacaaccgtttgaatcaactcacgtttactaccaggtactcctggtactaaatactataagtagcagttcatttgtttttgtctttcttttttttttctttctttctttccttctttctcttttttttttttttttttttggtcttttctttctcttgtgtaaatataaagctcccactgaaatctacttaagtatcatatctggaacttttctagtaagtagtggaaaatcagtttgtctgaggtcatctttcccataaaaggtgttgaagtcaaaatacaacatagcgatgaatttctcaattaaacattgtattagcgaatcacagaattacaatttgaggaatacacacagaccagagtagtctttggtatgttcaaaggacaaagagaagattggggattttattagaaagagaaatgttatgtattgttttgaaagaaggctcattggcactacagaagcttttgggagctggcaaggtctgatgagtgaggcagcaggtaaaactctagacaagaagcaagacaactcacagcaggtcatttcagcagctctgtgtaaaacaaccttagggtcatagcaagccttttcagcagctgggcttgcagaaaattcacttcttggagctggtgctatatgtccagagtgccccagcacctcgactctgatttagttgaatatttcaagaatgactcaattcgtataatcaactttcacacacgctttttgggcgctggataagattatcagaggagataattacgctacctccagacctttaaaagtgagcctcgtctagatctgatagttatgaggaattctacttgaagcctatgagattaactagacgatttaggacttaggactgagtccctaacactctagtaatctatgattcttaaaagttaatatttgtatttatatttatatttgcagcccatcaataattacattaatgatgaacttggttcttagttttgaagcatcattcatgcatttggtcaatagcatttactgtgcaggcactttgttagcagccggggatacagtggtgaaaaaagtagacatgaagcttcatgaagcttatattatagtgcagcgcccataagcttttcaaaatcttcaattactgtaatagtgtttcttggggccagacgtggtggctcacgcctgtaatctcagcactttgggaggctgaggcaggcagatcgcctgaggtcggaagttcgagaccagcctcatcaaaagtggtgaaaccccatctctactgaaaattccaaaattcgccaggcgtggtgatgcacacttgtaatcccagatactagggagactgaggcaggagaatcgcttgtacctgggaggtggaggttgcagtgagtcgagattgtgccactgtactccagcctgggcgacaagcgagactctgtctcaagaaaaaaaaaaaaaaaaaagtctttcatggaggacttctcatacacgtgcgcacacacacaacacattgaacactttattgtttctgtagtgatggggagacagctaggtgtggagacctgtaataagtcctagtgatagcgagccccagttcccacctgggcagagttagatttatcctgtgtaactgaccaattcggagtgatttggagtgtttctcttcttgatgaggcccaggggccccactgcacttggcctacttctgaaaggagggaaatgctgctctcagtaatcctctgctggggggcgaaggtgggagtgattggattacagttcctttagtagctgcgtggagcttgccatgtgtcagaaaaccttagagtgtagtcatggaatcctcagtgctgacaggaatgcactctttttaaaataagtatgcctctctgtgttgggatatatgatcaattgaagcctctgggcagaatccattgatggaaagcctatatttaaaaacgaacctagtggaggtgtatgatacagaggatatggtacagagaagaagaaagcagtgaggtctcaggtgttggaaaagtcaagtctagacaagaagcaagacaactcacgatgcagacgagatgactggaagagtctggggaactttgggagattaaaggatagagatggtggatgctgggtgatttctacctgtgagcacgattaccagatgtccttgatagtgtgcaatgcccatgccatttccttcaggcgacgctgcagttcagcgtgcaagatactgccacacagttgagatgcagatgaatttggcacatgttcatgttgatgttgcccatgtgattaagcttatatgaagtggtacacacaaaaaaagaaccatttccttccacagatatttatatttagggaaaaatgagaatatttaaagaaaagctgttatgcattgtagaagtaaaattgtagaaggtcttctactatctgcatttacttaaagttaaaagttaatcacttccagcaaggaactgcacatgtggaatgttggtggtcaatgtgttatgttaagaaacttaaaaccctcatttctacaaatagtcatatgatacgactcttcctgaaaactagagttgggacactggtaccctaagcacagcacagagtaccaggatgcctatctgactggacctttgccagctctgggcatttgctcttttgttagtctttggcatttattttattttatttttagaggtagggtctcattctgttgcccaggatggacagcaatggcacagtcatagttcacggcagcctcaacctcccaggctcaagagatcctcctccctcagcctcccaagtagctgagactacaggcatacaccaccatacccagctaatttttaattttttttgtatagatggggtctcactatgttgcccagcctgtcctcaaactcctgggctcaagcaatcctcccaccctggactcccaaagtgctgggattacaggtgtgagtcactgcatccagcccaatctttgacggtttgacagacaaaaaactggcatcctgtggttttgtccgggaggtttttaaatgcctctgcccatagtgtagcagtgactatttgagactaaaatgctttttttaggggaacagtttatttgctattttcttattgggataactttttcagagcagcctccccccatagtaagaaaattaaaggtattcacgatgaaccaccctgatgaaaggaagaagtgcttagagcttccgtgtcccacattctgtgtgggattgggaacctctggcatgggtcccagtgatgatattggacaatcccctggtgtactgctcagtgggaaagtagatatggcagagaatgttacttgacttctaataatcattttccccatcttccttgttaatagaaccactgcatttttaatttggtgacttgcccgattaaatgcaataaagactacatgtcttagccaccattgcagcaaggtgctgtcatatcactaagttctggccaatggttatttttaaaatttaaatacattcatttatttattttaattgatgtataaaaatggcatatgtttattgtgtacaacatgatgttctaaaatgtgcatacattgtgggatgatgaaattgagctaattaacatacgtatgaccttacatacttgttttttgtgatgagaacacttaaaatccagtgatttctaagaatacaatgttattatctatagtcaccatgttgtacaatagatcttctaaacacattccttctgtctagctgaaattttacatcctttgaccaacacttcccaacccctccgcccagcccctggtaaccaccattcgactttttgcttctatagctcaacttttttagattctgcatataaatgagatcatgtagtatttatctttctgtgcctggcttatttcacttggtataatgttctccaagttcatccatgttgtcccagaggacaggattgtcttttttttttttttttttccgagacagagtctcactctgtctcccaggctggagtgcagtggtgtgatctcggcttactgcaaactctgcctcccaggttcgtgctattctcctgcctcagcctcccaagtagctgggactacaggcgcccaccaccacgccaagctaattttgttttttttgttttgttttttttttttgttgttttgtttttttagtagagacagggtttcaccatgttagccaggatggtctccatctcctgacctcatgatctgcccacctctgcctcccaaagtgctgggattacaggcgtgagccaccacgcccggccaggattgtcctcttttttaagactgaataggatccattgtgtatgtgtctttaccacattttctttatctattcatctgtcagcggacacttaggtgaattccatgtcttggctaatatgaataatgctacagtgaatatgagagtacaggtatctcttcaacatattgatcttatttcctttggatacataccctaaagtggaattgctgaatcatatggaagttctgttttttgttgttgttgttgttgttgttgttgttgttgttgttgttgttttgagacagaatctcactctgtcgcttacttaagttggagtgcagtggtgcgatcttggcatcttggctcactgcaatctccacctcctgggttaaagcgatgctcttgccttagcctctgagtagctaggattacaggcatgtgccactgtgcccaggtaatttttgtattttaagtagagacagggttttgccatgtaggctgggctggtctcgaactcctggcatcaagtgatccaactgccttgacctctcaaagttctgggattataagcatgagccaccacacccaacccatatttttaatgttttgaggaacctccctgttgttttccataatggctgtaccaagttaaattcccaccaacagcatgtaagctttctttttctccacattctcaccaaaacttagcgctcatctttttttttttttttttttttttttttttcctgacagagtctcattctgttgcccaggctagaaggcagtggtgtggtcatggctcactgcagcctcaacctcctgggctcaggctttccccccacttcagccacccaagtagctgggatgaccacaggtgcacgccactacacctggctaatttttaatttttatatagagaccaggtctcactatgttgcccaggttggtctctcatctttttgatagtggccgtcctaacaagtatgaggtgatattcattgtagttttaatttgaatttccctgattattagtgccgttgagcagtttttaaatatatctgttggccatttgtagttcttcttttgaaaaatgcctattcaggtcatttgtccattttttatttgcatgattttcttgctgtagagttgtttgaattcctaatctattttggatattaaccccttatcagatacatgatttgcaaatattttcagccatttcataagttctcttcactctgttgattgtttcctttgccatgccaaagattttttagtttgatgcaatcctatttgtctatttttgcctttaggatcatatacgaaacatctttgtgaatgtcatggggtatttcccctatgttttcttccaggagttttacagcttcaggtcttgtattacatgtaagtctttaatccattttgagttgattctttcacacggtgtgagataagggtctcatttcattcctctgcacgtaggtatgcagttttcccaatactatgtattgaggagactgtcccttccccattagccagtgggtattaacgaaagagtgaagtgttacttgtagagtgtacccttaaagagtcaagggcatgcccccttcacccttgctccttctgcggtctagaatgtggacataatggttggggctgcagttatcatcttgcaccatgatgtagctttgggaatgaaaggcagtaaggcagaaacagcaacatatctagagaaaccctatgtccctgacattatagagtgccatgccagccctaggctgcctaccgtggggctttgatgtgagaaagagaactcttacttgagccactgttattttaggttgcctgtcacttgcagtcaaacataatcctaactaatccagtggggaaatggctctaaaaggagctatcatccaccttcctaaatttctaacatttggaagccgcttcttatagcaagtctttttgttacaattacgcagtcacaatggataactatctgcactttactgtggactgtggaaaggtatgaagcacagaggaatgaaaatctcacactcactcactagaatgtacttatactcacatttaccaaaatgccacttacagccttgtgcataataaaataaagtaattactaattagtccgtcacgtgggcatccaaaccatacttgaatagtgacttcagtgatgtgctgagagtcgtactcattagagtagtcatagtttctacaaagggggccttagaaatgggcttacttgaagcatttctctaaatatacaaataataaattggaaaccttctggagtgtgtataatgtatacacaaatgtgtgcattggttgttatactcgaagtagcagaaaacatctgctcctgactttaacacgggaacaaatgaccccagattattagctgctaatagatttttgtagttttagggaaaggagaaaagtaccatagccttctttgttctataaagaatacgtattttatgtattctgtgtttgaaccatctcagcatcagaattgactgtttaatagttgcagttgtttaataatttttttttagttaatgcaaaatattggaagtcatctccaggcttctggcttacagagagtccctgtagagatagcagatcactgcatctgacatcgtcagctgtggttgctcaaacctctggtccaggaagaggcagagtcaaccttttttcccagcagaatgggattctagacatgcagatcagctctcctaaatagtcttagagtcagagtattttaccaccggatgtgaaccctggagatgatctagtattgtccttcaagttgaggaaactgaggtccagtaagtccaacaagacctacccaaggtcacagtggcctgggtggcacagggctggaacccagacctcattgttcttgtcatacagcatgaccttccatttcaaggagactaacaaataccaagtttggcaatgtatccaccctcacttttatttgagaggttacaaagcaaacaaaatgagatcatgtcataagcagttctgtcctaagtgggttaggatttatttcttcttttctacattttttttttaaatcagaaggtatatccccaagaacaggaactaaaggaacagattgcttagacccttgtgactctgccctggtggtggatcattaatggtgtagaaaatgagggcagtgctgggcaggcagtccagggtggggtgcatgcctctttaagagatttatgtggaggtctgagctagggagacagcgcggtggtacatcatcatgcaggcgacatcagagactttcttcttcgcttgggtgcattatcataaaaagtgatttagactggagctgattgatgcaaatggccctatgttctttcctatcattagcggcctctttcagtggccagaggcagtgattaaagctgtcatttggagctgctcattaaagacaagccccagaatagcaagaggaaaaaaggttggagaggcatatatatacatatatgtgtgtgtgtctgtgtgtgtgtgtgtgtgtgtgtgtgtattttttgccttaaaagtgcatcattcttttctagattgagccactgaaatcaaggctgtagagacatttccactgagaatatagaatgctgttttgcaagtaatattagattttcggagtgtcatagtagattctgatgacagcttgcctacatattatgaaaggagatgaggagggtattgtgttaggtgtgttttgttagggattgaccctggtgagaactcattaagtctccctcctcccaggctggggacttcagaggcaggccacaggagagcagaggggagggttgccgagagtggatggcctcagtaagtcccactgtgacagtgttgaccccagggatggacagaagaaggagagcagggaggaggctttttgctgagcccagatgatatagatgcctggatgtcactcagagagaggggttggtgagaggaggcccctaaataggaggggaatggaacaaagcaagatccatagatgcgagaagagaaattaatcagaacatgatccctggctccttggagtcttccagacagggcgacatgactagttaatcactcttgtggtcaaattgggcttcagtgtgcacctgcctaccttttcatcaacatgcattcacatccacttacgcactgatttttagtttagtgtcccagtagtacctaaaagtgacaaaaatcccaagctccaaatgaattacagcatgccccaaatgaaggctagggtagttagtgggtggcggctaaacagggagccagggctgtgaagccagggagggagccatctttgtttcttggaagaaaccagtttgaagtcagagatgagactggctggctaatcctgcacatcctcactggccagttgatgtcttactgcccaaatcccaccaaactttcatacaagctagtctacagctctcctcagaaattcctctgggaaaggaaaaaaataagaaattatcaatttaatttctcagtctaatgaactggtcttatacataaaaatttaaattacttttttttttatgaaagtggggaccaacatcatttatgcaaccaccactgtctccatgacaacgccttggatgtggcagctcatgtgacttcacagtcacaggcccttgaaatgaagcaaaggaaagttttagtttctcttctgtaatttattggactctagggatgctcacgatggtgctaagtggaggtgtgggggtttctttttgctgtggacagtaaatagtgagaaagtggtgaaattattccttcctgcggcagggattggaacttgctgcagagagtgcttccttgtcagcctcagagccagttgacagcttcagaggcgtggcttttgtcctcctctctgctgcacccccacccccacgctggccttcttagcctgggtctggcgcatcagggcctattagtactgatgctgggctgtgatgttcctctcctcggggagcacggcagcagaactgaacaaagtcactggtaatctgtgcttacagcctcccccctggggagaaagcctagccagctggcactctcacgctgagcacattcacttcccctggctggtcggcagcctggcaggggcccagaggctggccggctgcagggctaacctgcaccagcaccccaggcagcccagctcaggatcacacacgcattgttctctgccttccagactggacactggctgaactcacagcttggacggtgtggctcatctgcttaggccttcccagggtagctctctagaaataaaaattacgaacgctggatgaagaacaattggctggctacattgaggttaatacaggaccatttcccctgtcgtctttttcctttcccaggctctaggtcggtgacatcaggaagatttatcatgagttccgtcttctgtagttggaaaggagatggcacatctgccttgggtgatggggtggaagagtgggtggcagggatgagggtggagcaggaaacaccagtagtcctggatgtgtgtgtacttgttagaaatacctgcagggaaaaaagaagcggctggtctttggatccttgctcaggtggaccttccagcacacccattgccagatacaacttctgtcgaactaagacttccctcccatgtaccagaatcttgcataaagggagcagaggcttgagaggcccctctggggaagcaatgtctttagtcactgctctgctcacaaggtgcaggaaaagtctagatttttctcagttgactttcaggcttagaaaaaaaaaacctctagaagatttatggcttgttgttgttgttgttgttgttgttgttgttgttgttggaaaagcatttattctctttaggagccatcacacaccaacatgtatgtggcccttagttggcgtaggtagaggtcaactgtgctgctttcaccaggtatacaggtgtcctaataagagtttggggacagtgcaaaacggcagtgtgttctgttcaaattttttttttgtcttgctctgttgcccaggatagagtgctatggtgcgatcttggctcactgcaaccttcacctcccagaatcaagcgattctccacctcagcctcccgagtagctgagattacaggtgctggccaccttgccgagctcatttttatatttttcagagaggtagggttttgccatgttgcccaggctggtctcgaactccagacctcaagtgatctgcccaccctggcctcccaaattgctgggattacaggcgtgagccaccacatgcagcccagaaacttttcttttagcagagataaaggagggatttctccaaaaagacaacaaaaaaggtgcaaatgaattagcttctgtacatcttcttcagattttccctattctgttagtgagttcactgagaagtggagggaacaagaggaagaatcattgctaacatgaagccagtgctaggccttatgctaaaactcttacacaggggtcttatctccttctgacagtgcagttgggaagcatgctcaccagccccatgtggcaggtgaagcccctggctcagagcctctcagcagctaatagctaccacgtggaggctccaggatctaagcccaagtgccagcctaaagaccccacgctcttctccctggctgagtgctgaggtaccattcggctttaacagctgacggggctgatgcagctgcccggtgacaccatgtgccctgctgtgtactgcagttgccattttgcatttatagtgggattatctgatgctccaagctccacaagggcaaggtcttagtttttacatactgttgagtccccagtgcctgacactgtgctctgcacaccatatgtggtcaatacatacttggcaaatgaaaaagggaatgaacgagtggtcagggttaaaaatcaacgtatctttaaagtaagccaatgtgcttcccaaacccaaagaaattcttctcaaaatagagtgtcgaatagttttttttttttttttttgattggagaaacttgagcatgtttttaggccaagcagtaggaattattagagagggaatgatggcactattgatggaacacggtcccagaggagatctgaagtgacaagattaagagcagagaagaattttcattagcagaaacagggcacttcctccttagagaccagaggtgaagagagaaaaaaaggatccggtagtcatgggctatgtatcacttaggagtgctttcagctgcaagtaatagcttgactagcagtgcctgaaacaattaaggatttatttttttcatgtgatggtaagacagctacagctgggtgaccactgtgttgcttcagtggctcagtggggtaagggccattgtcttcaagactttcttggcctttccctcatgagatgcaccttctagcatcacatttgcattcaagtaaaagtccgtgctatccttgcagacacttacttcgcatgctgcctgctctgctgattgaggaaatggtcaagactaaatgaccactagtccctccttcaggtatgacagtggagtccaacggttagtgggatctgacctccagcgagcttatttctcctatgatgaatataagaagtttgtggccgggctcagtggctcatgcctgtaatcccagcactttgggaggccgaggtgggcggatcatgaggtcaggagatcaagaccatcctggctaacatggtgaaaccccgtttctaccaaaaatacaaaaaaattagctgggcgtggtggcgggcgcctgtagtcccagctactcaggaggctgaggcaggagaatggcatgaaccagggaggcagagcttgcagtgagctgagatcacaccactgcacaccaacctgggcgacagagcgagacactgtctcagagaaaaaaaaaagaagtttgtgagggattcctaagaaagtgaccgagggagaggaggaaggggagagttggaaaagttaaatgattcacttgtaagctactagaactttgttaagtttggggacatcatggttttgtgaaatctactttcgctgaaatttatgtccatttctttgcctccttctctctgcacaccgcctctactcagaaatttaaccatttacacacaacagaaagaattttcctcaagatcgctacttttgcccagtatttctgattgtctttctgcttcacatctccagaaaatgtattccctttaacaacttaacttggagaaggaggaaagaaacctaagcagatatgactccacctaagttttatgaggaaccttcgaaggaaactctgagaaaaatgagtctgtatctttttctccctcttagaccaggcttttgacatctaccagtgtgcacacttaccaattaacagttacgttcttattggttgagagaacaaggcattaacacgtctggtgactgctgcgctggtcccgtgagacctgtagagaggccaagtggttgccgtgggcttttgctacctctttgggcagtcactttgcctgtatgagacgaggaggccggaccctctcagctcctgacatcctctctaacctcctgtgatctggtcaccctgtgggaaagccaaggcagccctggcccctctccagcagtctctccctggagggctcggcctgttgggttttacttagctcgcagtttatgccttcattctcctctgaccctcattaaccaagaggaaaaactaattctagaaaggactccatttccccccatattgtatatttcatatccacagagcatgctgtgccctattgagaattaaactgcgatcactaacctcatctcatttgtgccaggggtcttgttcaaaagctgtttccccagcaaagcagtgccgtgggttaggaccccctcaccccacacacacatgcttggtggagtggttcccatctctttttaatgcctttggcaggggacagacagagagagagaaagagagagagagaaggaaacacagggagagagagagcaagagaaaaaaaagagaaacacaaaagaagaacaagagggaaagaaaagctctcgaacagcagccctgtgttttgttagaacattggcactgcatttatcaggattactggagggagagcagggtttgatcctcttctccactgggagagggaaaagctttattgtaccttttttaacatctcacagttagatcagaacaatacactgtgtatgtacatacacaccatacgtatgtgcctaaggatgatattctacttgggacacaccctgttttcaaagcatggctgaattttttataaaggccagatacagaaagccaccaggctctccctgggtctccctttccagcagaccttccccccctccccatccccttgccggacttggatcagcaggattcactcctgtcaaacaaattagagcatctatgaaatggggctatcgacatgtgtgacttgatctgttttaataggggcccggtgggagtttcctccctgccccactgagctttgtatccttcacggaaaggcagacggggcgcgggaggatgctgtggactttaaccctttgctgccagcaggttgcctgcctcctgcgtgcagccgcttcctttttgtgcctggccattgtctggggagtgcgtgcggcctgccatgctcttcatgcttgttatctcacaggagacaagctcaccccaggagaggaagagagagctgcgttctgaagcagatcttttgatttcctttcttccctctcctctctcaaataattagaagtgctggtcaaggtattaaaaaaaaaaaacagccaaaggggagaaaatatattgtatattttataaccctggcattttgtttttcaagaggtgttgtcgggctgccatttgacccttatgtaataattagcatttgagctgtggcagctagcaagtaggtaagggagaattgcctgtttggaggaaggatccgaccccttttaagtagaagagaagagggaatttgcctctgtcagcatttcagatgcacccccatgctatcactgtctccctggccctctgttcctgactcagttgctaatgacacaatctcccagcgcctgcctccgcccatggctcacccccacacccattcactgttcaggtacttgagtcccagccacagagctggaaggctggacagcagctaagacaagaggcagaggccttgtgcacagtcctgttgccgagaagcgcttagcaccctgccaccctccctgtaccgctctgtaggggtgcagattcccaccgagcccatggccttacctgcacctctcccttaacctgggagtgctgcgggcagaagtcaggacccgctttcttttcttgctcttctttactccttagcacatagcactggtacacctcaatttatagaacagacaccttcctgaaaaactgcatgtaaatgcaatttttgacaggtggaattttgtagctcatagatttacattgtttagagtcagtcgaaatgaagctgaaaacacaatcatattccctgtacttactggtgtaggaacctgagcacacagctcctttcgtaaagtgagaaattctccagcggagcgtgtagccgtaccctggtttacctgttcaaggagtcctatgctgaagaccacatcttatgggcatcggtgtgcagtaggcgctcagtcacaccacgctcatcactgagatgtggaaggaaaggggttggtcgggccctttgctctcctgtgctggtggccaagcccagggcttgggttgtaaaaccacaggcctgactgcttctccttgaattgtcctgaaccttgacccttagcgccctcaggtcgttgtgttgtttggattggtgatttcattaggatttctcacccttttcatttatttcatttaggcccgaggcagaacttctgggagctagctgatcatctgtcttttaattttcctttagggagaagaactccactgggctccatttctccctctcattgcttgctggcactggctccatggcctctttgttgtgtttttgttttgtgttttgttaccgtcccctctggcaccagatcaaggggcagggagggaaactgggacgttttggaggagggttgccaaagagttgttgcaggaaagaggcatggtcagaagaccagttcagcagctgagcagcgacaggagcacttccagttcctccagggcctgagctcagagcggggaggaccatgaggggccgcggtatggcggcggtggggtagggaaagagccaggagaatgaaggaagagcagcagcttatttaatttggaaaaacaagggaaaagctccagtccacatacatctcttctttcttccccttccctgatgctcatgaatagcacgtggaagggttgagtgtttctgccccacagtgtggcttctgccgggagtgggggcacacattccaggcttctgtgctgcctgggtagctccttctcctggcctttcaggtccaggattacagactcaaactgtattcactgtgggggcagggtggggggttctcccctttttttctcccatgtcctagtcatttggtcgctgcaaaatgattacaacatgcaggagatctcttgccacctgaaccatttttaaatcctctcctgagtactaagcccagttctttccaaattatttccagcaactttcgcctcatgtgtaggtttctctggattaatccccagtacaatcttttccatcctcaaaagtcacagacattttagtttttctgatttcatgtcccaccttaggtcagatctttgaggggtgggagggtaggaggtaaggaaccactcctcatgcaggatattagattgagaaacagaaacctacaaaaattcagctccacttatttttaaactgatgatcatgtctgaattagatcagagcaaaagcaaagattaaggaaaaaggcctagtacaaactatagcaaacacagtggaccagtgctgaactttgctagctgttctgggacgctacagctaggcaggcttacgttagtgcatagtcattctctttttttttttttttttttttttttttggagaaatggagtctctgtcgcccaagctggagtgcagtggtgcaatctcagctcactgcaacttccacctcctgggtttaagcagttctcctgcctcagcctcgcgagtaactgggactacaggtgtgcgtcacgacacccggctaattggtgtattttttagtagagaccctgttgggcacggtgctctcaaactcctgacttcaggtgatctgcccgcctcgtcctcccaaagtgctgggattacaggtgtgagccattgcgcctggctagcatagtcattcttaagggcatgttcagaccaagttcctctggctattcttggagcggagatgtcctggcaacttcatttctctgtcgtctcttacaaaaccccctttctccaagttctcttaaaaatgcatctttgacttatattctctcctgcctgaggggcctgccgttgtcctctgttcctggactttcacctcatcctgccgtctagacctggcatctgttttggtcagtgctctggatgttctttaagcagcacattcttgctgagcagaacacggtgttcagccaggttccatagctcccgtcatccccaccgttgctacccaggcccttggttgtcctgcactcccgctaacccccagactttcttagaatcaaaacttcctccagttggatcactgggcttctattccataactccttcatttcctcttgccaagaatgttctttagcaatccgaagttatatttgttattaaatataagacttaaaaaaggcttgtatttttcccctgaaatcagctttaatgaattatgacaaaacttaactcatattgctaaacattatatgtaatgggtgtgctctttcaacttagggaaaaatggatccagaactgttggcagcctttacacgtctttcatcggcctttttctttgtggaccaaaagaaagggccaaacttagccaaaaccattggccgctgatactcttgtgaagactgtgttttattaccactgcaagagttgggggttggccaaaatgatacccagacatttcagatcttaatcacaggtgctgaaaacagagatgtgtttgattctagaccattacaagtgggagttaattaccacatttcaatgaactctccgtgtgccctcctgccatagcaattagcaagagagtggccgcttgtgtgcttgatggtgttttatgaccatggattatataggaattaggaatggcttcgggaagcatttggtcctcacagttatccaataccagcatggcccaaccccagatatgtcaaagccacaactgttgcgtttggcaggcattctacaaaatgtacttggtcaatactaaatagtttcatttagcagaccagtttattcaagtgcctgacaggagtttcctggattctcacctctcctgagaggccttcaagagcatcgctgaaggtttatctacagctagggtaggttatgagtaatgtcttttatgaaactttgcaaaccaactgtcgttctgttcaattcccagaggcagatttttagggttgctgtgtccaatacagtagccactagccacctgtggctatttcagcttaatttagttaccatcaaataaaatttaaacatcagttcctcagtgacacactagccagtttcaagagtacagtggtcactcttgtcacagtggttattgtatcagacgatacagaacatgttaatcatcatagaaagttctggacagtggtgctctagagtctcaacatgtcacgtgttcaggggatcactggatctaaagccattccttatgggaaatgttggctttcttgaaaatacaccagagaccagagaaggtcaccatgtggagaagaggcagccttcactctgccaagaatgctggccaggcttctctgttttatatctcatcacaatgagggccattctggccctccaaaatatggataccaacctttacgcactgtcagaaatgggccacaattcaaagtgttctctgctgtttctgatgaactgccgttctccagctcttccctgaaatggcaaggaaaagtgatgttccctcaagatctgccaagggagatactccctctctctggtaatcgtcgctgtctccttccatcaggttagactaccagggaagtacctacctgaatagcattagcgtatcttcctcactagaattatctttgatagatcatactttaatgtttataccttgggcttattgataattttaaaaaatcaatatgaagataaacttgcatgtgctgtgaaagtcattcattactaaagatgtagaccattcaggtaaagcactgcataatactcaggatgtgctggtctctctggaagaaccgtgggacctccttccaatggagaatgcaaatgatgtgacccactgttttacattttgccccatctgcccagaactccagagttcaactcagcactcatttatattgacttgattagccatggtggttagaaattggctttctctcccttaaccaggtgtttgattttctgttttagttttaataaccttattgtgtatatcttttaatttaattctccttaaattgttttctgaaagaggcgaagtataaacaaatgaatacaaattttattttcaggtccccacatttgatattttctgttttgaggtagtctctatgcaagccccaaccccaggccctggcataaatgacaggagggcccagggacctcctggcagtctcatttttctttcataccctcctgagtatctagcacactgctaaacatatgctgcttagagtgatgtaaggtagagaaacactgtgccccgcgtgggaaggcattacagaataaacttaggaaagagggtcacctctcagatttagtcagatgacaaaggcagcactggcttccctggggtgtagagataggaaagaatttgaataattatcatcattatcatcaccacattcattaaaccccatctgcacatggcactgtgtaagtccccataggtttttttctctgccagtgagagagaattttgtccagcagggaggcgaatcctgagctctccccagctcaccagtttcctcctcgggctgttccactccacagccagcagcctggctcatcactgaggttgagtccattgcctcctatgttcttgggagatctctgtggtccttggcttataatcatctttcacgttctaggactctggactttccctttacagcactcaccacagtagcaattaagaacattgatgcataatgaattagagattctcttgtagtacattttatccaactagggggtcatctctgttctctgcacccccatatctctagaaccccccattatgtgtggtatgtagccaagtgcttgatgcatattcttagcagtaaatagcaggaatgaatgaatgagtgtgtatccaatttgactttagagttatttcccgacttacagccgttgaagttgctgtttcctccacgtgttcaacctttgggattcacacaatacttgacagtcacagctctgccatgggggacatcattacacaaagcactcctcaccagtagtcagatggcacttgatagctacaggcatgtgaatattcttttactgtcaacttttgttgtgatttcacctaaaatgtgataagctccttgaggataaaggctaagtcttacttcttcgtatttctggtaaccgcttgtaccaaacacctgccaagcattgttgattgcacctatgaggaggtgagaaagtgccaggccgtcatgcccctctatacaaacatgtaacagtagactctggttcatcaggagtaaatgacatgatatgtgatagaccacgtacattcgtggctatagataggtgagtaactgtaaccatatccaattgtgagcaaaagtgttttaattggtggttttaaactaatataaaattggctaaatcatcatttttcagctttcgaatcatctgaagacctttttttattttttaatatttagtcttgttttatttatttatttttgagatggaatcttgctctgtcacctaggctggagtgcagtgatgcaatctcagctcactgcaaccttcacctcccaggttcaagcgattctcttgtctcagcctcctgagtagctgggactataggcacacactaccacacccagctaatttttgtatttttagtagagatggggtttcaccatattggtcaggctggtctcgaactcctgacatcaggtgatccacctgcctcggcctcccaaagtgctgggattacaggcgtgagccaccatgcctgctctgaagatcttttttaaagaactgatagatgtccaggtatggtggctcacacctgtgatcccagcaactcgggaggccaaggtgggaggattgcttgagcctaaaagtttgcatccagcctgggcaacatagcaagaccttgtttctaaaaaaaaaaaaaaaaaaaaaaaaaattatgtaaaaacttttttttttcttttaagtactggtaggactggatcctaccacaggaaaaaaataataatctctagggctaggtaccagacaatgaaatatattttttaaataactcactttttaaaaaatttccacttttattttagatttaggggctacatgtgcaggtttgttacatgggtatattttgtgatgctgaggtttggagtatgaatgatctcatcagccaggtactgagcgcagtacccaatagtttttcaacccttcccctcatccttccctctcgcctctcatagaccccaatgtctattgttgccatttttatgtccatgtctacccagtggttagcccccacttacaaatgacagcattcagtatttggttttctcttcctgcgttaattcacttaagataatggcctccagctgcactcgtgttgctgcaaaggacgtgattttgttgctttttctggctgcatagtattccatcgtgtatatgtattacactgtctttatccagtccaccgttgatgggcacctaggttgattctgtgtcttcactcttgtgaatagtgctgtgatgaacagctgagtgcaggtgtcctttatggtagaccatttattttcttttggatatatacccagtaatgggatttctgggtcaaatggtaattctgttttaagttctttgaaaaacctgcaaactgctttccataggcactgaactaatttaccttcccaccagcagtgtataagcattcccttttctctacagccttgccagcatctgttgtttttacttttaataatagccattctgactggtgtgagatgatagcgtattgtgattttgatttgaatttctctgttgactagtgatgttgagcattttttcatgtgttgtatgtcttcttttgaaaagtgtctgtgtgttttacccatttttaatggggttatttgttttgtgcttgttcagttgtttgagttccttatagattctggatattagacctttatcagatgcataatttgcaaatgttttctcccattctgtggattgcctcttttctctgttgatagcttcttttgctgtggagctcagatgtttttaatgtgcaaacatagttgagaactactaacccagtcttcgggtattaatcagcaccagctcattattccatctctgccaacactcaatcacaatttgctctagtttggtaactgccctcgttcagatggagcagagttggaattttacagtgtagggctggcgccagttcctgtcattctccatccaattccgagccaagtgtccagccttagcagggatcccacatgcaatggaaaaagggatgctttgttctcagaatggcttattcatttactagatgtgcatttagcatctgttatgtacacggtggaggaaaagacagttaatttctgtgctgtgcagtcaaggttgggataaacgtggtcaggatgtcatgggagcttcaaagaaaggaaacaggcccctgtgtagagtcatcaaaagagactttctgaaggtgatattaaaaccaagccctgaaagttgcatggaagcttgccgggatactctttccccgtctttcacctggctgatggaagagcatgggcacaggtatggaggtgtgcacgaaggtggctcattgatctataagtagaaatttctataaatagaaattgtggttgaagcacagggcacaagtgtggcaaagcaatgccttggaagccatgcgggcaatgttgagagacagcccaaagaggtaagcagaggccagatcaaaaaaacatgtttatttgccatggtgggacagatttaccatgaagctcttgaagcttaagctgcagggcccctggggaggggccacatgttgggctttgttccttttttaatttgcaaaactatatatatatatacatatatatatagtatatatatatatgtatatatatatatatgtatatgtatatataaattatataagcttcaggctctacaaaaacctggatctgaagcttaaggacctttactttttcctgaaggtaataggagttaatgaagaagggaagagatgtgagttttagctaggattataatttatcattgaaactgagatactttgagagtaaaagaccatgctattaatagtatacctacatccctccccctcccccccaaaaaatccagtaatcagaactttccttggcaaaaagcagtgtatgaagactttgattttagcccacttggttggtaatcttaagatgcagttacaggaggttgagactggagcagggagaccagttaggatgctgttacattcaaaggagatgatcagggccagaattaagacagcattaaagaaactgaagacaagcagttgggatcctcaggatgggaaagcacgggtaaacgggcaggagacctctgggcgccatttctgaaccgggcagctgggtagatagatggcggtgtcttcccttggcctgatggaacagggagggggtggcagacattggggggaagtggggattccagctgaatgtaaggatgtcgggaagtgcctgtggaagagccaagagaggacgagtttagtaagtactgaggttctggtggcaggttcatatccatcgcggggcagtcgggtttgctgtactgccacagatgccaaccgtctgcagatgccacttggagatggaaaccacctaatgcaagaagaggtcaggtagcagcatggatggctcagtgcaaaccaacccttctatttaaaacacagctaggccaggcatggtggctcacgcctgtaagcctagcattttgggaaaccaaggtgggaggatcacctgagctcaagagtttgagaccagcttggccaacagggtgaaacctcgtctctactaaaaatacaaaaaattagccaggcgtggtggcaggcatctgtaatctcagctactcaggaggctaaggcatgagaatctgctgaaccggggaggccaaggctgccgtgagctgagatcgtgccactgcactccagcctgggcgacaaagcgagactccatctcaaaaaaagggaagaaaaaaaaaaagcccacagctaaaagccagcccttctgtggtcatagcagccaacatacatggtagggcctgaatccatccccttgccacctcccttagcagcctgaatagaggcaggcgcgtctcagatcatggcagctggtgactgacggagcccctgattctctgagctgaccatataagctgaccctggatttacttaaagttaattttcatcatcatcagcctcgctgtctcaccagccccacctaattctaaatttacctaaggttctttttttttttcttttttaaaagctttaggtctatattttggacagaagatggtcttttagctcctgatctcatacttaaataaaaatgctctcatattctccttgatatatttgcctattggatttgtttaatgaaatatggatttataccataaatattggagtcgtgtagtccatatttcaattaatggatcatttatatgtcatgctaactttgtaattactgaaatgtaggaatagagtggattgaaatgaatttctgttcatctttccattcctgcccccatccaggcatgtctgagcagcttggatcgcaaaagggcaagatttacacatggggtttgcagaggaaaggggtagggggctcggaaaggcggcctcctctgcgtgtgccaggagagctctatattgcagtgtgctttctgggttcacctaggcagcgttacacagctgtcctcagaggagcggaaagctgggctctggctggagggcccggtcatcaatatgctgacaggccttcatcatcattttcatctcggttgtaaagcacagcctattttccctctttgccaaatctctgctccaaatgtacataactatagatttctgactgagccctgctgccaggaatcaaccagaaagcttcaccagacctctaagacagaggacaagtaaattgtgttctcggctcccgtgaacggggcctgtcactttaactggtttcttctcaggcagtgggtacagcccaggacacccttagtgaacttgccactgcccctggttttctttctctctctttcctgctcttcctctcctgcctgctgtttgctgaccagaaaaatctggctggagaggcccatgcagtgagtgaacatcacatacataattctatcagaatatatccaagggtggggaatcattgttctcggaactagctgagctgaagcccgagcagaaatactaaagtcagtcgtgcctttgagctgcctctaacagcgccctttagagacccatttcatacaaaatttgaagcctgtgtttattgcccattaaagcaacctttattttatggcaaatgttgcagtaattgccttttacgaagagcactttgtaacacacatgcacagttgaaagaaaaccactctggtattgtctatcgggacttaatggcgcaattaattttactccatctgttcctgagactttaaaggaaaatggattttttttttgagcgtactttaatgaagaagataaagcggcccggctggtgtcccacaggctcggcgcagtaagttcagattattgctcagtctgtcagaatgggctgcttccctcagcagcagccacagccagcaacccgctctggcccctcgccgcgccattcctgatgacaaactgccagccagctcccacaaaagcacgattaaaatgtcagcacaggatgacgaaggggccaagagggtcctcagagacaaactgtgttcagtgtgagttaatactttacagcagggctggggcccggcttgctgcgggctggccgggctgctggctcgccttgaagagaacaccagggcaggggctggcgactggcggcggggaagcatgtgcacatgcgtgtctgcactgctgtgtgcgtgtcgggcatgctgctctgtgcgggaagaggctcgtttcagaggaagcgtccaatgggccgttcaggttagggagttccgagactctccatgatttctgaaccgtgggggacggggtggtcgcaacctagaatgtgggctggagagcgctgtcccagtggtggccccgaggccacaggttctgtcccagatgttctcagcaccattttagcgacaagggcagctatgaaaatggcccagctgcagaaagtcattcctcacgaagaaatgggtgtgcagagaatacagtcagcaccatttatagccccatgtccccaaccttagcctttgcacggttggctgggccacagcaaggggctcagcagcaaaatatccttgaatcaatactgctgcttgacagcatctccagccccgcgcccgtgtgtgctaacttgctagggggcagggcgcactctgccgctttggcttagttctcccatgtcccttgattcagtggtgtgaccagaggggagactgcctgtggtgaaaaggacaaggagatttgcatctctggcctcctgtggagacccgatctgccgtcctggtgggcagcaggtgtgagcgcctgccattgtccctaatggttattacaagtgataagcaggacaaatgtgaagtcatctctcctgctggcaggtcagagggggctggatttagagcccctaggagactaggaaattagatggtcagtacccaccgtggaggttgtagcaactccaggctccagagatcctggacaggggtgattccagatgtagactcatacttgaaaggcatcaagagcatccattgttaggacggaggtacagcagtaattagtgcagagtgctaatagaggaacagaaggtaggaaggaggccccagcgaaaggcagccgggggattcggtttcctctaggtccagaaccgtgggctgagatttcacaaaggagaagtgagggaagccctgctggtttctcattaagccccttggcctttgctcattcttcgtgggctccaatggagggtggaccctgtggcttcttcactttgctctctgacctcttcagccccttctctgctctcttctctgcttgtcctaggactgctgtctgcaggcacagatgccccccgttgagccacgcaggtttctgtgaatctgaggttctaactccctgctgccactctctggctcccacgtcttccctgcctgacactcccctcccttccatccatcaccctcctctctcctaagagtgctctctgaatcttattgcctttttatgtctctcttgggttcttcctcctgccctctccctgagcatggttttccttttttggagcatcccacagctcatgccattaatggagtcataatagccacggttggcttttcccgagcaaacagacttctgtgggctgcagaggacacagacccccactggtggctcgaaacacccctcctgcaggcagttcacaggctggacctttaaggttcccaccagccaggccacacattggttcctccatatttgtacaaaaagatgtgagccaggagcagtaggcaaagccctctaccttggggggaaaaaaaaaagttggtctggaggataatggaaattcgcatggggcgagggctctgagagcagcatccatgccccatggggtagagggcaagacagtgactgtccgggggccttttcagggtcgcttggtgaaacacaccctatatgaatgtgttgggagaacctaaagcagaagggagagacatagagcaaaatcagagcgagggtccccccacctcttcactctggctctgggaagagactgctggaggattctccacagcacagctcactcacccatccatttgctcaccaagtacttactaagcttctctccaggtagctaaagacacagaacatgggccaggtgcagtggctcacgcctgtaagcccagcactttgggaagccgaggtaggtggtgaagtcaggagttcgagaccagcctggccaacatggtgaaacctgtctctactaaaaatacaaaaattatccgggtgtggtggtggtcatctgtaatcccagctgctcgggaggctgaggcaggagaatcacttgaaccctggaggcggaggttgcagtgagctgagatcccaccactgcactctagcctgggccacagagcaagactccgtctcaaaaaaaaaaaaaaaaaaaggacagaacacatggaatgcctgatccttgattgggccgtaggtctagattttttaaaagcttgtatataggatatttgaggggacagctggggaaatttgaatgtgaaccgtctattaaataatgcctcaattgaaatttctgggtgtggtaatgttcttactctaggaaataatacactttcctaaattttaagatggtttaggaaaaagaaatacacaaagaaacacacattcacagataaatgtggagaaatgttcatcattgtcggatgctggtgaagggtgatggctgtgtcaggattattctaggtactagatccatatcatcagcattgattctgggtactagatgtatatcatcagtgctgattctaggtactagatccatatcatcagtgctgattctaggtactagatccatatcatcagtgctgattctaggtacgagaaacatcagtgaacaaaaccagcaaaaggtccctgcccttgtggtgctcaccttctagtggtgagaagagacaaggagaattaatgagtaaaatgggatctgttggaagggggttgggagtgctggagtgggaaggcgccatttgaaataggaggacaggaggcatctccctgtgaaaggggcgtgtgagccaagacttaaagggaacaggaggctgtgcgctgcagagcactccaggcagagggagaagccagcacaaagaacctgggtatagtgtgcctggggcttttatccagaatgtcgagtgtcctgtgaattccactttccagcgatccacctttcatcccccatttgctgttcggcgggcctagccttggaaatgaccttgcatgcttgaggacaccctttggatttaagctgcacgggctggacctgtggcagccctctagagtgcatgcattcagagctgttggcctggctccgtcacctttgtgattcggtacatcattctctccacacacaagatctttcctgccccagtgtcaagggcgataaccacgatgaggagaaagcacgaggctaggaataagaccatgtgcatatggacccacatcctccatcccatctgattcagcggggtgacctcagccaaccacttggcttttcttagcctcagcgttcctcctctgtaaaatgggagtaggtgcaacttcctcccagaaaggttaagaagatgagatgaaagtgagcaaaggcagattgtgagctgcacattgcggaaactgttagctctctagacattcttggtctctgagcagcttagtgttgggggctggggttagcagacatggtccttggttgctggtctcctgctgagtaaccggagccttgaagtgagtcacagagccttataccccttcaccatctgtaaagagggagtcaccacttagtgacgtctgctgtgtcatccacctctgagagtgggattccaagaaccagagtaccgagtgccttatgaattccactctgcgaaaaaattaatagtaccttggggtctttcatgccacgttagaggttggcttctgctgcaggctagccaggcattgctcgacagggcatcttgtttgagctcctcttcatgtctgaaccacaaaggcacaagccctttcaaggacatgacattcagatgtgcctctcctgtgtgtcctctcaactttgtgacttacccccttggctgccagtgaggccttctgaacattgtgaaggcagagagggctttatagcaatcaggctactctttggaaattgtgctgccttttagtggagataggttagctcctgcaaatcctcgaggccatggtgagcagccagcccctccccacagcccgtcccaggccttgaagggcttcatctgaggacccgaaggcctgggttcctaagctctccctgagcaccatttgggcaagtcatacacagagagggagaggaaacgagttttaggagttcttagctgggttgttcccatctctaggtggcctggcagtgggaaggagagaggtgagaagagcattgtttatcaggtactgtcagaggactattcctggaaaacactgctgaatcttctagaaggggtgatttgtgttctttccatattggcaggttttcatttccctgcttaacatgactaaggactgcaggacctgtgcatgctgttaggtaactctggccccaagatggaccctaggagagactttgacacacaattgatgatgtgccaggtggatagaagtggaagtgcagagcacccaggcactttcagccaattagtctggaaatgacatccaagaggcagagaggtactggctgtgctgcctccattcgtgtgtttgcctctggagcaaaatcaggctgggctgctctctgtagggatcatgccaaggatttggcagctctctggaagaaggagtgatttggccaagtagatgtgggcctcttatgtctccggcaggtcttcagactcaaattcttaagagaccaaatgacatcttgcctaggctatcaggcagcaccattgcagagaggcatggatgaagctgtgtcacgaggagtggcccgggcaaggtgtgagatggtggcttcacttcctttcacaaactctaaggcagcatgttctccaggtgtggtccctcaccagcagcatcgccacctgggaactaaatcagaaactctgggagtggggcccagagagctgtgttgcagccagtcctctaggtgatgttggtgtgctttcagaaccactactctaagcaataccttcatattgaccactattaagacagatcacttccactgacagagtagttgcttatggcagccatggcaaggtggaaaccgtaggtatcaggagacctgcgttcaagtccccctcttatggatacattttgtgggaccttagaaaaaacacggaacttttttgagccagtttattaatttataaagtgggaataatcatacatcatctccgtggattttgtgaggattaagttaaattgatggcctacaaaaatacatttttttttttttttgagacagagtctcactctgtctcccaggctggagtgcagttgtgtgatcatagcttactgcagcctcaaactcctgggctcaagggatcctcccacctcagcctccccaagatctgagactacaggcatgcactaccatgcccaagtaattttttttttaagagatgggggtcttgctatgttgcccaggctagtcttgaactcgtggcctcaagtgatcctcccaccttagccttccaaagtgctgggattataggcgtgagccaccacacctgtccagaaagtgctttttaacttccagtattttgcatgtaagatggcattgttatgtttatcgaacacctgccagtttccaggcaaacgtgatccttatgtgttatgtcaggtaggttgtctttttatccccaattttacacaagataaaactgaggctcaggctttaaacttggtagagcaggacatttagcctggttcagcctgattccatgttggccttggagtttcactgggagtccatgttcttaaccattatgctttttaaaagttctcatcctggcttaaccatcatctgtgacactttcaaaaatactgagattgaggccactggtttgatgtggggctcggccactgagtttctttaaaaccttcctggatgtttggaatatgtagatagggttgaaaccatagtacgttgcgtatataccaccacccttccatctcagaacagatgctgcaaatccagagttacataaattcaaagtaagggacacagagctttagcaaaccatgggcagtcaataagtgcttattagatttgtgaattaagaagttttaaaatagcattcactgcaattttaataaatcagataacaggtgttcattttgggcaagtcgaagagtccaggaaactggaggaatataatgttacccacaatttgagaacccctttttgtgaggcctcaggaggtaggaagaggtaggcgttgttcttcccacattagagcaagaaaagcagccccaggaaggctcagcgatttccctaagtaggggtattttgggggttggtttttatagatggtgggcaaggggataatagtgtaaattttgtactttgagcttttgggtaaataggcagattctgaaaccattgtgttgtatctactgattactataaaggcacagatccaggctctttgttaactccctggcagactgagtgcttccaagtgcaatttccctcccctcctttctttagaaattacctcgagctgcaaagtgagttgggctcaggttggcatgcaggcattttccattccaagggacaggaagtggctgtgaatcttgtaacctgtattccttctttgagagtctatagagttggaaataaagacacagaagtctcctgagtgccctggcagtgcttccctggatgaagggtttggggagaacttctagagagccagactttcattaccgaaactccccatctttctccccaaacccaaagtagcagtgagacctgctgatcaccttcatgtaaaagaatagtaataatccccccgaatcctgtccaaaccacagaaccctgcaggttttggacgagtcccgccataaaaccactttcccatgacttcccgaacagtaaaccccagcttgggtaccagggaatggcgctttcagtttttaatggactgcagctgaagcaagttcaaaagtgcgaggattgtaaacttgagagcaactctgcagatgccgcacaccgtggcagaatgattcagggggccaaactttgcctcatcaagtcagagaattttctgcaaatgaacttttcaagaattatgccgtcgttggcattacagtattacacacatgcctgttcccgatcactcactggaacttattttgtagttaacctccataaaggactgtgcgagcgagcacaggcctgtcacacacacattatttagaagcccttattattattttattgccagtccttgacagctgaggaaaagccaagcgctttaatctttttttccctttagtttacagtgtaagagctgcatgtaagatggatttgattaatatgtaacagagatgcaattctctgtaaaatgtgctgtactttagcaccctggaaaacaaactgcatcacaatggcttaaatctcggtccattgtattatatagacatcataaataatagagagcaggcagatattgctgcaggcttcatctgcataacacatctgagctctctataatgtgttcaacttgtcacttttagtacagaagagaggtaataaagctaacagctgactaacacacatcagccctacttctacttccaggggggtgaatgctcattaagccatcttagccctgacttttaaaatccataactcttacaaatgtaaaaaagttgccgcaaaagattaagcgcataatatatgtcaaagtataatgttttatgcatctcccccaactaccactccccgctgccgccgccaccaccacaccaaaagtctggtttcttttatagccttctcactagacgaaagaaaataaaaaatctggttctcagataaaaccaaatgaaatattattttcccagcatcactaagggactaggtaattgcttttgagtttgaagcacatgagctgaccccaagaaggttgaagattgaaacctttccccctctcctctaagaccagctcaaaggaaacagggagcttgggcccaggagtttgagaccagcctgggcaacataggaacaccctatctttacccaccaataaataagccaggcaggtgtgtggtgcgtgcctgtggtctcagctactgggggggtggtgaggcaggaggattgcttaacctgggaggttgaggctgcagtgagctatgattacaccaccgcactccagcctgggtgatagagcgagaccctgtctcaaaaaaaaaaaaaaaaaaaatagggaatcagtcatccccactgggaccttgcagacaggccactagatcagtcttagctgccttaagcacgcccttacatttacttgcctcagtttccctattggaaaccagaagggagtaaacccctccattttctttctgaggggactataaggccgagttcagcactgcttgtcatttacttgcctcagtttccctatcagaagtcagaagagaggaaacccctccattccctctctgagaggactacaaggctgagttcagcactgcttgtgcaatcacagttgacagaggtttcagagtctctgttgtgctcttctgattagcagtcttgtgttttagaggaaaatttgaaaacattacggtatgtcattttctgtaatgatggctgagcctttttagggattaaggctgtcaggcagaaaagagaaaaggatgtttatactcttaactcagagcagatttaatcctatgggatgcattttggtgggctaggggagcattgtggtctctttctcggggaggctgtgatgtatacagtacacggatgtgcatgtctcatgacattcatctctttcgaaaatatactttagaacatttctcttggagctcctaagaaaaataaatggttggtggtggcccggatggtaggaagacaggttaggatgaaacaggaaatttttcttagtagttataaatctctcaaggggaaaagttagagccccaacacttgactcatttagaacaagttgaaccaacctctgaaaaataaactcacagggggaaaaaaaaaaaaaaaaaaaaaccataaaaaatcctgcatgaggtcaggggactggcatgctaggctaatagaaactggaagtcagcgcagacatcccaggatgcactagaataacatactgtttacttctgtgattagctcagaactaatggtgtgtgtgtgtgtgtgtgtgtaagtgtgtaagagaccaactgagacacaggggctttcattgataccagtggtgcttgtgggcggggattgaaagacggcttggttcccttggctaggagtgtgggcctagaacagtaacacacttttccactggtcacaatgacagtttgtttttggagaaagccatcattaaactgtgatgtgggccgtagcactgctacctcagaattctgttgctgtccaccaggcaggccctgaaagctcagctttccgttgctagagcccacgccgtcatcccttcttgcccatattcctgcagcagcttccagtctcatctcccagcctcccgggcttctgatctcccccgttccacatggcagccagtgtggccacatcatttctcacctcccaggcctgccattcaaagtcatccacagttgcttctttttctctctcattggtctaatccctcacccagcttccagccacactagtccacccggctccagccatgctggtccattagatgtttctagttatgctcagtactttcccatctgcattcaagctgttcctctggctcagaacactctttatctttgtaaattgaagtcctattcccatctttgaagagtcaccatgaaccctacccttcaggaagactcactagacccctacttgaaataggtctttcgccaggcgcggtggctcatgcctgtaatcccagcactttgggaggccaaggcaggcggatcacaaggtcaggagatcaagaccatcctggctaacacggtgaaaccccatctctactaaaaatacaaaaaaaaaatagccgggcatggcggtcagcacctgtagtcccagctactcgggagactgaggcaggagaatggcgtgaacccgggaggcagagcttgcagtgagcggagatcgcaccactgcactccagcctgggcaacagagcgagactccatctcaaaaaaaagaaaaaagaaataggtctttcataaatctgtgagctcaccagttaactaagttaactaaggtaatcaggttccttagttcagaacacactgtcatcctggatccatgggaggccgcccttagttttccccactatcctggcctgctccccaattctcagacacccagcctcatgtgcctgatatgtaaccttgtcaagtagatagtgttcttctgtgtgggtgttttgtttacataagtgatgatatgctataaatcttagttctgtttcttgtcactccacataacatttttagaatctggccttgctggtggttgcacatgtgtttgttgcttctcaataataccgaatattctatagtgcacattcccctagtatcagatagctaaggttgccctcaacttctcccatgaaattagcaccacaatcaagcacacactgtcaccataaccatccttgtaatgtgtctatttatggaattctgcaatctacctgcggtgcatgtaagttctaatttccagatgtccttgcccacacttgctgttattcacctttctagcttttgccatcttgatagtataaagtattataaggagttgaccatttttctgagtttctgatttcttgttgatttgcatttttggtataatttaactatgggtcattggctattattttggacactcaagtatcttcttcaaatctgttgcccattagctaactgtagtgaccttgatgttaagagatctttacttttgctatagtgaaacaaatacatattttggcctcacttaatgttctgggagtatctggtttaataagtctttttctatccttcgtgcacagatatcatttcacgtgttcttttattagcttcatagttttatttttcacttttaggtctttgtttcaccccataatactttgtaccatttcctagagtttgccttgaatttatttccaattgtgtcctcaaccaggtgtaaagtcttagaagaactatgttgcattctccatccaagcctcagctttgccgagccttaacctgactgacctacttccctgtgtccatactgatgacattccttccctacattctcagtggaagacatatcactcctcttgtctcaggtcaactttttgtgcatctgagtatctccttccattccatcctcctcagtgacttctcttctgtcttctaagctctctcgctgtcagcacataaacatgcgtgtcaactccccttctcgtgcatcttcctctggctccttgtctcttgaccccattcacttgtcattccttcacagcaactggctttgcctctgcccgttgatggcactgacccatcctcatagaagcttcagtcatttccacttgccaggtgaaggagtccctgcattcatcaggcccaccctgaagggcatgtgaaatgttacgaccacccttcttgatttttgattttttaaatgtttttggttttgtgatattcccgtctcctcatcttcattttgtctctctaacaattctcagatcattttcagtgattcctcagcctccacagattccaagattatgtccactctgatggctctcgccacttttgcatgacaatgatactggactatgtctccatcccaggtcttgcccttagcttcggacccatattttccatagccaacaagatggccaggtgtcttgtggacacggaacattaaaaatgtgcctaatctaggccaggcgtggtggctcacgcccgtaatcccagcactctgggaggccgaggtgggcagatcatgaagtcaagagatcgagaccatcctggccaacagggtgaaaccccgtctctactaaaaatacaaaaattagctgggcatggtggtgcgtgcctgtaatcccagctacccaggaggctgcaggaggagaatcgcttgaacctaggaggctgaggttgcagtgagctgggattacgccactgcactccagtctggcaacagagcgagactccgtctaaaaaaaataaaataaagtaaaagtgtgacaaacctaagttatctttcctcaacctctgtgtcctctgctgattttctgatttttaagtggatcctaagacaggtctctgggaatttttctagactgccttttaaatcaaagaaacaaactttattatcatgtactaattgaatgtatcatctctgatctctctctttccccaaccctgtccaaacctgttcctgtattcccatacccacaattcagccagttaccaaagccccacatcagcaagtctccccagactcttcctttgctgagtgctatgtattttacctctcaaaagactggctcagtccatccctccctttccaccaagacagcctctgctatgacgtcctggctcgccccacctaccatatctgtgctgcagtagacctggggtacggcctgagaatttgctttcctgaccagttccttggtgatgctgaggctgctggtctagacgacactttgggaactactgcttccgttgatttttcccatccatcaattggctcattcaacaagtagttattgagtaccagtgtcaagttctggaattcaacaatgaagaaaacaaggtcatctattgaaaaggttgtggagggaacaaacaaagaataaattcatctataatgtgatgtgtaagtgatacatgctaacaatggttagcatttataaatggttgaagggacggaggagtggtgatggagagggagtcgtcagggaagacttgctatttaggaaaattttgagcagatacctagagggaagagcattccaaacagagggaactgcacgttcttgtgctttaaccatcctaaaacacagtcccgactctatcacttccctcgcggggtcaacagcagccacgtttgactgccattctgcgctctccacgaactgtctcccacacccttttccacacatcgtctcgcacccagactgacctgacttctcccaggtctctctgctgacatttcacttgcctcccctggggcacttatttgtgctattcacccccacccctcctaccttccagcaaatgcccttcttgtgtgtttgcctcatgccagatcctgtaattcattcaacgtttgcttccatttccacctcctccatgaagccttccagaatcatcccctttgaaagtgccctcttcctcctcattccagaaacatttatccccagaagtgctgcataacccttgtggcatctcacccttgtatattcctcacctggcccaactctgtagtccagcaaatgcgtagtagaccttgggtgaaggatggcccagaagtgtttctcctgctccttgacctctccaagaggcgggcctctggtatttcctaaacgctggtggctttactgttgaatcagagcaaaaggagaaaggaaaggccatggcctaaaatggagtattggaatgatctctgggtttctctgtttatcccagctttctttctgtgctattaccaagataattgagttggaaatactagtagcatttccttcatcttccttcaggctcacaagcgttcttcacccaaagggagggagattaattgacttcttttatcttccattcaaatgaggctttcatgtgaatcgctcccaccctcccgccccctcagccctcccaacctcccctcattcattaggagctggacatgaaaaggagagcatctaaaactctgcagagtccctggatctccccagacccctctcttccctcattccccgccaaacatttctgacctggcatcacaacagttcacgtgagaagtgtcacggtggggcagagcagatccaaccggaagctgcaccagccactgaactctctccacaccaccagatggtctggtgctgcagcagcctttcagaattaataactctccctccagaggggcagcttcattcaggaaccgtttcacattttccagctaagtgtggttttttcccatagagttttctggccgctctgttctgggcagaccatggggcctgctcacgaaggcaagagatgtatcttgccttccctccacctttctttgcctttggcttctgacagcgcagcttttaatctggaaattatggtaacttgtatgtgcattttgagagtatatcattgctgcatttaattaacggttattagtgttagcgtactgtgctgtattctatgtcacaaatcatcaagtctcccagagcagttacagcaattaagaactccatcacaccttctgtatagtcatttggtacttttccaggtcttttcaaaactggaaattactaatcaaatcatttctgctgtgtgcctcagtatcgtttattccattcctaatgatgtgcgacttttttttctttggccgttaacagaggcatccgtgcgtctaacccatttcacaccaccgtcatgctttagcgaggcgataatgaacttgcagaaggaaatgcaggctttggttctcttttcagagcagtgtctttcctctcctgctgttgggtgattgaattttgaaactgtaaaatgcatcgacagacctacaaacctgacttgccagagccacagccatcacagttgagcttcaattcagagctcagtgcgactcctgcctgatcaatttgtcatccctctaaatggaaactaattacttcccagggaaagattgcaggcaaatatcagcctttgcatcagcagccctctgcagtgaggttaaggcagagtccatggggtttcaccagaggggccatttccctctctgcctccgtcatgtcaggaagaatttttattatttagagcagcagtgagcttgccgtcacatccactaaggtcagccgtcaagcgtgcatctcacttaataggtcacctggacggtcccaagtcaaatgtcagaggccattcaactgccaggttgcaacaaaaacaccctggcaggcttttgatggtgtttagatggggatgagccagcccgctggaggggagcccaccgcctctggccccccaaggggattctctttttctttatgcccaagaacactgccctggaagcatccccggaatgactgaatcattgccatttgtgcggcatcgaacagactgtgccgctgacagctgtaggcaagattgactccgatgcagtgccaggagatctaggccatgcaaggcggctgctcaaggcccgctctagtgcgagggccctggctcagggcagcagggctggcccagaagctggggccaggaccgggccagccagctcagaggctgttgaacaatctgatcagaggagggccttgccagttccctacctttgcccattttggatgctgttctgctctggccttgctgctcatcattccaggctggctgagcagtttcaaactcagggctgatcctgccacctctgtgtctgggctgagctgcaaggtctttagcccagcattgctcagtcttggacattctcccagcagaagtcagacaagacccaggagagaagtttgttttgttcagcagctgattggatccgctcactgttgacttgtgttccatgttggagaatgcgttctggtccccctgagctgatataaaggagcccaaactcaaatctgtgcccattccacgtttcccctctactccaggatggagagtttttcctctcattcttatccacacagcgaaaaacactagacacagtgagaaacgctggacggctctgggggccgtgggagctgggatgagcactgaacttctctaggcctcagcccacttcgctctgcaagccctgaatgtgcctggacaagatgaccggtaaaggccattccagctctctgtgctttgtagcctgagtccctgtgaggagtggtttgctttgaaacacaatataatccagaaaaaacagctatcttaacttggccagctctgcttttaagcaagaaataaagtgatggtttcttgaaaatgatgctggcctttataatgccttctcccttaatctccccacaaactgagacaaggcatcctgggtcacaccctggctcgtctcctgtgtgatgtgttttctgggacttgcactttggtaaccagaggagactgccaactgggtatcatacctgtctctcaacccctcttctgcccaccaccctctctcagcctccctattccctgaagctagcatgccagggaggcaggtggcatacgtggtacaaggactgcatgcgcacattttggaatgaaacagtggcctttctttggaactcagaccatccagtgtgctctggctaaagacaggattgtagatctaagaagtccattgtactgattagtttcatctcagtttaagccactgacctaccaagagtatccattcaggaaatgtcaccccatggcctgatgtagtggtaggagactggaaatagctgagtgatgacggcatgtacactcagcattgcttagccttgggcaggtaccgaacctttctttgcctcggtttctcatttataacatgggaataatgatagtacttacctcttcagggttctggtgagggttccatgaactaaaacacatgaagagtctagaattgttcctgtgctgtcctaggcccaggatgaatgtgagctgctgtggttacagctagtgtcatagtactccgcccccctccaccaccagactaccacagtttcctgcattctgtgatgccgtcagctcactgagtcaccttcaccaacacctttcacgcctctggacttcagctttctcatctgcagcacgagggagaggaatgggctgaggcttgccatggtgctttcagggacaggcgtgggagcatctgtggtgagtttgcagttctgtgttgtatatgtctgcaccaatgagagtttcatgatcttgaatttatacattcatatcatgaagcacaacctagtagcatgtttagatgtagaaacacgatataaaaacaaaacagaatttgttttggtttttggttttttgttttgtttcgttttgttttttgagacagtctcactttgtcacccaggctggagtgcagtggcgtaatcttggctcactgcgacctccgcctccccctttcaagcaattctcctgtctcagcctcccaagtagctgggattgcaggcatgcactaccacgctcagctaatttttttttaaatttttggtagagacagggcttcaccatgttggccaagctggtctcgaactccttacctcaaatgatctgcctgccttggcctcctaaaatgctgagattacagatatgagccaccgcgcccagccctggaaggaacctttgttaagagttcatagtaacagggtgctaaaatgagtttattaaaataatcccagtagatgaaagattaggagatctcttttgaggaaattagagagtttagatctgttttgaaattagggaatgccttttcctattgacctaagtctctgattatatatgtcaacctcagcttacggaaagaagctgacatgtcaaaataagaagaataggctggatatggtggctcatgcctgtaatcccagcactttggaggctgaggcaggtggattgctttagctcagaagtttgagacctttagattagaagtttgagacctttagattagaagtttgagaccagcctgggcaacatcacgaaaccccatggagcatgtctgtggtctcagctacttgggtgtttgaggtggaaggattactggaccgcaggaggtggaggtggcaatgagccaagatcatgcccctgcactctggcctggcagagtgagaccctgtctcaaaaaaaataaaaaagtaagatgaataaacaatggttaatagaaacataagtggtgggacatgggggtcaggatttaatctcagagtgtcccagtggtgatttattttatttatttatttatttatttatttatttatttatttattttttgagacggagtctcgcactgtcacccgggctggagtgcagtagtgcgatcttggcttgctgcagcctctgcctcctgggttcaaacgattttcttgcctcagcctcccaagcagccaggattacaggtgcccaccaccatgcccagctaattttttgtatttttagtagagatgggccttcaccatgttggccaggctggtcttgaattctggacctcgtgattcacccgcctcggtgtccaaagtgctgggattataggcgtgagccaccgcacccggccccagtggtgattttgtaggtcagcagagatgatctgtgtgccacatttccttgtagcttaacaatgggcctcaatcatgtggtgcttgggttcttagaatgtggacagccaagacattccagccacaagtaacagaacaaaatggcttcaaccatggcaggggggcgggtgtgagtagtgtttctaaatgggactggttaagtattttggggcacggattggcttctctgccattctcttagctttctcctcatgatttcaagatggccgccatagttatcagacactatttcctcaggaagccacactcacagacaggaaggaaaggtgttcttcctcacgtacctctttttatcaggaggaaattcttttctagagaccccatagcaaacttcccctcaggtttcactggccagaactgggttacataccgtctcctaaaacagtcaccgtccaagaataatgggattgccaagggtggcctgagcctcctgtaacaggggaagaccacctgcccacagcatggcgccatgcagtacctgaacaaaacctgggttcagtgaacttgagggctcttgcctgggcaaccaacagggtctgtctgggaccttaaagtcactgattctgacttagcacttaggaatcaggcatgtggtttaatctctctgaatgtcaaagaatgtgagctggtcaagagcagatctagaactagaatctcttttctcttactgtgactctcatccccactcagctttcttcctggaattatttttactttcaaatgtgtgaagtcagacatacaacaattgtgcatttcacttgaaactagtatctcgttgattgctaccaagaatgttgtttaaaattgagaagtacatacatttacctctacatatctccagtgaacttctgtgaccattaactgtcaattttatcagattcattttacacgcaaagcaaacacatctacacccttgtctcaagaagtttccaggctagatgaaaaaactgttcctgtacccatgacagttagacataaattaatagtgccaactaattgattgatgaccagagttcaaatcaggggaagaaaggatcacgttgagggcatggctgaggcccaagagaatgatttcaatggacagagaggaaggaggaggaagtccgaatgggatgaagataatgttgatagtaatgatcaacattacagttatgagcacttgctgatatgagtaatgatcaactacagttattgagcacttgctgtttgagataaagttctaagcactttacatgtcttaacttatttcatcctcacaaaagctattatgagatgggattattgtcttctcattatttccgctatatagataaggatcatgacatacaaagaagttaaataaggtacccagtgccctagagttagtaaatggtaaagctggacccaggtaatgtggcttcatagcctgccccctctctggtgctcagcctcatttactgtagcaaactcacgaaactgggaaacccagggttttgtgaggcgacttctgtacaggtgttccttaacttacattggggttacatcccgataaacccttcatacgtggaaaatattttaagtcaaaaatgcatttaatacacttaacctactgagcattgtagcttagcccagccccccttaaacacgctcaaaacacttacattagcctaccatcgggcagaatcaactaacataagcctgtttcataataaagtgttgaggatctcatgtaatttattgaatactgtactgaaagtgaaaaacaagatggttgtatgggtacctgaagtgcagtttctactgagtgcatattgctttcataccagcataaagtcgaaaaatcgtaagctgagccatcggaagttagggaccatctgtatgttgatttagctgaagggaggatttataggcaaaatagtgagataaaaggtagggaaagttttcactgaattcagaagtatttggaactggggctggtcatctggatcccagaaaacactggcaaacacacgcacagaaatgcacagaaaaagaataccccaacattgaacaccaaaggccctcagactttggcgcctccattttgaaggtgagggatgtttctatgtgtctgtaagcagtgaagacatcaccggattatgatcacatcatacattgcacacgccgtcacggttgcacgttgctctaatcccatgtatattactgtgtctatttggaaagctgcaagagccatttatttatgagtgactaagtggtagttgactgccttcaactcctcatgttttacaaagtaggaatccacagagaatagcagtaaccaatacaccaaaccaccttcattttgagatgaatactgagaagtctttcattactctgcagtataaagtgtttactaaacagaattaagccacagcataataccctgccttccttcttctctatttgattcgtcctacttaacaccagcaaaagtacttctgccattttttttttagggttagacaatttatgccatttaaagtgtaaaaatggaatttacttggcagttagagggaaaagaattgacattatctagacacaaggagttcatgggtataaagtctcagatcatcatttctgctaaagatcaagtacctaagtaaatgtaaaagactacactgagagagacatccccagttggaaaatgtgccaagtcatagaaaattgtggtagccctgaattttcaagaatggttttggccagatgtggtggcgtgcgcctgtagtctcagctactcgagaggctgaggcaggaggatcatttgaacccaggagtttgagttcagcctgggcaacatagcaagaccctgtgtcttacttttttaaaaaaagaatggttttattggtgtattttgattattgtaaactaattgtagactctaatttactcttggatattgagatctgttttgactcttggcaatggtggtgttttttggtgattggttgatgttttatctggcctgatatccagattcttttttgtaatgtacatactctttcctgatatcgtttatatgacaatcctcccctccccttatttaaatagaggtttaaaagtttaacaagcccaggtgtggtggctcatgcctataatcccagcactttgggaggtcaagagaggaggatcacttgagcccaggaattcaagaccagcctgggcaacataggaagactctatctctacaaaaaaataaaaaatcaaccaggcatggtggtacacacctgcagtcctacctactcaggaggctgagacaggaggattgctttcgaggctgcatgagctatgatcatgccactgcactccagcttgggcaatagagtgagaccttgtctcaaaaaaaaattaataaccctatctctcatacttttatattttctctttggaaacctaaccctcaatatatttcaaatgccttgtaaatggcttttgaagaatgcttcacactggatacctgggttctaatcctaattctaatacttaactgtgaacacggatgaagtatgtcagtctctgtgatccttacgccctagacttcccttccccaagtggtttgccaccattaccaattaaaatcctatacctctctgagatccagttcaaatgctacttcttgaagctctttttgatactgctttctcactttcctcaagaggccattatgtcctgtccttttgaagggcatgtttctcaaaagccaaggttgtacctttagtttcttgagagccaaggttgcatctttagtatcttcagtcatctttgcaccccagaatgtttagcacagagcttgcccatgatggctactcaaatgctgaaaggatgaatgactaaataaatcttgagatcagttgtatttttttctttaaaataactggctacagtcactggctctcaaccctggtgttgggctcatggggacattgtaatcagttgtaagcgggttgaagtgatttgttatgaatgattgttaggttttggaagtttgcaaactatgtactgtttgtataaattagaatgtttcccttcagtaatattctttaatgataatatcatcatcctgcagtgttaatacttcagtgtgacactctcccttgcattgtgatttgtcttaaatggaagaaaaaaggatggacttagagtcaggacccaggaaattgtatgttaatccacagcctatcttttctgtgccaaagcccataataagccagaaatcactgctaatggttatggaactatggaaatatgatagtcctctactactgtacgagatgtgggggccttgtcaaaatgaacattatctgtcaatttagagaaaagaataaccattactctaaaccaggggtcagcaaacttttacagtaaaggtctagatagtaaatatttgagggcttttgagggccatacagtctctgtagcaactacccaacttcgctattgtaatgcaaaaaagctattgtaatacataaatggatggacatcactatgttccaataaaactttatttacaaaaataagacggaggtcacattgggcttaatgagctgctctaagccatagagtacatgggaatgtaaaccatactgcttattttttttaattgtattaatggcatttattctacttcctttgtaatagctaaggagttcctgcaaagaaagaaaaattaggggttagtaaatttgttacttatttgcaagaatattcagtatatatttcagggttaatattctctagactttctcagcataagaaatgagatgaaattctgttgatgttgtaaataccactattgaggctaattcgtgaaagaaaggtgactacggtatttgatgaagtaccttgtcttccaagaagtttgcttttgtggtattatctgtggcacgttattttctgtcttggtactttctctcagtgggatatttaggctctactttcctgcttggcacttttgttaataatgactttaaaaatcctcacttctctttttaaattgctgcatggagtaatagcctctctccttgacagtcaaaaggccaagaagtgcaactatgtgaaataaacttttaaaacaaggccccaagtgcactgcaagttgacttgaaataattagtccctggagtttggacacccacaaagtatctttcggaactcggattcagaaatgtctcagtgacagcctgtggcgggaagccatcacagcagcagggcccattgctcttgggacatcccacactgtagagttactttggcagtgcctggaagcagcggcccctgcccacatggcttttccactgtctcacagccaagaaccatgacaggcccctcagaacttgggccctctccagtccttgagccagtgttcaccctcacaggaagagtgtttccctgttttatcagcaagtaacagaaaacccagatgactgcagcttacaaagtaaagacatttctctcccattacaagaagcgtggagaaagcatgttgtagaggctcagtgttgtcacagaggacctaggacccttccaccttcctatgctgccatctcagtgttgggggatgacttccctcatggatgcaagaaggttactgaaacgccaagtataatgtcactacctcatgtggcaccgtgctttacggtaagggggtgagcataaacagaggggattccaagtgctgttctgtttgagcaggggacatttttcccagaagcccctggtggttttcttcttgggacctgcttgcttgaacagcatcacctgcctctggcataggggaaagagattgccgttattggcttagaccaatcactaccttccctggcactggacacatgccacatcagggttctactggaagacaagagaaagggatggctactgggggagcagccaacccaggtctgccacacccagctgaaccccctagacagtggtcagagcaccttttgctttgaccgaggaatcccaagccttgccaagaatctatggccagtcctctgggattattgccagcagttttttctgtttgttgatcatctgcagacacctgattccctgtcagtgctttttctgtttgacaggacttcttgatgcccaccaggatcgagcttgccgagtcttttggatgttgtgtgttatccacccagccaagtctttttggggaatatttatggaaatatttatatataaataaataatatttatatttccagaggtgctctgtacctctgtctatcccttttgggggataggtaagccactttggggccctcaatcccttaacaaaaataatttcatttttcttagtaaaatcatataatgtctgcatttttcctttgcagtacagaaatacatgattggtattttttaatagattacttttctggaacagatattattttgaaaatttaaaataaatttgaagagttctcttctaccagtcttaatttcatggaatagtttaaatattatttaattccatggtctaaactattggctcttattgtctttttttttaatattatgtatataaaattaggaactcatttaagaacagcaagaattgatttaatctgtgagatgccaaatggagctaatcctgaaatactttctatctgtagagattgatagtttacaaagcactttcatacatattatttcagtactttccataactattatctgcatttgacggatgaagaaataagggtataagagctgaggtgacttggccaggatcctaccagccttcacagagttggcactggagcctgggccttcacagcctgcctctgagacactgtcctgtttctagcacttaagttccagtgtctatggcagcatgcaataggattacaggaggacatcgtagccacagataacccggccatgttacctgttcatttcaacctctgcgactaggcccagatttctcaggacatttccttccccatgagctgaattttaacatgcaaatgtcactcacatcctacaagctaaggtgtatgggtttatgctgggactaggtcatatctgtattttaaaaatcccagaacaaccccagcagtggttttagagatgaggaagagaggagacagaacaagttctgctggttaccctgctcttggacttctcaggtgcttcattaatatcatctctgatggcattttgatgccatttttctgatggcattttgcagcttgcctcaagtgtcccttctggttttctaatgtaggacaaagcccaaggatgagtggctgcggttgccagtcagcattctctgcagatgtctttggtgtgtgtagctggggttaacccgccgtcttaatgtctgcctactcggttttgcatgcaaggatacattatacaagaaaattccatcgagatcatgtacaagtaaaatcagcttattttttccgaagaggcaggggagctacttcttagcagagtgagctgtagagtctctctggaatgcaaaacacagacctttgtattagaagtgaaatatttagatagggatcattatggagctctttttatagcaaggcaggcctgaaaaacagagagagagctgggaaaggaagcacaaaggaggtaataatatctgattagctaagcagctggataactgaaggagaatttgttaaaaacctatcaagacatcaaagctagatgtgagttgctctgttagcccaggccacttgtggagccatctctggaatattactgagcatctaatttgctgctattttttcccctagcgtcactccttcactaagggatctgagctgtaacctgacctgtagctgtcatcagggctttttttccatccctgtcatggcatgggatcccagtatggagaagcttagttggtattcaagtcatccgcatcgtacttgaccacgtgtgaacaagtaacctcatgtttctggggacaggcagggagaaacttgagaacttgatccccttgggggcccttggaggattgcttccaccaagccctgggttttgcaagtgactcgtttcccaatctatggcacatccaagcctctttggttttctttttccctgttcacacggatatatttgaggcaccatactctatctgcccaagaaaggaagaggggcaaggaaaaccgtgtaagtcatgcttgtttaaatattttggcttctgccaaagcagatatgagaacaattggactataatgagagttttccattggcctcaactatcctggacagttgaacgccaagcctagtttgataggtacctactatggacctggtggagctccttcttaaaattagacagtgtgtactggccagaatgtctcagcttgcagcctgaggatgattatgctgatcctggaggccctggggaactgtctagggcactaggggtgcctgtgctaacagcaaaagaccactcccccccaacaccacacttgcacatgcctcatgcacagaggaagtaggtgccaggtcttttcagagaagagcttcaaagccctgctgccacctacgagagcctttgatccatctctcggctgaatccagcccctcacggggctgatccgctttgaaaccagagccagcagcccctctacaactccctctgagttacctcacacagacaagagcacaggcttctggggggcttctttttatcttccctaaattgcgagaggtacttctttcagcgttgtcctataggattcttaagaactgccggggagatgtcttagggccaacacaaagaattgcaaacaacagcccagtgtcttggaaactttctctacagtttagtacggataaaccacatgcagatagaaaataggaagaaaaggaaattcatggtaagcctgcgtattttcttatttcgggtgcgaggggagtggagaaatccgtcatggataaaatccaactttaatgacagtctgaagccctgaagcacagacatattgcagagctaatgtattattttgtttttgtttattctgcagaaatggggaaatttcattttttagtagaattacaagctccccttttactattcacaagccctaacatgcatggcatcctgagccagagagccttccgtgattttaataccagcttctttgtgaatctaaactggttttccagtccactccctggcgggccacgggggttgttggagtggtgttacacatacttagctttctttgggtgcttgaccaccgcctgttctcaggggggacaaggagccttgctgtgggcattaccagtgggaggtaggcatggacagtgaggttcggcacctgacctctgaattcccgcggcccttgcaggatatcacgcccacgactggcggtcctcagcctgaactgcgcgttggaatcacctgggaagctttaaacatactaaacctgggccctgctaaatgacacccgtattctgatataatgggtctgggtgtggcctggatattaagatttctgactttcccctcccacctaggtgattccatgtgcggtccgggctgagagccactgtcccgcagcctcatcatacagcttgcctaggttccacggctgtgtcacttcctggccatgtgaccccgggcatgttaactgagctcagcttccttgtttgtaacataggggaatcactgcaagattcattacacctatctcctagagattattgcaggggttcaagttatggacattactgggaggataccatggaccagacactgttgtgggacctggaactgttatggctgggaaaaaaagagatcagagtccctgcctttgtggcgcttctttattttctagtcatggatatggtggataaacaaacaaacttgcatatacatagtgtaatgtcaaatcgtgggcagtactgtgaagggaaaatatggccaaggggaagggtggcaagtggcaggagagagtgcatgcacataaagggcacatgcagtcccgggctgtcagaaatgcaggcaactggctgggcatggtggctcatgcctgtaatctcagcacttttgggaggccaaggcaggtggatcatttgaggtctggagttcaagaccagcctggccaacatggtgaaaccccatctctactaaaaatacaaaaattagccaggcatggtgatgcatgcctgtagtcccagctactctggaggctgaggcaggagaatcacttgaaaccaggaggcagaggttgcagtgagccaagactgcaccactgtactccagcctgagcaagagagtgagactctgtctcaaaaaaaaaaagaaaagaaaaaaaggaaagaaagaaagaaatgcaggcaactgtgcatggcatccttggcagggtctacagtgttgcagttcctaccacttcaccctgggtcaatgagatctcagtgtgatgtctttctctaaacagattatagacactccctcaagacagacctcagactctgtgcaagcccagggcccggtcgccatctgtgtgatgaatccaggcacctagctccgtgcacagcttctcaaagtgagcgtagatttggagagaagaagggataatcagatgtttcatttacccaggtacaacagatacgtattgaaggcctgcagatggcaagacctggttcaagcacaatggggcagaatatgaggaaggcccaccccttcctttgtctcttcccccacagccactacagttccttccaccagtgtcaaccaccaccgtggcagagcatttcccgtgagacaggccgcaggctacatacattatgtgcatcctgtcgtcatgtcctcaccaggggaagtagctgttggtttattcaaccccattttacatgggaaggctctggggctttgtcatgctatcgtttgttcatgtcaccccaggccacacagcagctaagttggaaagtgtttgctgttagcctgcattgttgtccttccatgagggacctaacgtgcatactaaaggcctactatgtgccagagcctggcatttcaccattaagtcactgaatccccataacactgtgcagatggaaccttctcagctttcctgaccatcccttatcttgggctagccctcatgacacatgtcacaccctgcaattaccttctttattcatttgttgacttttatttgtctttctcccctactagaacatcagcacagacagtggactgttatcattcactccagagccggcatttgaatggagattagctggcattctagatgccgcctaattacctgacaggagaaagaagaccaggacagaagcagctgaaattccaggcagaacataggttgtttcagaagaaacacaaactctccctggcggcgtctgaggccatcttcttcaggaaggtgtttcttggatgcacttcaaagcgtagggggcttcacaggtagaattaggttgcaggaatgaggggaaggtagtcccctggaaaatgtgaaaatgagggttgagatgcaggcaggaaaattcaggaggactgttgagtgaatagtcgctccctgtggcaggtgaccagggtgggaggagggtggcagtgtgaggacatcctgaaacacacacgctttggactcagatcttgctgttgtagctccgctacctgatcagtctgtgaccttgggcaacttccttagctttatctgtgaaatgggaataatagtgtcttcccttcagtgagaaccaaatgagacagtactttctgtacatcgaatgctggtgtagagcagttagaacaaatctgtagatctgtagatcgatgctggtgtagagcagttagaacaaatctgtagatctgtagatcgatgctggtgtagagcagttagaacaaatgagtctggggaggtggacccaggctgtgttgcacgagcagggcctctgcacaggcccagcactgacctcaggtttaaccttttacttgaggtacgggaatggctttttggatactgttgtttgaagaaaaaaaaaaggtcatgaataaaacttagaatactaacaaccacccagaaagccagtcccatctctgcccagtaacgccttcctttcctgcaggaaggttggaaccttccacagttccaccaggtattggcctggtggaccagattgaaagggtgagcagacaatgggggggcagacacctgaagccagagatgtgggccaggtgggggctgtcggcccttcccacaggcccaggcagctgcgctgacacagctgtccctttgaaagttggccccgagtgggaagctctgcattattctcccagcccactgcagaatgccttctgcccattgcacagtggcagcgtgctttgggcagcttgatgctggggctgcatggagggcctcagaaaagtaggtagactcgtaagacgggctttatcctggaacaggcaccaccaccctgccctttccagagccaagctatggacatgggtcctggagaggcagaaatgtcttaagggaaggaaagggaaatcctaattactacctgggaaacagtcctcatttccaaacccagcaggtgacctgcaggataatgtgtgggcagtgattcattagaagctgtaatccccagtgttcaagcgagagttgtaactgtatctagggcctgagagagagaaacgggcttcatgaattactcctctggcaccgttgcctacatacctaggcctgtagcaatttatcccaaatgaggaaataataatgtcattttcctccagcctttccctgggaggaagttctctaatagagggtaggcaggtgttaagaagaaatctttctgggccacacctcattacaagattgggataagtgagctctttttcagcttctgcctctcctgtccttgccttgtcagcagcagggttgggagttaggcacagggcatggtgggaaagaagtcttgctgggttctcagtcattgcagttggttgttttaggtaaagtaaattgatgttgtgtttcttttccctaaatattgactgttgaacctagttgtggaagaaaagatacctgtattttgctcttattacttgctattcactgctactcttcatctggaggtcactagcaatttttaaacacttatccccattttacagatagaagatagtaagttctatggaggaatgaaaggcctttttacagagtaactgaggttccatatgttgaactagaataaagtttaagctcctgaccaggtgcgatggctcacgcctgtaatcccagcactttgggaggccgaggcaggcggatcacttgaggccaggagtttgagaccagcctggccaacatgatgaaaccccgtctctactaaaaatacaaaaattagccaggcatggtggtacacacctgtaatcccagctacttggaaggctgaggcaggagaattgcttgaattctgccaggaggcagagattgcagcaagctgagatcatgcaactacactccagcctgggcaacagcgggactctgtcttttaaaaaagaaaagaaaagaataaagtgagctcctatagcaagtggagccccacaggaagaaaggcttcaatggaacggacgttgacttctcgtccatccgacagtcttatggatcttgctggttggccctgactccccttacagtgtcttagggaccccgttcttttcatctcgtggctttgccatctcgtaagcctcttactttctatatccacccaatcatggggaggaagactcagaattgacacttagcacctctgccattgccaagaactagtcatgtgaccttaactactagtgaaaggcaggggtggcccggaaatggagtccttcaccagacagttgcttacctgagacaacatgcatgtacctgtgaaatgcgtatactgtagaaggatcatgagtttggcacataattagtggataataatcactaccacgtctcagaatgagtgtcagataattagtggaccataatcactaccacatctcagaatgagtgtatttgctaatagaaatgtggttttggcttaagtcacattgtcagtggtgaatgcagcctaaaattgaactcaaatacccaggccatagttgttttctgactccaccaaggcagaaatgaaattgttgagtttgagagtaagtagatggggccagccaaagcaagatggacagaatgacattcctttactgtccttattgacaatttatggttcatgcaatagaaaagaatcttaaaagtctctctttaatatacaagaagagaaagacccctggaaacttgtcttttcatcattcgaaacctaccttatcccttcagtcaaatgcagtggtacctgtaaagctcacacacagttttgcatcaaatgattatgtggtcagccatgtaataagtggattcaaagaaacgtatatttaaggtggccacttgcccctggggtaaatggcagctgttggactctgtgggattttgtgttgttgttgaacttgtaaagtgatgaaacctcataatttctctcctcttttagttccctctctgtctgagcagctgtactgaagtttgtcaaacatgcccattagctttcacatgtaaagatggcctttttatattcaaattttagtaatatattatttaatcattaggcagtttactaagggtatatttgtggccattgttctttctgaatgcctaatcactaaaggaaaacattttggaaacaagcactttcttccagaaactgtggtttccaggagagagagtcactgggaagattgggaagccatcagtggcatggcacagagacaccatggatgctgctgctagaccagccctgacccagtagtaaggcctagccaaggacacattgaactccttgaaattgctgatatttggtcaggcacggtgccccgcgcctgtaatcccaacaccttgggaggccgagctgggaggtttgcttgaggacaggaggtcaaggccagcctgggcaacatagcaagatccccgtctctaccaaaaatataaaaaattagccaggcgtagtgatgcacacctgtagtcctagctactcaggaggctgaggcagaaggatcgcttgagcccaagaattgaaggttgtgttgagctctgattgcaccactgcactccagcctgagcgacagagagagaccctgtctcaaaagaaagagaaaaaaaaatgcttatattcaacaatttttgtccttccaaacaacaatttcatcatattcaaactaatacaaaactggcttcccaaggaggtgtttgtttataaggctacagggcaccattttcctaccacttctaacattgtcttataggaggttctctgaaatgagaaatgcagatcttttttttcttcttctcctaagacagggtctcgttctgttgcccaggttggagtgcagtggtgtgatcatggctcactatagcctcaacctcctgggcgtaagtgatcctcccgcctcagtctcctgagtagccgagactacaggcacacatcaccatgaccagctgtttatttatttatctatttatctatttatttatttatttatttatttatttttgtagaggtagaatctcactgtgttgatcagccttgtctgaagtcctgggctcaagtgatcttcccgcctcggcctcccaaagtattgggattacaggcatgagccaccacacccaggcagaaacacaaatctttagtgaggtagcattccatttagctacagaagcactcagcatgcagttgacctttaaacaactcgggtttgaaatgcatggattttagatgtggggctttttaaaccaaacttggatcaaaaatatggtattcacaggatacaaaaaccacatatacagagggctgaatttttgtatgcatgtattctgccgggccaactgtgggacttgagtatgcacagattttactatactcaagtgtcctggaaccaattcttcacatataccaagggacaactgtaatgtgaacacaaacccataaacagtgcaacattaccagctttcccaggatgcatgtggctgacagaggagtcagcatcaagaagggctccactggcggctgggggcctctgagctggagcttactgacaagtggaagatgcccagatgataaggtgccgtgacagattgtggtggtagcattgtgagctggttgacaacacagaactctggaatcagatggcctggattcaaatcctggactcaccccttattggctgtgtgagctaaggcaagttacttgccctctctgtgccccaatttcttcatctgcaaaatgggaataatgataatggcattatggtttactgaaaggattaaaagagttaatatgtttaagtacttggaacagcatccagcacgacactaagtgatatggaggtatttgctatttttatacagagcttagtggcatgaagaagttagacaagcaatgaggaattcaaggtggtgtcctggagtagaagagaaatcggttctggaagggagacttagattacaggacagacagagatttgggtgttgtttccacgactggaagaaggcgacagttggcaaatacccacctatgtagtgatgtccagcagaaactgtcctgagacccatctaactttgtcattccactatctctctgtctctgtgctttctcctgcccttcttcctgtctcaaaacctctagtccttttaattataggaaatgttcacgttttcccaccacatttttttttatatatgtctgggtgtaggaaatttctgtgcacccccaaggacacctgcagctcctctctctttgagtttggtgtatgccgggagggtagtcagaaaacagccatagccccctcctttgcaactgtttctgctatagtctttttgatggtgcaaggtgtaccctagggctgattgtgttcctgggagctggaagctgttactgcagggttaaatcagcaacaggagagcatcactcccagcaacctcagaaagaatagagaatgatgttgttgaagggagcagggagctgtgttcctagtgccgtcttcttaaaaaaaaaaaaaaaaaaagtttccttcccccctcttctctctgcctttccacaacacaccttgtactaaatacatttttcagacctgactttgtgcaaacacagtgttgttcggcaagcattaaaaggcaatttagtactcaaaggattaaaagctcatgttaaattgaagactacacttggcataaacattaaaaattgacagaacaccccgcacattaactgcaccagggcttcgtaattagcatttaaaagtaaaacatcatttccttactgtttcctacttactcatttataatgcatttattataatacagatgtgagcaagaggctttctcccatcatcagcagatgaaaaatatacctgtgctgagaaagaaactgggatttattaatccagcccaaaaagcaaaaccaataaagaaatctctcactgggctgatttgagagattcaaactaccccttggaagattgacacaaggcccccaaagaaatcgccttcacacttcttttccttttcttagcctttcactaacaaatactgggaagaaaatccaagtaagcttcagccaggcacacacttgcgtttaaaactgatcaactggcaggttaccaaaggaatgtggaaaagagcttgttggcccattgctgatgcttcttcaaaactttggtaagactgggatccaattttctaactcagggaaattctgctgacttaacacagatggctgaatttgtaaatgaggacacctgttcatgacacctttgggctcctgcttaaaatcagggtttagtttttagcattaccaaatttgtaaaatctgaatgcagtccaaatctgattttatgttcttcctccagagttaatcctaaatgtgccaccattgcggtctttggacctaattctcggccccttcttagtatggtaggtagtaattcccaaactctagcatgcatcacgatcactgggggtctccctaaaatgcacattctgcctgagcaggtccagggtggagcatgagattctgcatttcttttttcacctaggctggatggagtgcagtggcacaatctcagctcactgcagcctccacctcctgcgtccaagtggttgtcctgcctcagcctcccacgtaggtgggactttaggtgtgtgccaccacgcccaactaatttttgtacttttagtagagatgggtttcaccatgttggctaggctggtcttgaactccggacctcagatgatctgcctgcgtcagcctcccaaagtgctgggattacaggcatgagccaccgcgcccagccagattctgcatttctaaaaagctcccaggcagtgccagtgctgctggccccaggaccacatctttgagtggcaacgttgcacagaagactctcatcagttatcagtcagtggattcagctcatcaaatgtgaaagacccccaaattgccagctccctgtggtaaacccatggcaatgactaagacaaccaaacacagtgcttgccctgaatgaacttattctagaaatatctgagaccttgttatctttctcaggcctctcctactggacctcgtttgtcatgtgtgattgcgaacacctttccctgatgttatctagagatcctgacaggcatgttctgctaaaacagacctcccaggctgtccccaagtggcctcaaattccccagctggggcaccttaagtttatcacgttaggcagttaacaggacaaatataatttctgggccacaaggccagtctgggtgaacgcatgacataagggtgttaaaagtggaggggaattccgaaaatagactttactcttgtcagaatggtgccaggggctggcccagcctgtggaatgcctcagcgctagagggcttgggcagtaaggcacgcttccctggggagggtggtggtggctggggagaggagagccaggttcccaagaaagtaatttggcacctgctctatggcaatcccttacaggcgaagagagaaaaaggaggctttgggacagataggggaattttctgatacaagcagtccccttgtattttcttttcattgtcgtaatgatttgtaaaattccagaaatgtattcgtgcccctacatgacttgaaaatgccgctgtctcactaagagccatgggctaaaacacacccgaacagcggtcagaagtgaggctcgctgtctctgaggtgaggacaacagcctggattcccgagtcaggctcacatctaagcctggcagggcctggagggcggcaacgtgtggtttgcaggttcgttcattaccccagtgttttttatgggaagatgcttgggtgtgtttgtgggaacagaaccctgattttaattacatcccttctggttattcagattatagacttctaaggatcttgtttctctggctttcttctgccctacagagggacacaagggttcagcagagaaagtgcctgtgctctgtgttgacacatagaagcagagaattttagagcagaaagggacttcagtgcatttagtccagcaccctcgaattataggtgagggaactgaggctcagagagattgaaatgacctgcctaaggtcacacaagtaggattaaaacccaggtctcgtaaacctctctattttgtacatcatgctgtctgcacataattatttcttttcagatatttaataaaagtcacaatcagagttagtccatttcttgtctctcctttgagagttgaagtcatcgtgtgaatagccataattactgcattttctgtgcgtttcttatttgattcttctttggcacaagggctctgaggatgcttcagcattgtaccaggcagaaaaacgaacacaattagcagattcaaacagatgcacatcgcatctcacacaggttaatagggaatgtgcctttctaaagcgaaggagccagggttaaacagggcatggaagaattcaaagggtaaaatgaatatgattcacatacttgtagagtggccaaggagggccttattttttactcttcaacaaaacagaggtttggcgctaaaaccacaaagtaacgttcactgtaggcgcacctcaggcacaccccgtccctgctacgctacacgctgcctggtctctgtagactgttactgtctgaggacctcctctcacaaacacttatttaacaatggcactttggctttttaatattttatttgatttctgttttatggtatttttaattgaaccctgttttaattgccttttctgcacaccaagagcctaggtggggaaggaaggcttacaaatgaaatgattattgttattacttcctttctttctgcagcgtcttagtcaaattataaattgattccatccacatattagccccgatcctcatatgcatgtgtcagaaaacagaaagtgttgaataaggaggctgaaaattttcatctagctgagaataagatttgtcagcattattacagagtgaggaaaggaaattggggctaagttcttgccgtcgagttgagcagagtacttggttccgggtgacacagcccacaggtgggcaaggtttcataaactgagagctagaagtggcctagaaaagacatttagtcgctccctcgtgtccagtcatagcccagggcagacatagtttatcctgcacagccttggctgacacctccataaataaggggaccttcctttacagcttttcagagtctcaagggcagctacacagttgcccttaggataaaagaataaacaaccctcatccccttaaacttctgcccctctttacccagtgcccccgcatcctgttttttggaatttgacctatttatgcccaggcactgactgcagggttgacagtagccaccctgaaggggccttggtagggagtaacaaaacaggcggggtgcggtggctcacgcatgtagtcccagcattttgggaggccgaggcgggcggatcacttgaggtcaggagttcaagaccagcctggccaacatggtgaaatcccatctctaataaaaatacaaaaattagctaggtgtggtggcgcacgcctgtgatcccagctactcgggaggctgaggcaggataattgcttgaacctggtggggggatggggacacggaggtagcagtgagccaggattgcaccactgcactccagcctgggtgacagagcgagactccgtctcaaaaaacaaacaaacaaaaacaaacaacaaaaacccagatctggcacacacagaaatggcttctggccttattacacccgctgcctccccagctgggtattcagtgggcagccactcatagccttcataaaatgacttagatttgatgcttgaaatgaaagcttgtcaatcctgggtaaccgcttgaagaaaggaacattatcccttaaaaggatagccctagcccctagaatatctttctcaccttgggacttgctaaaatagaattccttatttcaaaggcagtaaaatgttttgagttcctactatgtgtagtatgctaggctaggcactacaggccaagcaaggcaaataaaactagcctctttccctattcccctgcatttcagaaaagacaacacatttcaaggctctgctttgcaagagaccaggcaccacagtttcctcctatcagcctgggcatggcaagtaataaccccccctatgaatgaagaggttgctgtgttcaaagaggttaataaagtgtccaagaccgtacagtgtcagtgaggcagggaagaaatctgaaagctggtccctggctaacctgtctctttgcgttgtcaacctggaaggaagtgtcagatggtttggcgcagagctctgtccttgggcctggcctgtttgcaacctttgcttaggtgaaaagtgagagtggaagacactagattggaagaagacaatcaggataccaaaaaatatcccagcagactgaggaccagaacgaaagccgtggcagtgagagtggaagggaggaaatgagcaagaggcacagggaagacagagcagcctgaggattcggtgaactgggtttggagttagggagggtgatggcctaggtaagaccactgacaatcaggaggaaatcccaatgaggtcatctgtagattgttgatttttaaagtgccaatggacaatcagtgccacactccaccaaatgagttggagatacagaagtgtaaggcaggaggagctggagtcttgggagccccctacttggaaattacagcggaagctggggaactggtgagagagagtcccccacttcctcctttctagacattgaagggatacctgaagaatctcaatattaaaggataagagaatccaaagaaggcaatattacttgagaaacaagagaataataatagtattttgtcacggaagcccagtaacaaagggagagacagtctgccacttctgcagaaagagacagaaagggccactgtgtttgttaattaggaggtcctcggccagagacctgctaagctcataaacgttaaaggccagagttactctctttgggtggaacagctccagggcagctgaatagataatagtcactgcttcctcgaaagggtaggacacatgatttctttttctttttttttctttttttgagacggaatctcactctgtcaccaggctggagtgtaatggcgcaatctcagctcgctgcaacctccacctcccaggttcaagcagttctcctgcctcagcctcccaagtagctggaactacaggtgcccgccaccacacccagctcaattttgtatttttagtagagacggggtttcaccatgttggccaggatggtctcaatctcctgacctcgtgatctgcctgcctcggcctcccaaagtgctgggattagaggtgtgagccaccatgtccggccaggacacgtgattttaaaagcaggggaagctcccatgctagtcaaaacaaccctactacagcattcatagaagaataagatagaaaatgagatgggagcttagctggtgacacagcagggcacttgcttgcttgggtcagcccagcctagaaagtcagaggtgacggcactaatcagacttcagggaaactggctggctggtaacacaaatcttctgtttacagtgaggagtataaccagcaacccaacgcgagtgacctacatgcagtagttggcccatatgccccccagggacaatccctaaggaatccaaattataatcagaaagtcacttgctgaccagggattataggaataagggacctgggcagaactgcccactctctcctgttttagtattggtgaaactctagtactgtgcagggacttttggtactcacttgtaacacttgattgtctttttttttcttttctttttttttttaagacagggtctctctttgtctcccaggctggagtgcagtggcaccatctcagctcactgcaaccttcacctccagggatcaagcgattctcatgcctcagcctcccaagtagctgggactacaggtgtgcaccaccacgcccagctgatttttattttattttattttttagtagagatagggtttcaccatgttgtccaggctggtcttgaactccaggcctcaggtaatccacctgccttggcctctcaaggtgctgggattacagatgagagccaccatgcctggccggattgtactcttttgatcctacctgtttcccagtgctggattgtgagctctctgagagcagagcctgggtcttactcatctttatatcctggtgccaagtattctgtgttggtcacagaatcatctacttctatttggaatcatctactatttctagaagaccttagtagagataatggtattagtaagtgcttctgtgtttggggtgcctactctatgcctgcaggcacattagataaagatatctttagagctaatagatgccatgaggcgtatcctacagataggatcctgagcttcagagatgacagatctcatgtaatcaagccggctttatgaggtaggaggggatctgaacctggtctgcctcactccagagcacatgctcttcccactgggccgcattacctggagtcactaaggcctgtttcacaggccccttgactgggcagctcccggctctgctccgtggatgtgctgtgtgctaaaggggcggtgggggaggggggccctgagaaaggaatgttcaggcattggttaaaataggtgtcctagcctcttgtcatgccttcatattcacaaatgttcatttctttctttctcttttttaaaaaaattcttcctagggatgatgactgacagattaatatatgtctaactacatgtctcagaaatcaaaaggaaggtgctgtcagaatcacttgtcagaaaatgagattaggcgcacttgtcatttgctgaggattgcagtctttcagagataaggtttcatttaatgagggtaaaaagcctccttttaaaaaaagaagagggagcgagggagtgagggtggggtaggcgaggagtgatgattcttttttctggtgtcagccaagtgttttatcacctaacgcgatcccgcggcacctggtagccactgataatggcaacctggccttctccacctcctctgccgctgcaccacttcaaaagcagctgcttgttacctgcttttacctctccttgaagctgaagctccttctcctgtgggaagagggagctaagcatgtactctagatttaaaagcaggctcaagaaagcatgcagtagaaaggaaacgtacagtcacatttcccaacaaactggaaagaatccacaatggatttcagtgagatatggagcctgtctgagtagtgaagggtaactaatgaggaacagagctagatcccattgcaaccaattgtgttttgttatggaaaatatttatcaagttcttttgcatttgttgattctcttacaagtgacatagtaagagctcctggcatgtgacttgatgcacctcctgcaccctgcgattcaggctggcaatttctatccctttattaagcttctctctacctcaggtgtggcctgtgctccagaagtatttcaaattaatcctcccccccctcaactccctacctccaatcgtagaaaactgcctctgaaatgaacaactttattgtggagaatgccggtgataaagcagaaaatccgtatttcagaaatgtttggtgaccaggcgcagtggctcacgcctgtaatcccagcaccttgggaggccaaggtgggtggatggcttgagatcaggagtttgagaccagcctggccaacatggtgaaaccccgtttctgctaaaattataaaaattagccaggtgtggtggtgcatgcctgtaatcccagctactcaggaggctgaggcaggagaattgcttgatgagcccaggaggtggaggttgcagtgagccaagatcgtgccactgcactccagcctgggcgacagagcaagactctgtctaaaagaaagaaaaagaaacgtttgttccagttctctactccaaaacttactggtgtaaagcagtacccttttcttctgttcctggatttggtgggtcagaaattcagacagggccaagcagagaagcagtttgtctctgctccaccatgactggtggtgacatgaatggctggggactggaatcccctggaaaagtcttcactcatgcatgaggcacttggcagggacaaaagcacctctgcaagccttgtccatgtagcatgggcttctcacagaacggcgtctgggttgtgggaggagttgccggaggggttgctaccagaaagcaagtatcccaagagcttgaggcagaagcagcgagacttctgacctggccttggaaagtcacatggagccacttctgccattgagctgaagcactgacaagcccaccaggctgaaggaaagaagatggggaccgctccatggggcagtgtcaaaggatgtgcagctgtgctttaaaatgatcatcatgctgtaaaggtttctttctacctgtgtttcttcacatctcacgaacgaaatggcctaggaatgtaaagtaaatgacatttggatggttactgacttggtataaaaggttattcctcttcattaaaaagaagaagaagaagaataagatataggccagatgtggtggctcatgcctatgatcccaacactttgggaggccaagatgggaggatcacttgaggccaggagttcgagaccagcctgggcaacatggaaaaccccatgtctaccaaaaattagcctggtggggtggtgcgtacctgtagccccaactactgaggaggctgaggtgggaagatggcttgagcccttgaggtcgaggctgcagtgagtcatgatggcatcactgcactccagtctgggcgacagagccagaccctgtctcaaaaaataaagagagagagagagagagaaaagatgtagacagagagagtgagcccaaccacattaatggcccagggagtctgaggggtggagtgtcctgttcctgctctctgttgctaatggtttaaaacagactcagacttcacttaaatgggcacctttctggccgggtgcgctggcttatgcctgtaataccagcactttgggaagccaaggcaggtggatcacttgaggtcaggagtttgagaccagcctgggcaacatggtgaaaccccatctctactaaaaatacaaaaattagccaggcgtggtggcatgcacccataatcctagctactcaggaggctgaggcagaagaatcacttgaacccaggaggtggaggttgcagtgagctgagattatgccattgcactccagcctgggcgacaagagtgagattccatctcaaaaaaaaaagttcacctttctgtttctttccagtccttctctgttacactcttcaaaaatcgtctgtacatacttgcctctatgttcttacaactttgtttagaacttaacatttaatatgtaacctagcttcaaccccattttctaacaattctcctgctattcaccagagacctcctaaatcagcgatccacctgtcttttctcagtccttctcctccagcacctctaacacatctgccatttttgagttctcctcctcctggaaatcccttcttgtcattcaactctgtctgtgactccttccccagcgcagtaaacgtggacactgtccaggtgtagtccttggttgtgttttcttttcacgccacgacattccctcatctctttgcagaagacatttgcaacttatctgcaaatccgagctctctttctgatgttccactcccaaatttctgaccgtggctaggctttcctcacggtcttctaaattcatctcgtcccaagcaaagtctctatattcccctgaaagcctccacatgcttctgtgttcctgatgttaaccagttccccagcctttacatcttagcatcgccctttgtgttgcatcactgccacacactcgtgcgttccttgaggttctgcctcctaagtgtgttttctcaccttagctttgccccgtgtctcctgccattttcctcgagtcacttttccttttttctttttgtagaggcagggtcttgctttgtctcccaggctggtctcgaacttctggcttcaagtgatcctcctgcctcggcctcccaaggttctgggattataggcatgagccactgcagcccacctcgggtgacttttcttaatgcttccctggatacctatcaggttctaccttataaaatttttataattttagtaggttctggccaggcgcggtggctgacgcctataatcccagcactttgggaggccgaggcgggtggatcacaaggtcaggagatcgagaccgtcctggctaacaccatgaaaccccgtctctactaaaaatacaaaaaattagccaggcgtggtggcgggccctgtagtcccagctacttgggaggctgaggcaggagaatggcgtgaacccgggaggcggagcttgcagtgagccgagatggtgccactgcactccagcctgggcgacagagcgagattctgcctcaaaaaaaattaataaataataataataataattttagtaggttctaccttccccacgtgtagttgtcctctctccctcctaaattataagtttcctaagggcagataacatgttttgttcttcttttttttgtacatagttcatacttagtaaaagtatccatactgaatgaatggctcttacttatactgtaaagaaataaggcatacagcggaagtgtgtatgcttaatacacatacaatacacaaactgttggatttaaggaaagattttgatgacatgaagaggctaacactgccgaacgtacttccaaatattgccttgcccctcaactctccttggagtggtactggggggagcaagacacataagcaacaataataacaagaatcataatagatatatttattgagcacttactttgcagttgatgctcttctagctaaggtaatcttcacaaccctggtcttttcaagacacactttgagagacaggtacagtatgttttccattctagagataaagaaactgacagaaaaatcaaatactactttttttattagttgggtgaatgcttagtaccaccaaacaaacctctttttgcaatccgtgctaaagcaagtaagtgccttaggctcaccaccaaagcaggccttcctttttcccttagtctaaattttattgtgggttgaccacgaagctcagagcaacttccaaggggcccctagctgagcttagtcatcaccagtcctgaaggcaacagaaggcagaagagaggcccaagtgtgtgcaggactttttaaattcaaagctgtggtttttcgaagcacagggaccctgtccactggcaaacctggcccaatcagagtcttatatgctaatactcggattggcaaccatgaggaaagctgggagagtttcctttccctcacacaaaccctaaatgagtagatgaataaatagaccctgcatggtatatgtaatcatataccaagcataatgagagacaaaggaaatgtggcaaaatgttatcaatggaggaagtcaagcaaagagtttttgggtgttattctcaccatctatcattattttttcctgttagaaatttttcaaaatacacacttaggcaaaactttaaaagacatctaaaacaaacaaaaatgagtaactgtaaaggtaggagtcaacaataaatacacgggaaaggaatctgaagccaggaacgttgtggcccatccaagggggaagtgcccagagagaagggaagaggtagaactggagacagctggtgcttcttagggagatgctcagcctgcccaagaggctaatttaaaactaaatcttatccctggatcccacagcccttaatgtgacccaaactttccattaccaaattctggggttttaaatcctgatattgtgtgcttgaatctggaatctgtctcatccattaaagatctgacctattgaggccacatgtgtctatgcaataagttcttttcaagccaaactttcatgttaaaaaaaaaaaaaaatcctgagaggaaatacatgtggtccctgtccgcttctagcccacttcaggctatttattgttttatttgattgttgagaagtcagaaatgactaaattggttctcaatgtggcctgcacatttccttggctaggaatggtctgattaaggcaaagcccaacttagaatttagcagtgttctgatctgtgtgggtttgggggaaggcatgtgtattttgttctttcgttctgaagtccttcccttgtggatttcagactaaagtgggtgtgatgacacatttacccttttggttttgtttttaaaacacaaagctgacaaatgtgtttaatggccccgtagtaccaactgacagcggcacggagcccaggaggctcacttgtaccttgactgtctcagtgaggaagctgaattttactcaccacttagaaggattaaatgcagaccatagcatacttctgacatttcattggcttatcaggaaattccatgagagtggggaggagggtggaagcagaagaggtacatacattgaatggtatatcctacttagaaattataaactctaagaaaatattaatagaaggaggaaaatatttatttttcagcacagagactattctctgtttatacattaggtaccagatcataaagaatcacagagagagagagattattcatcccaactggtgtgcattttaatggtgaagaaatagttacctgacttacccaaagtcataactagttgggactggacctgttgtaaaatccagggcttctgacctttctaatccagtacagtattcattcagcacctcatcttccctgtcatggtctacaatagccctgcaaacagtcttctaaaactcatcagagttggctgctcatgtgatccggtccaggtcggttctctaatctgcctacaggtcagttctttgaaatcatttccatgcctcctcatgcacccccaaactcagctggtcattttgcaaatgcaggttgtcagctgtgagtgagcactggtaacagaaagaaaatccatcaccacgagtgctgatggaaaaacaactgggaacgtactgcctagtagaatgttgtttgtggcccgatctttgtataagaaggaaaacatcataaattaaaagaaaagctaccagccaacaactgtatttttaccagcctcctcttcttccagaaaactcattgcgaggaaaataaatagcattctttcccagcagcacaaccgaaagtcttgttagttataggcgagtggctatttgaaagcctggctacaattttcctgttttactaacacttgtaattaaatccatcaactccctctaagattctgtgtaaataccagatgctccctacatttttttctctcctggagaatatgaaaagttgtacattagcagtagaggaacttcaaaggaggcacagacctgagtgaaagtgaagttctgaagatccacactcgcttccctgtgaatttcttagagtgttccagggagggcagcccaccacacttggccagcacaggcccatcccatctctcacccgagtggcggatgttaagttgacatccgtgccccagttcaggagcagatggctctgcgtggggcatggtggtttgggagaatccacccgggcctggcgggaatcctgttgttgagggaggagtagggccctgcctcccgctccccgagggtttgcagcccgcttttcatgtgctattgatgctgcccccacccgctgtcacttggagtcattcagtcaatcacatggagaatcagaggagaggcttgggatggctctggataaatcctccctcgctactgggggtgagaaaatcctcttcagagcacatgcactcctcagagggcatcagtgtacatatatatatatatattttttttttcttctgtatgcaaagaagagtaacttgttcccccaaggtgaaggatttcagcggtaggcaaagcaacaccactaccaccccaacccgcccactttgcttttccagaattaaacgtagttgcctagagctgtcatgacctacagagaaagctgaggaagtgttaagtgaatcatgaaagcaaatcaacagacctgctggtatttaaattttagtgtattccagtgtggatttcttggtatttgtaatgcaaaaactgggaacgggggctccacctcctctcccagcagatccaaccctatgttccaacttagtcccagcatattcgaccccatgttttgtgtgaatttactttaaagtctttcacactcccgaggccgtcagcaaagcactcatatcttatgggcaacccccagccctcttcgcttataaactaactgtccgtggctttggggttgttccctaccagttttattgggcaggttgttagctaagggattcattctagaaccagaggtttgaggcagacctctaagatcctcttgactctgagtgtgtggaggagagtgagggaaaggacagaacccatggcccgcgccacctcagcttctttcagtttctatttgaaactgaaatcacagaagagctgtcagatggcagctgtgcatttggtggaaatgagaattccagattttatgctaattcagtttcaggttcctttgaacctgcagtttatggggccgtgctgaaaactgcaatctgttttggataaaagaagggattactaaagactttttagttgtacaaacattcccagcctccaaaaggaaaggggggagaccagatttattctttcattaaaattgtcatgttaagttttcttctgctttatcaaatagaaaacttttccttattttggcaatgatttttcttatttcaagtttttttgttgttgccgtgatttattttcatttcagtagcactctttctcgaacttcaaagtccttgtcacttcctcccagaggcaggaacacaaaggtggtgcccatggatgtatctcatcctggcatgtgctcaccttcttccattctcgcagtgttgattgaggctgacccagatggttgtttcacttacctattattgctttgtaacaaaccacgaatttggagcctggaaatacaatgctgccattagggcagggctctgcagagaagcttcctctctgttccacatggcatctgctaaggcaagttcagctggagctggcggagccacacccaagatggcttcttcacgtggctggcaagttgtcaggggctgttggctgggaactcagctagccctgtggtcccaaggcctcagcttacttccatgtggtactgcttgggcatccttactatatggtaactgtgttacaagcttaaataaccagaagctgctgggcccaaactctgaatctccagcatatcacttcctcctcattctattcatcaaaacagtcacacgtcagtcacaaggacataagtttcaccttctaatgggaggcatgacatgcacatacagaattatttgggagccatatttggagatgagcaaccacaatggttaatgatatattttttagaattttgattttcaggagaatgtacccacgctctgttgttagccatatgggtttctatattctgtgaaatcccaaactgttggcaattcgtggaaaggactttgcagtttagttttatgtttgagataatgtcttcattctcttctgttttagttggcagagatctggtcatttatttatttactcattgatctgaccactgcgtatcaacccatctcttacatgtgatgcatgagaatactgtactagatgttaagggcaatggtggtgtgtaagagtacatcacagtcctggtccttgagtgattgaatctacagactgctctccaaagcagtatcttgttcccagtgaggatacgtgtgcccctaaaggaatggcagtgtccagaggtgagccgagaaacaactacatgttatatattgtcttagatctatgtttccattaggaagcattcaagaaaagctgtagtttggagcagaagaagaaatttctggtgtaattcatttgcaatacagatctgtaaatggaaattacataggaccagagaggagctggcgggtctttgtaggcacacaggcttgccctgaccctatgtaacagcggcatatgatcataataactggcatttctgtaacagttaaccatctacaaactgtgctaatttgattgataaagccccagagatggaggctattggaatggccatagtagggtttcccattccattctgatagcatggaagagacagagagaaaaactaaggccagagcaagagggaaaatcagaaaccttgctcaataagaatgctttcaggaaatcgaaactaagggaattctacgacattctagctcctcagctactaccccagcaagtgtatgattccccaaaccagtagaagcaaatattttgtcctcagccaacaagaattcctgcaagtcaatatttggaccatcaggatgcttaataataaggctagggaaaaaaaaaaaaagctttgttagatcattgtatattagcatagatgcaggagtcaaattttcagtaccctaaagattattaatactttcaggtaacgtttccaggaggagatagcaaagcctttgagtagaaggatggactaacatgcggttggccaccattctcaggatgtcagtaatctttcaaaccacaaaacctgggaaggtaaactacttgtatatcccaggaatagtcacgtgacttatagacagccttaccatgacccttcagatcttaaaacctctctagagtttagacagcagaatgattttgtcttagacatctggccagtggagggagaaactgagatttacccagcagtggggataggatggtgtggtgtggtatggtgtggcgtgatgtggtgtggtgtggcgtggcgtggcgtgttgtggcgtggtatggtgtggcgtggcatgttgtggtatggtgtgtgtggtgtggtatggtgtggcgtggtatggtgtggggtggtgtggcgtggcgtgtggtgtggtatggtgtgttgtggtatggtggggatggacagtgggagcatggtattagggaaggaatgtgacatgcctgctggcaccatgctataatcctcattccttcactgcagaggacctccttacactcctgtatccatttccttatctaaaataaggaagaaactctccgttactctctttgcctcacaagattgatgtaagagcaaacgacattataattgtagcattctggaaaaatatgtgttactctagggcatttttggcagcgtcctttggagaggctgaatcttagaaccagtaaatggcaccgtcacatataatttatggctcatgctcttttttcagtctagggttcacttcttggttggttgatttctccctcccttccatttcaaggcactgaaatgaagactagaatcatattttgagcttgactcagtcctagaatagcagcagtctttccctgggactaaccaaagctagaaatgagggtcctcagatcagatacagaaaagtagttcttggctgggtacagtggctcacacctgtaaccccagcactttgggaggctgaggtaggtggatcacttgaggtcgggagttcgagaccagcctggccaacacggtgaaatcccgcctctactaaaaatacaaaaattagccaggcatggtgatgcacccctgtagacccagcttctcaggaggctgaggcaggagaatagcctgaaccagggaggcggaggttgcagtgagcagaaatcgcaccaccacaccccagcctgagtgacagagcaagactctgtctcaaaaaaaaaaaaaaaaaaaaagaagaagaaaaaagagaaatagttctccctcagtagtcctccctcaaactgagctgaaatgataataacatatgtggtatgacttgttgaatggtaaacatggtcggagaactcccaaaaaggtagtatttctttcaatattcatattagtcattccagcatccaactgaggaacatctaaggtggtttcagggccctcttttaccctgaattgttttttaaaaaaagaaaaaactgcggagagctcagcctaaaatggctaaaatgcctcttacctagagaactggaaaacgcgatcagttcaccagcagttccccgtttcccacagtggttgtttctaacattgccacttagtgcatctgctgaaacacagatggtcgcatccctaccagcaattgcagagactcccttcccaccctcccagaagctgcacccatgcccgggagcccatggctacagctcttaatttatacatgggtgcaatgacagccactgtttgctgagcaagcccccgccccagcaccatctcccccagctcagtccttcttctttcatagtaagctcctgtctgggatcctcacctgtcaacagaccttacagcaaggctgcctttgtcaggctaccatatgtcctgtccccttaggggactgggtgcttgacaaccttcatttataaaactaagaggggctgctagaagtcagctttcctgaaactataagaatgtctactcctaggtgacttgtcactaatgatgaaggtaagttgctgttccaagtgctttacatacatgaattcatttaaccctaacaacagttgcagcaaagtaggtgatgttatggccatactttctagatgtggaaactgaggtacagagatgcaaagtcctctctccaccatcacacagtaagtgggagtggaggataagctaggatttgaacccattggttctttcatgagtggctaagcttttaaccactagaccaactacctcttagttgtccccaaacatagaaatggctggcacctgtttaaaggccctttttgttttgtttttgtttttggagacagagtcttgctgtatccccctggctggagtgcagtggcgcaatctcagcttactgcaacctcccgggttcaagcgattctcctgcctcagcctcccccgagaagctgggattataggcacctgccactatgcccggttaatttttgtacttttagtagagatggggttttaccatgttggccaggctggtctcaaactcctgacctcaggtgatctgcccacctcggtctcccaaagtgctaggaccacgcacacgtgagccactgcgccagacccgaaagcatcttttcattcattcatttatttgtttttaaatccaatcgaatttagcagtggggagttgtcttaagtgtcttcttttccgctgaacacattattttcctcaatctgtcatctctgatgactgacttacacattgtgttctacgccgatccgtcctttcagctcatgcagacattttgtatacattttcattttaattaccaccccccaactctgccccatgttcatatggaaatagaggagccaggtgttggatacatgagccggtaactaaggcaggatgcgtacctggacttagtagggtcccccagggagcatggactcaatatgaaatgcaggtcgctagaccccaagtttcaaacacccatcaatatgacatgatgtgagaaagagcaaaccaagtccagacggaaacgagacagccatgaccaggggaggcagagaggcctcacagttctcatcacatgcactgctgtaaaaagtaagatgagatacctacagccaattgggtgacacgagcagggattggatttatttgtatttttcattgcctttctttgcagggttgtcagattctgaatattaataccttaatgtagatttggtggttaagtaagatatattttatggattttttaatactttttcccctttgtagtttatagtacattgtgaagtttgaaagtaaaattcctttccttgacttctacactcggaaaatatttattcccccctgtgtctcaatggtatgcatcataaactaatccagttcagtttatttacttccctcttgttgcagatccatgatcaattgtagcaacacgggcatataatggcagaggtttttactttacagcagtacgagcatgagctattgcactctcctttcagggtgataaggaaggaagcttccattttcagaatcacccattcagaaggggttggggggcactgagcagaggaactgggggccacctgacgttgattagccctgaatcgctaaggaagacatcccaatccatagtttcaaatgaatcagcctacacagaagaaatccctgggaaccagaaagagttttaatctcctgggctgaacagtgtggaaggcagaatattaggaattagcagaggtgacaagtaggacaacctcggcctgcctcccagtggcgggcaacctgttgactccagttctccatcctaggacccttgcttgactgccatgagtaagagcagtgggcaccgaagtcaaaatgcagatccctccaggcttctcagtagctgttgtctgccctgagcattctcccaaccttatcagttacccagacacttgttgggagccctcagactaactagcatgctgggacaatttccaccgtgtcttcattcctctcatcatgggtatgttgagcaaggcctcctaactctgtgctgggtacaaattccaagatgtggacaaattctaagatgtgaattctatccacaagaaaccaggtgagttcagaaggcatggctcggggcatacaggaggatttatcatcacaaacagataataaagtgttgtctccagacacacatctgttatttatactgctgctgtggcatggacaaagacaagcaagacacagtccttggatagtcacatttaaagccaaattgaggtggtgggtcctccatacagagaaaataaacaaaaaaaacaaatcatggccgggtgcagtgactcatgcctctaatcccagcactttggaaggccaaggtgggaggatcgcttgaggccaggagtcagagatcagcatgagcaagataaagagaccctgtctctacaaaattaaaaattagcccagcgtggtggcgcatgcccatagtcccagtactcaggaggctgctgcaagatgaccccgtgagcctagtagttggaggctgcagtgagctctgattgtgccactgcactctagcctgggcaacacagcaagacgccatctcaacaaaacaaaacatgcttctgcaccagtaagacatcatttttatagtcgtaggcaaaacggtagtcctcttaaaactggaaattacaatttaacatgtctaaatgacataattgggatgctgctattttatgttttaagaaattgaagccctcactattaagagtttcatcacatcttaaggctggcaggcttttataacattttgctggattcagggtcgactttataatctaccaagaatatccatgtggctgggtgcagtggctcatgcccataatcccagcactttgggaggcagaggcaggaggatcacttgaggccacgagttcaagaccagcctgggaaacatggcaaaacaccatctctagaaaaaaatttttaaaaaattagccagatgtgttggtgcacacctgtggtcccagctactcccagctactcccaactactcaagaggctgaggtaggaggatcacttgagcccagcaggtcgaggctgtagtgagctgtgatggcaccactgcactccagcctgggtgatagagcaagaccctatctcagaaaaaagaaaaagaaacacccttattaggagacccaagctatccactgtccaggttctgaccctgtctggagggattctttgcagtaggtcctctataaagatgtcgttcccagccaggcacggtggctcatgcctgtaatcccagcactttgggaggctgaggcgggcagatcacgaggtcaggagatcaagaccatcctggctaacacagtgaaaccccgtctctactaaaaatacaaaaaattagctgggcatggtggcgggtgcctgtagtcccagctactcgggaggctgaggcaggagaatggtgtgaacccgggaggcggggcttgcagtgagccaagatcacaccactgcactccagcctaggcgacagagcaagactccgtctcaaaaaaaaaaaaaaaaaaaaaaagatgtcgttccctagtagagatggtacaaaccactgtacccactttatgggactggtgtcattttgatgttcatgtggttattttcattattgtggtgatccccactgggagaacccagtagaaggcaaggctatggccattgtggccctaataaaatagacttttattttgttggtctccacggtaatcaaaagaagtgtgtcatctgtaatcataatagacaacaaatatatcctccttactaagtgccaggcactgttactgatgaaggccccaagaggtgtggctcctgttatctcactttctagataaggaaactgaggcagggagagtgaagagatttacccaagctgtcctggctcagaaatggcagagccacaattattaacctgatgctggctccagggcccagctccaaacctctaccctgaagaacaagtagaaacttggattttcagagcttgcagaacctttagaacttgaaaagaatggagacttccatagtttcagaaataaaccaggcatggtgacatccttgccgaggctagttggagttatcaccctccttcaatcacctagtgatcttttaaaactacatcatccataacgaaaggttcgaggaaattctggtgaagacttcctcttcctttaaaccacctcaagaagcacacagcacatgcgctgttagagtgcctgaacttcattatatttaggagggggagcacaatgaaattaatgaactttctctgtataaaacgcttaacagaagactataatttgtaagaaatattttgctaaaatatatttagcttaaatctggtaatttgtgatataaattgaatcccatctcagattataatttttaagaatttgcaagtataggccagacagagtggttcatgcctgtaatcccagtactttgggaggtcaaggtgggagaatcacttgaggccaggagtttaggaccagcctggtcagtataggaagaccttgtctgtacaaaaaataaaaattagttgggcgtggtggtacacacctgtagtcccaggtacttggaaggctgaggcgggaggattgctttagcccaggagttccaggttatagtgagctatgattgtgccactgcactccagcttgggtgacaaagtgagaccttgtctcttaaataagttaataaattcataagaatttgaaagtatagattgacttacaagaatttccctttgtttttaaacctagtttaaatctttagatgtatttttgagatttgaggaagaaggctccatattttaacgtagctttacattttttttaaactgattaatcataaacttggctaagatctttgggcatatattaaaaattatttctgaaatcattaatctaacaccagagtggaaattgagtccacattcttgctctctgctttctattagaaagggttgccgctttctaagacttgttctccttagattgggttcagaggctaaaggtgatgttaagaagccattagtgtttagtatgttaatccacctccatgtaacagaaaagatagcttccagcctttgacttggcatctttatattaaaactccaataaaaggaaattaaatttctcaaggaaaaaaaaaaaaaacaatcttcctgattattgaaagccctctgacctggattcagtccctaatatatggattatcaaatttagtcttctttcttccttcttcctacttctgatgctgttgtgtacctggtcccctccaattttgacattcattcccatccccgcttccagaaagcatagggaatagagcagtttggaaaccagtcagaaatgggctcatttgtgagtctggagagaggatgagaaatggagcaggtcacagtgggtggtgttctgcaaccgggccagccaggggaccctggggagcagcactggaggtggccacagtggtcagaggcttggcttttggcgttcccaggttcctcttgatgagagatcatcaaaagatctggacacatgcagatctggctgaggccgtcatctgaggcctaatccctggtaaccattgatgacaatttttttttttttttttttgagataaagtcttactctgttgtttaggctgtagtacagtggcatggcgtgatctcggctcactgcaacctccacctcccaggttcaagcgattctcctgcctcagcctcccaagtagctggggttacaggtgtgcacctctacacattttattagtagagacggggtttcgccatgttagccaggctggtctcaaactcctgacctcaagtgatccacctgcctcggcctcccaaagtgctgggattacagacgtgagcaactgcgcccagactgatgacaatctaatgcaaggcatgataaatgtcagaagtgccacctaatgaaagcaccctggagggccaagtggtttcagctggtcagctaagctgccatgccatcgtgctctcagtttaccctgtaggggatggtgcaggagctcaggcagtttcttccctgtaacaccgattttgctagaacaacaagataagaaaactgttccattttgattgttccaaaagaaacaaccttttaatgtcttctctagaacatttcatgtccacctttgagctatcctggtattgtctaaacagcttcagaatgaatgccgcctccctggaggaccacagctgggtattgtgacatcttgtaagcaactggaaaatccatctccaaacctataccttctgagatgccttttcttttgacttctcaggaggcagtggtagagaaaaatcactgttacctatatttttaaaaagacttgtataacaccacattgtgctaccagtttgggggagggggtgatgaagctagagagagaaggcttcttatttccaaacttagaggctagaggagggggaagtatgccatacagcaagcacccccaccttttttttttttttttaacttgagaggtttttcaagagtgccatgaaatcaaatagtgatagacatgcaacttcaaagaggcaaggagtggccatcattactttaaaccagtctgcatgtcattcatatgtggtgtgcatctctcccaacccctgttctcttcctctcttcctccagccacactccaggtaacggtggcactgggaggggacttagaactgaagttttcctctcaccccaccttggtgtgcccactgtactccacaaccctaccggttgcaacctagggcttgcttgctctttttcttgtactaggaaaattgcagcagcttttcctctgcaccaaggagggaccttgtcaagctgcaggtgtggaattaaaactccagatgttttcagagggtttcctcgcccggggtgcgttctggtgggagtgggttgctcaggggaatctgctgagtgcctcatttctggccattcagtcccccacaccctctgggggcactgcactgtgctctaggggatacagacacgatacatgttaggatgatagacgtaactgctgcccatgtagcgaggctttgccattgctttcattctttccctacattcggtgaatgccaggggaagcaacaggctccacttttgtggatgcagggtgtgcacgtgtcagagggtgtgaggagctgggaggagaggatttctaagtggccagttcatgctcttaagttattcatcaaaccgagcacactgcggtcagtcggctgtggtggggaaggaggttaggtgaagacctttgtgtctgagacccagaccgtgatccccgtctccattttccacaatgcaatgattattttgtattgagcgcctactatgtgccaggccttttacatacatgactttaccactgagccctcacaaccgcccagagagcctgctctttgcagatgtgactggcttggtggcaattcaaccccaggctgcgggcctagtggcctttccctgccatggcgcaatcttggaagcggcaactgcggggagggcgaggagcggtgcagtttccgccgcgcccgcccgcaaggaaggcagccggggggagccgagggctcgagccgcggggggagcaacagctgtcgatgtcgcgcctggggaccgcgcctccgctgggccgacccggcgccggggacgagaggaggggcggcgaggggcggggcgcgcggggcgggacggaggaggggcggtggcaccggcggctcgggctcggcgcgccgaggaagtcccgctccgagagctgcgagcgtctggaggaggcgcgctcggcgcagtcggggagcgaagtccggagcaaggggcccccgcgtagccgccgccccctcctgctaccgtccagccagggagcccgcggcggccgccgatggagttcacttgagctgtgaaccggcgggagaggcaggcgcccgcaagccgagcgcgggccggagcccagccagccccgggcgctcacccgccagcccgcaagctccggccagaggcgccgccgccccgcgccccgccgttgcagcgcctcctgggccgcgcgccggcgagatccgcacaaaatccagactcccggagcggctccctccagcaccgcggcgggcccaggaccaggcagcccgcggcgcggctggagaggcgggaccggctgtcggggagccccgggcggccgccggggagaagccgccgcgcgccctcctcctcctcctccctctccctcctccctccctccgcacatggtctcctttgtcctgtcgccgccgccgccgcctcgctcttagctccgcgcgccgcggcggcggctcaggccgctcttctccgcctcgccctcccgccggccggcccgggacgcgccttgttagcccccgccgcgccagcgcggccccgcgcgccgcaggagcggcggggagacagtggcgagcgcgggccgggcgatctcggcgggcgcgctcctcccgccgcccggggcctcggccgcgctggatgtgtgcgcgcggcgccggctctcggtcgccccgaagctgttgcccggttcggatctggttcggcgcctccgctctcggactttggcgaggaaggagcccagagactcttgtggacagagccgggtcgagagttgggcgttttctcttcgtgtgttttggtggtttcccccctggtctttgacgatcgcccttcgggagccctgctaaagaaccaaaccatgaacttggggctgaccggaccgtttaaccctttgcaaccaggtaatgaagcccccggggcgcggctcgcttgcctacctctcgcggtcggaagggaggcggccggatcgggggtcttttgttgcggcggccgggccggcgggcaggggtggcaggggcgggcttctcccgtctggcgcgcccaagcgccccttcgctacccctcctcccttctttcctcccccctctgcggccctgtcgcccgcctttgtactttcctccctcggccggccgggctcggccggagctgcgcggtcgtgcccgggagggcctggcgttcgccgccaagctccgatgtgaggagggggccggggcctgcgtccgcttgagctgggggccctagcgtggcgctgcccgctcctggggtcgcgcttccccagcgcggaggtcgggatcccggcccgcacccggtgccaagggaggcgaaaggagatctgggctcgggttcggcagcgggagaaagaactcgcgcttaagtttccaggaggtttctgttttgttgttcgaaagccccccttctcgcctgtgcgggtgcggagggcggcccccggggtctgcgtccgaagggagtgagggtgggcctgaagcaggaatcgctgggtcccaccccgtctgcacgcacggctttttataagttttccttattctccgcgttcccgcctccaatctgtttcacttacttaactttcctttaaacgccaactacggcttctagcaatattttttttacatccaaaaaaacaaaaaaacatattcccccttcccttaaataaaaagcagccaaaagagagctttggttttctgtcagttttagattcaaccacttcatgcccctaccctccaaaaccgagcgaggggatgaaaggaagtgagtaaaatcttcaagtctgtagcgggtagaggtgcccccgtgttcgagagaaggaagagctcaattcgtcggctcattctgggctcgccgcttttccatttgaataataattttttttaaaaagccaggaaaatggtccaggtaatagaaggaaatgcagactattttctgaaagcaacgaaaatgataaacatccccaagattcagacccaaggaacaaatcatttgtacaaatgccctaaaaccctaagtagaaggaaagttcgttgaggaaaagcaaagggtactcgtgtcgtttcccctgaagattttggcaaagaatctctcttctgacttgttaggacagtggccggccacagttgtaaccacctggataggagagagaagggatccagaatgttttcacggtcagccagagccccattgcagtcgtcatcttttgggtgtttttctggggaggcctttctgagacaccccctttcccagttgcaagaggcatggtgtccagccctgtgacttgtatcagccaagtaagggcttagaaagcttttagtcgaagatacactcctaagcctctctgaatatccggtcagacttacttccttaataacttactgatcggcatcataataatggcatcctcaagtttggttcagacatgaggatcacgtaagtgtctgtctgagaatcccatgtggagctgacaaaggtggcagaagcaaaaggcctgttcacccacagcttctgtccttttcactcgaacacacacacacacacacacactaagtgcaaataaaaacttggtcaggaaccatttactttccctgtttatgctttttgcattcagagacagtaatttgtttttacatttcttggggccaattagagtcactttaataggtaatcccagaattttcaaaggttatgtcagtttggtaaaacactttaataaacaggcttttttttccccttctatcagttcattaattttgtaagccatgaatttaacatgaatttacattcaaaaagaattccaacccgttctaagaaacactttttcatgaaaggatggtaaaatacacatatctcgagtttttagctgggaaactcacagtcctagaaatctcacttaatatttcagtgtagcatcatcatgcaatttttggctttataactcactattcttgatctaggtatgacttgtttctctcccattaacatttttttttggcagtttgtttttatgtaaaggtactgttatatatagtttaagatgtcaggaaggccctctgtatttttcattattcctgcaaaataggaaaaaatctatctagggtttatgttaaactgcatgtataaatgtatgcacttcaatgttcgttttgcacatacattcattgtttctggattggttaatcatatggacacccccataaaagtaatgttagaattaaaataaagcaaaaaacagtcttaatacaaatattttgtctttctatatcacttgcattgagaactagaacatgtcccccagatgtacacaggaatatttcatctttgtcagtattacatggaaagactaaattgaatatcctctttgtccctaaaagctagccccagagtcaaaatatgctgcacttcagaattccccccccccatttcctatatttcctttttccatatttattcaacattctaggcttttgctttctcagaatatgcatctctgtgtatcaagtgtgaaagatgagtgatttctcatgagggttatgtagtgaaaacagcacaaatatagcttggccattataactttaaatgcagatatatcctcacgttatgtagtggagatgcttaatttttattttttcaagttctagaaatattcagtgctgaaacattacagcattttccttcaaaccgacttccatgtttattttccagaacattagtgtataatttaaattggctttagttttactgtttaaacaggcttatttcaccttcctcaagccactgtaataattagcagacatgttctctagaaaatggaaaggaaataatgctggtggcatgcatagtggtcggattttggggcaggccggcttgcatctttttgaacaccaaggtcgtttggttactgcaagggacagggatcttggagtcatcagatgaatcttaaaaaaaaattaatttctggcagtgttggcttacactttttagtgaggaaaagcttagcattaaataataggcatttctgatttgtgaaagaaaattgaaaaattggcatgtctgcaaataccacgaaaaacataacatttccaaaataatgatctgtcaacgaaattgcaaaatcattatgtgaatgagctgaattgctttgtgtatcatctcatagaaatatgttttgcacagataatgtgtctaataaggacacatttttaaaatcagatttttttccccccagcaaatagctgcactgcaggtctctctcaagcagtcaactagcaccaccttatggatgatttggggacattgctgcttccctgctaggctttcgtaaaatgtagtcaactgatttaaaataatgggaatgttgatggtgatgacaatattaatgacaataataatgcttttttcccccttcttgtttttcaggcatcagatgccagctctgaaaaactcttcaacactgttattgtaaacaaaggtaagacccattcattctcctgagtaatggcttatttttatgttagtttcattgtcattgcctaggaagaaagaagagctagagtgatctttctcttataattctgaagctactgttgatgtttcatgtttttgcttgagatggaagtctgcatactttgtgatgcattaacattaacaaccagtttattttaaaagaatacattgagtccctatttaaactgatttgactaatcactactactatgtgactttaatatagaaagctgtactcgagaagaatagttctcaaaatgcctgaactttattgttacttatcaactacccagcaataggagaaatataaatagctgatgtgcattgcagactccagtaatcaatggatgtttagaattcacagtattatggtcataaaccaagccttactctgctgtgggctttctgtaaagttaataaacgagcgagagggcagaatttaaatatgcactatcccattaatttcttccaaaccacgatctagagtaagagaggctaatgatatagcagtacattaagggaaaactaaccttaaatcattgccagtaggtttctgcgcagctttcatttgttagcagtatcgttggaaataaggaaatttaggggagtctgtaatcactggctctgaaaggtgtgtaatttgaaagggacaaaccatataaactatttaatcttcccctttccactgtcgagcctgatttaggggctggcatgataattgctaagtaaagatgtgctttctgtgataatctctttctgggttacatgggcgacacttggtagcacttgaacagacttgggccttcacaaagtgaaatttgagaccatttcagccttctgtagttgccttggctagcatttttgctagctggttagtaagacatttccaagtgcagttattttgagctcccagattattttagaatttgaaccaattgcaattttaaatagtacattatgtttagagttcccttgaggtgtatgtgattgccgttactcccagaattactgtcatattgaattttatctttttttattgcataatggagtattccagttttatatttcatcatattttctgatggactgaaagtttgtataaatgtgttatccataatgctaaaagcccaataaaagaagatgtgtgccattcatagcatacagtactcgtgtgtaaaaatgcacaattgtctaccacttggcgtttccttgtgagaaaggagggtgatgggagagggagactggggtagagggcaggtcaccaaaggcagggcttcttcgtttctgcagccccccaggacctctgccacatgtgactgtgtctgtcttctgctgatttgctactgaaagctttggaatgtatttcccctttctgggatcaggccctagaataagagttggctccaagacctgcactctggccgccactgccctgaaagattgtcttcagggcggatgaacagctcgcctctgcctcttccctctggttctttccccccctttttttccttttccaatcaaacgtttcccacattcttatttttgtttacttacagagtgtgatttgtggcatctatttggttgtgaatagccctccccctgacagggtgcctttcttctgagctgcttttctaggggtgatttagttgccttgaaaggattaaggtttctttgtgtacactaaaatcaacataggctttttctaagctttgcttgggaaaccatacacaaataagcattttagttgatggcagattattcctttgccccttatttccatcaaaatggcctttcttttctcctccagagtttccccttaatgccttatgctaattcctgttggtaacatgaatgacaagagacggaatcagtgcgaatccaggtggtgcaaagtagactgactggtatcccgcaccccctttcctccctggggagaaagagattaaggggggtgtggagggggaaagcatcggggacagttttgttaaggggattagtattcaaactgctaaatatcaggaaaacaacttcaaaaagggattcattgtgtagcgataatgtcaataattgcttcaggacaggtgcagagtctccttataggcttgtggttttgggtctgtttttactccgggtagtggcagtgtttacaggatgaatggctgacaaggccttcaaggaactgtcagcttcatgcacatcaagttcaagttttcctgcaaggcggcctgcctgcctgaaagtcaggtctcctatctttgtccagtatctttagccaagagcaataaaaagcatcataagaaagggcaaatttacaccaggtaacaaacacaactggggaaatcttcaaagccccagcttatgggacaatctaaccagagtgcaggggagctgacacgtgtatccctccacctccagatgtttaagttacacatcacttctccctctcaagagactggtagtattctggccttagaggagtgtggctttaagctgctggtgagattatgctgctgagcctggtggcaggcagatttggtccataaaatttcaccgtgggagggcagtgctaatctcacaagctgattgtggtgggggttgggggggcgcagccctgatgttgggctgcacagtgcggagatgaagctcaggcagaggcagcaggggccgtggctcgaggcccatcagtcagcttgtgagcttgaataagtcatttaccctctttaggtcaagattttcaatcataacaaaacctattccagggccaacatctctggtggggataaaacaattaattgggaaggggcaggggttgaaacagagtggatacagtgagtatattttatatcacgtttgttcatcgattttattttgactttccctgtgttatagatgccatccagtttcatagagatttttgtgtttaggtgttccgaatggtcgttttcttctcctgccttttatttcctgctttaaaacaagttaatcaaacagcacatgcttgcatgtacacacaacatgcctaatgaggactgagcatttcgaaaggggtgtggcattgagcagggcttagcgttgtagacacaaaaaaacagtttaactttaatcaaggtcatagttgccatatttaatctttatgtgtttaaatgtttacaggatgttcatgtgaattttatgaatccttctgtctttgtgattcaaccatctgccaaagaaaaaattaattttcccactgagacagaggcacagagagagacttagtaaccctatttagttgattgaaatgctataggagcaacaggacctgtaccccaaattctggggtatttattctataaaggaactttcagtctattcaacatggctagtatttattatcctctcttgcctactgtagatccttgctggtgtcaccagtttggtctgtagacaaaagtgcagaaaatgagttctttgctgcacacaattatcctgccaagataatgaatctttcctaaaactcttggattgctccagagcagagctgcttgaggaggaaagaaaagaagggaagcctgtctgggaggaaggacaacactagtcaggcgtcaggagttctgtggagccctctgtttataggatgccagtcctggcatgtggctgtggtctaggttaggggaagagaaaaatccctgaattgctctcccttcttggttcagagccctccttcccaggatttagcccgtaaccaagacaagtcacagatagacgatgacaagtcaagacaactcatagatagacggtgagaggggcacagtggtgtattttaccccgtgactttctcaccccttctctttccttcaactttgtctcaaattgcagaactgggtactcctggggaaaagcctcctgagtgagccatcggggagctgtgcccagctaaatgggcatttctgaatggtttcctccagcagggaatgaggcccctcattctgcttctttctactgtgggcacccagtgtctcctgaaatgtgaacagcaacagagcagctgctcaccctcgtaggcaggaccccacctcacctccatcagcctgggaggttctagtggatagtcactcaccaagaagagcaccagacgcaacgctctggccacctggagccctctctgaccaggactgcttttcctctcccgggccctaccaggcctattagtggaacacacccggcctcttcttggggttggttttgcactgagaatttccggtggaacacagatgaggttggagcctttaggttagtgaagcctttggatatttttggcagtatggttctatcagcattgtagaaagaagacctagcttaaaaattgcctgaaatctgaggagatgaggtaagaaacaagttacccagcgatactgctggcttagtaaccaggtacctaataaattcttccatggcgaccatatgaccttattctttaggtttagacacaagggatttccttggtttggtgacagaaaggtaagagttatattaccatcaaggtcaccatttgacttttaagaaaaacccattcccgccgagcatggtcactcatgcctgtaatcccagaacttttgggaggctgaggcaggaggattgcttgagctcaggagctcaaaaccagcctgggcaatatagcaagacctcatctctactaaaattccaaaaacctagctggggttggtagcgtgtatttgtagtctcagctacttgggagggtgaggtgagaggatcacttgggcccacaaggtcgaggctgcagtgagccctgattgtgccactatagcctgggcgacagagtgagacaccatttcaaaaaaaaaaaaaaaaaaaaaaggcctttccataaaataattctatgcatgaaaataatgcagttgactgtggaatagctctcttaagaaaaaaatttggtttacagtttaaaatccctttataatgaacatatggagaccattttacaattcctcctagggtcttgggtttagtcgcagggaggacatgatgtaaagtgcatttccgatgtgcacaagagcaaactgcccgtttcagtctctgtaaattagtttggtttttgtcatgccttaaattccacataagggagagttagaacatcactcatttatttttctccctctggaccttctttgtactatttcagagcattttcttgagtttttaggagatagagatgtctggagagttaagtagtatttaagggtaattggtacttgatgcaagagacaaaggagttatgagtagttcagtccctcctcctactccatactgcaaatagcatgcaatcagctccttttgttatggaaattgaccttcctatagaagccgactcttggagaatttgttgtatagaatcatcctttgagcgttcttggaaacagatgccttgtactgttagtgtgaaaccaccagtaacagtcaaaaaatattccatgttgcatgaaagtgtctcccgaaaattttccaatagttgctttggccgaactgatcttttgccgaacttgtgaatgcgtgtggtggtgaatcctgggatactggatcccatcactggaattgtgaaccgggtggaagattccaggcattcgaagtgatcttgatgatgccttttgggtagaacttttgacagctgccacttttccatcctgagtgcccctgtgatggaggaggcgtagattacagtgtaacccattccattcttttagtcagatgttcaaacatcactctggttacttttgagctcagtggaaagcccttgacttatactgggcgattactgctgtcctttgaaagagttttctctatccttggcaatattgaccaaaaagcttgaatgttcatcagcctctcttcaatccattcatatttagcgttttgtgtagttaatgatgtagttagtatttggttgtctcagaaagtaatatgcattcatgatagacaattggaattgaaaaatatcagatcagttctctagagtctaatgagaacagttgagtgacaaagggctcaatcacgcgggccaaccccagacaggagggttcctaaatggaggaagcccgtggctagcccgtggcctctggattatttctagtttctgacaactgcagaaaaatgttgttttctctgaatatgtatgtttatttaactaggtttctttttgcttcacaatctggattccattcagtcagttaccactccaattaactaacaattatttaacattaacagtaattacagacgccagttaagcgcctacagatgtcaactgttagctttgtacctaatcactcaatgaaatggagaaagttcaacaaacatcaattagctaagcaattagtatgagttaggaaagagcatgttatcatgtgtgagctgattcaatttattttattttggcagtaaaatacacacaggcaagcagcaataagttcctcagataagataaaactctattgttttgcggcttatataagaattccttcctttcctgtgcataagtcaaatacactctcgtctggaatttatttaacagaatttgtctcaattactcagaaagcgcagtctcaggaagcacctttggtgaattatgaatccagtgactgtactgtataaggaaatgccagaaaacttcagtggagaaaatgattgattcccactcgagtaatccgctccgtgcatttcggatttttaccagtttattcctgaacctctggtggaacgagtgcaacagtgattttattaatttcatagtgcctgaacttttactcagctgtcttttatttagcccggagctaacatcaaagtattttacctacttgcccagtctgtgcttttaaaaagtagaaacagctgtctattgaagagccatttcatgaattcaccaaggagattccagactctcctgaactcagaggtgctgttccactctcttttttcccccttcgcctcctccaccccacagacttgactcttgtcattagctgagcttgcctggacttactgggagagtgcactctgaggcctgattgtatgaagtggcccagaaagtggagattcattttacctccaagaggaaagctgggcataggagctgggcctctgggtctcctcctacaaatgacttctcatcaacccttaaagcccttggataggagtggaagaagtcaatccctcgtggggtgctctgataggtctgtgtgcatcctatgtgcagaattttccatccgaacaagcctctcagcatgaactgaatgtgggagtagggaaaaagtattctgccactggtatggcttggggtgaagggccaccttgtcccatgtgcagtttctattataaagcatttcctcgtatacaccacgaccccagtacatgctggatcttgacagatgtctgctcttctgcatcaagtcactgggtctctgtgagtctgctttgtcaaattttgctgcagtaacaaaatagctcagagtcctacaacaacaaaagtcttatgttaggtgtcatctgccaatcagccgcaggtttctttgtttttattctgggatccaggccaaaggaggagtccccatcgtggttattcggctggtaaaggggaaaagagcagagacagaaacagagaatgcctccacttggaggtgggtgtggcgtttccaaaaatctcattggccagacaaagtcacatgaccaagcctgccatcaatggagtaggaagtaaactcctacagggaggagcagaagagaagagggatccacagggatccacagggccttggaaggaagggaaagcaaaccctgcatgggtaatgctatctgccacaggcccatcccagaaacctaacaaatcaggagctgttgcctcttactgtgttaatgcaaatgggatggagggtggcttgcatagctttgatgatctccgtaggcttttctgttagagacctggttccctaatagccatttggttggagtttatattaagttagatctgataagttgtcaagaaattaaatgcttttttattgtttatctggattaacttattgctggcttggaaggacttatggaaaagttgccccagagtgcagaaatgacttcagtgatttgcaaagaataattgttggactggccagatgtttagactctgcataattaacctgaggaagcatgattgctgtaaaactttactgcaaagtagtatgcgttgtcatggttaccttgaacatgggctttggatttaagattctcacagacactgctttgaatctcagtgctttgaagacgcttactagctgtggaactttgggctagttaaaacaccttagaaccaatttttccttctgtaaaatgggaataaccaaacccatctcttacaggtgctgtgaggatgaaacgaggcaatggatagaaagtgcttagcctaccttgtaccatattttgatctaatgatacagtgggctaagtattttacatacattctatcccctaatcttcacagcagctcttaatttagaaaagaatttagaaatagcatctgcattttataggcagggaaactgaagttagatatgaatagctagcatttattgaggactttctttttgctaggtattgttcactttatatgtaattcactcattttttaagtgagtaaactgaggctcagaaatgaggcaacttgtccaaggtcgcgcacctagtaagtggtggagctcggtccagctgactcctagacatgctcatagcagtcatactgtgctaggctctggggatatggcagagaatagaaaggaggaggatctctgtccttcctgagggagacacaaagcgggatggtaaaaattcggattgggggaaactgggttctatgggaagacactggcaggaaccctcaacaagggcttccctagggcttttcctcccataccttcccaaagtatttaatcttctcataaaacataaggtcccggaggttctcatccaggacttctccaggatgtcaaccattatcccatcacctgtggccagagtcgccatagttactgcagcgcagtggggctcagcttaaggcacctccagtttcctcgctcttccatgcccattcttgtgcctttgcgtgaactgatctttacttttcagccagattttattagaaatgatttaggaatttcaagcaggggcatttccctagcaaccgatgacataagcacaaggcccaaatctgtgctgttaacagggaatggcgttctgtgggctccgatctgcgtctctgaccctcgtaaaccttgtcttctaaaggaggaggctgagagcacatcattgcttttctaagagtccttttgaagagggaaatgtctcaagtgtgcccgttaatagactgatgtgggaggcagttatatttggatgcctttaaaagccacttggaaaacattttccccctcttatctatcacctttcacatctctcagcagagtaacactaaaacctaattttagccaagattacatcattttctcattctctgttcatagctgggaaaggtttttccatagtaaagctcctctccccgaaaacccagctcctccgcaggacctcttgggcttctgtgaaggcttctttatccataaagtttagtttgacaaggggtcttctgaaagcagattggtcagctgttaaagaaatgacatcagtggtgattccattgattcgttcaattggcttaaggtggaaaccatattgaaatgaattcttttcattcacatattattgagccccaaccatggaacaggatctggaggtaacaacactgaataatagatgacacccacctgaccagaagagtaaaagagtttaaatgtattttgaaatgtttttcaagtggtataatagcaaactcactaattaaaaaaaaaaaaatagccttaagactttcttaggtggaaaagcttatctgaggtgagccccgaagggtcagcagaccaaaaattgaccagccctcaaactgcagaattatgtctcgcatttagagagccccagaatctgccagcttgtgctcatcgttagactaaaacctacccctttgagttttccattttaaaaattgatgctattgttatatgagttaattaagctattgcaaaggtttttggcagtgccataaagatctgtacatcacctatcaatacagtccacttttttcacgtttcttcagttagattttattgtttaaatacttttttttttttttttttgagaccaagtctcacctcattgcccaggctggagtgcagtggcaccatctcggctcactgcaacctctgcctcccaggttcaagcgattctcctgcctcagcctcccgagtagctgggattacaggtgcccgccaccacgcctcgctaattttttgtatttgtagtagaaatggggtttcaccatgttggccaggctggtcttgaactcctgacctcgtgatccgctcacctcggcctcccaaagcactgggattacaggcgtgagccaccgtacccggccttgttgtttaaattcttaccaggttggcccaccgcaaggaggtggcaggagggaagccccatgcccaagcctgagcaagactatttgtaaagttgagcagatcactccatttgacttgcttttctcatgggtatcatgagaaactggggggtggcctccaagactccttgtgaatctaaagaccaaagtttgtgttagaaatattctagggccagccagcacagtggctcacgcctataatcccagcactctgggaggccgaggcgggcggatcacttgaggtcaggagttggagaccagcctggccaacatggcgaaaccccatctctactaaaaatacaaaaatgaggtgggcatggtggcacacgcctgtaatcccaggtgctcgggagactgaggcacgagaatggcttgagcccaggaggtggaggttgcagtgagcggagataggcgctaccacactccagcctaggcaacagagcaagattctgtctggaaaaatatttacatatatcttttagggcctctcagaacctgacgcttctgctgagggcacacattttccctgctagctgtgaaagagattctgaacacttagcattcaaaagcagtagtgcctcgtagccgataccaggacttcagtcctgaacttgtgaacaggaataagcctctctcctcttcaggagattgcatctgtgtaagaaagatcttaaaggtaagaggggattgagccccggcacaagggaggagtggaaaagacagtggctacaatttgaataccagctgttaaggtattacggtattaacctccagaataagagtaacaatacagagtcctccttctctgcttgcctgcatcttgggtgctgttaaaagagatgatttatctgctcagtaaatgtttataaaaccccactgtatatataagtacttagggttcctttgtacttgacttctcaagtggaatgactgtcatttggaccacttcctaggcagggattgctgcaggttagatgagggtggggggcaggggcgagataccagagaaagtgcccaagagcaccccaggggcaactgccaggcagcttctttttctatgagatgactcattttaccaccacgaattgaaatgaggcttgcatgggccattgtagataatcgaaagaatgtcaccaccctcccatctgtcttcagctgtcacagactcacacaccaagcatttcatcagagttctagttcttcaagttcatctaggtctttttgactggagcaatctgacttcctacttttcttttgctagaaggtgataataattgcagcttcattcactcagtgctgcatttgctgtttgttggtttgtaattcgatgcgcagtcttcttgtgtctttgcgggagagttggttttagaggtggcacacaccaaaatcatgaatggatttaaggagggagaggctgaactaatttgattgttaccaagtccataatgtgttccttgggaaaattccacttgtctggactgtgctcctcactttctgagattgagaactggagaaaggaggaacgtcacagacaagacagcaagaagcttaaaaaacaaattcctggatttggagcagtgtgctctggtggaatattagatgataaactacactttgtggttttgttttgtgcagttggctgtagaggccacatggccctgtataatgacctcttcccaagatgttagacatcaaatcagtttgatttctacccccatgggaagaggaactccggttgtaaagaggcagcttgagaataactggtaaagggtgacttgccatttccccgctggtcttgcctcccaggagtaactgttatttgaccacatgacccagttacaacctgttacccctgtgtggccagggcctcacccccccagagcacaccttcgggtcaggctcatgcctgatttgtgccttctttccttctcagggccctccaggttgagggaagacagctttacacctccaccttctgtattagctccaggataaacttgaaaactgcctactctgagggtttttttggcattttaaaagttaagtctgactttccgagccctctcagcatcctgccaggtatcttatcttattcaaatatcctaattgcttctggggctgcacatcatcctagcacctaactgacaaaatagaccttcacctgagggcctcattatgctttctgcctgtgcatcaggccaaaaatacctccacaatacctgctcgacatcctgggcttccaagtgacaaacaaataattgggtgaaacaaaccctgggcgccgagcagctgccatcagtgtcggagcacagaagagtccacggcagtaacagtcacagcgctgcctggttcatgtcagagcaaatctttgaacagtgggttgtgctgacaccagagaatgacagctttggaaatggcatgctagttactgctgcaagtgaggcctctcatgtagaccatgacaagcggctgtcatttccatacaggtgaacaactgacatcctagaagggggagggcgggagccacgcaggaggctgtgtttggcagtaggtggggccagacttcggagaggggtcccaagtaccggtgaccctggcgaaaactagcctaaaaacacagtctctttccatgcccctttactcactccccacacatcttctctgttacctctttggagttcatctgagagagggctacagaaatacaacccaacatgcttaaaggatgtttgcattttcactctgttccctccacatcttttcttctttttctttccttttttttttgagacagggtctcactctgtcgcccaggctggagtgcagtggtgcaatctcggctcgctgcaacctccactttctggctcaagttatcctccagcctcagcctcccaagtaggctaggacttacaggcacaagccaccatgcctggctcacttttttttttttttttttttttttttttttttttgcagagacagggtttcaccacattgcccaggctgggctcgaactcctgagctcaaaatgaaccgcccacctcagcctcccaaagtgctaggattacaggcatgagccaccacgcccagtgtcctccacatcttgatatgtcagggattagctttccggtcgcaatgcttagttttatagaggatggaaaaggcaaggtttctgctgataaggaactcaccatgaaaaggaatgggttagatgaaattaagtgcagaattgggtctagaccggtggttctcaaagtctccatcagcaatatctgcatcctctgagtggttgttagccatgcagaatctctgccccaccccaaacctacagaattggaaactctggggtagagtcacaactctgttttcacaagccttccaggtagttctaatgcagacgactgtggtccagaaaaaacgaggaagaacattttggcagtgaggttttgtaaatgctcagacgatccacagagtcactgggtgaaatcatactctattgcacagggaataggtctaggttcgtagttgggcagccttttttttggaggggacagagtctcaatctgtcggccaggctggagtgcagtgtcacgatctcagctcactgcagcctccatatcctgggctcaggcagttctcctgcttcagcctcctgggttggtttgtttgtttgtaaatatcaacttcacctgatctgttcaaagtgcccctgcacctaccatttccaatccttccactctctatagccttgtgaacaggcctactcatgtttagcgtggttctgacagatgctaggcctgtacctagggctctgctcatctgaatagagtttgaaaccatgaccttgggccaatgttatgctgtaaccagctgagctaacttgctcaaccgcttctgaaagacaaactgttccatcgagttccttcttggcaggtgctgcatcaccaatgccggcctgccatctgtgtgaagggctatcacagcacacaacacacacacatactgggcaaatgtgccgtgattaccactaactattttgtaaacaaagtactgtgttaattctgttttaaactgctttatccaggattgtagaacaatgggcagaagtgttttgaaatctttttttcttctgtattgaatattagagttttaaggccataaaattaacatgtaaattgagttttcccaaaaaatgtaaaactcttaagaagtttaagtaagttacctaaatagtaaagctttttcagttgtccttcaagaataggcatcttccaaaactagttgtgttaaagtagtggttctcaaactttagcctgcatcaaaattagctagaggacttgttaagatacagcttgccggccgggcgtggtggctcacgcctgtaatcccagcactttgggaggccgaggcaggcggatcacgaggtcaggagattgagaccatcctggctaacatggtgaaaccccgtttctactaaaaatacaaagaaattagccgggcgtggtggcgggagccttgtagtcccagctactcaggaggctgaggcaggagaatggcatgaacccgggaggcagagcttgcagtgagcggagatcgcgccattgcactccagcctgggcgacagaacaagactccgtctcaaaaaaaaaaaaaagatacagcttgcggggccccacctccagtgatttctgattcagcgtgtctgggctagggctccagaacttgcatttcaagtaaccaggtgatactgatgtttccagtcccctaagagcactgtgtgatctacatgggttaaatttaaatgcctttttcaatagggaatattttcaacagggaatatcacaccactcaaaggtgtgaaatgtatctttacatgtaagatgaaattgacacatgaaagtgaattcaattttatcatgaatcgggagctttttacaaaatgaaaattttcaactctaattcaatatagaaaatgtagaaatgaacccccatatatacccattacctagattcatattaagacttttccacaattatttttaggtgataggctggatagggcgatgtccaccttttttttctttattgctgaaatattttaaagcatgtctcagacttcatatcattttacgactacatactttagtgcacatctataaaaaagaacatttcttacaaaatcacatgttgttatcacactaactaaatatgcagtaattcctcagtgtcatctgaggaatatacccatccatgatctcatctccatgattgtcccacaaggggtcattttacgtgatctgtgcacatcaggatacaaacagacacacatactgcatgtcttaaatctagagtgctccaccctccccagcttcccattctttcaagtcattgacttgttgcagaaaccaggtcagctgtcctgaagactgccccacattctggaagtccttgcggtgtcatttagcttgttcctctgtccctcgtatttcctgtaaatggaagttggccgtaaagctttgattagattcaggttagagttcctggcaagaaaacttcataggcattgcaacgaacctcatgttgcctcacatctgggaacacacagtgtctgggtgtcccagttttagtgatgtcaaaattattcagtaagtttaggttgtggcaacctgatacttgcattggcatgttccccgtcaagcttttatctcatggtctcatctattgatgatgcttgcctgatgcagtaattcattagagatggcagagggtgacttttctagcattattccacatttattggctgaaattcttcagtacaatggcactttccctcatcaactagagttctttggttacactcaaatataatacaaggaaaaaagtaaatgctcaattctctccttctaattgcatgttttcagagcaaaaagttggtgctctaccaggagtttattaataagtctgaacagttctctgcatttttcttacaataaatctaacctatgctttcagtgcattgagcttttcttacatggtttgtgtttatcaattggagggacaaaatatctaaaaattagaaaggtactgcaagaacaacatcgtcaaatgaggtcatacacacttaagtgtgtgtgaatttagtcatacctgcccttcatagctctgttcaaatgccacattctccaggaagccctcctaccttcccaaggtttgaacctttcctgtggcacttcctgcatcctgcctgtctttttttcttttcttttcttttcttttcttttcttttctttttttttaagatggtgtctcactctgtcacccagcctgtagcagtggcatgatctcagctcactgcaaccttcgcctcctggactctagtgattctcctgccttggcctcccaagtagctgggattacaggcgcatgccaccacacccagctaatttttgtatttttagtagagatgaggtttcaccatgttagccaggctggtctccaacccctgacctcaagccatccacctgccctgtcctcccaaagtgctgggatttacaggcatgagccaccatgcccactgcctgcctgtcttttattgaagttgtagatgtcctcttccccttttctctgaattctacccctatcctacccatggtgacccacagggtgctttgaattaaaatgaattaaaatataatatcctaaaagtgatttcaaactttggaatttaggttatatcctgagaatcttaagtgacttgattcaagaaagtaggcaaaaacctgaatcgtgtttggtctgatcaacccatttggaattaatcgaaaatctgatgatcccaactgggtacttttcaggaaaggagtgggaggctgcccacgtatattgagtgcctacagtgtgccagggcacctgctgatttatttgattcatacagtagcctagccaggtccgtctattacctgtgagaacactggtgactggtaagtgacagtgagttcttgccatctcctgttctttgccctttctcttataccagcccagcataaagaggatcgggggcttcagtttggtgaatttaaaaatgtctcttgttaaaggccgggcacagtggctcatgcctgtaatcccagcactttgggaggctgaggcgggtggatcacgaggtcaggagattgagaccatcctggctaacacagtgaaaccccatctctactaaatatacaaaaaattagccggatgtggtggcaggcgcctgtagtcccagctactcgggaagctgaggcaggagaatggcgtgaacccggccgggaggcagagcttgcagtgagcctagatggcgccactgcactccaacctgggtgacagagcgagactccgtctcaaaaaaaaaaaaaaaaaaaaaaaaaaaaagggaagtctcttgttcacaacacagcttctcatccagcctgacctgtttgaagtatgtctggggtggaagatcctggtgatgcaattccagcctgggaaaacttgaggagaggttcagtatagcaccatgggcggcaggctgtcagtgtgtgttagatgtattcggttacttcgttttatgggagatttcatgtgatactaagacgtaacctcccacaaaatgagatttatagaattgggtatatgtctaatcaataaacatcaaactggaaaaactgtaaaggcatttcaagtgatagtagttatggctggaaatctcagtggagttattttttttttttttttttttattactgtttaagccttgacacttttatttatttagacactgggtctcactctgtcacccagactgtggtgcagtggcacggtcatagcttactgcagccttgaactcctgggctcaagtgatcctcctgccccagccttgcgagtagctaagactatataggtgcatatatacgtgcgtgccaccacacctggctaattttttaattttctatggagacaccgtcttgctatgttgcccaggctagtctggaactcctggcctcaagtgatcctcctatcccagcctccgaagtagctggaactacaggcctgtaccaccatacccggctaactttttaaatatttttgtagagatggggtcttgctgtgttgcacaggctggtctggaactcctggcctcaggcgattaatcctctcacccctgcctcccaaagcatcgagctcctggtgcactttctaactcacccttcgaggatgtgtgtatttatatgtgtcagggagaggaaattgatctcctgaggggtgggtggaagagcacttgtccctagttaatccttttttgcctgttctttaaaaagcgtgatagataggccaacccactatgagttttctggtggcaaaagtacaagaaatccctgctatttatccactatctgtgtagcttcctctttgaagcacctcaagccctcgccagcctcttcttgtccgttgctgatctttggctctgggtgccagtcagcctcaggggcggtgctgccttttttggcagagtatcactgttaagccactttttctctttaaaaaatgctacacagaggtttttgaacctgaaatgcaattattttaaaggcatcctcaccactcacttcccgagtgctctgttacacccagcgccacctgccaaccacagtgaacatccagccatgtcatttcttccattcctgccctggagtaaagtagatttactgagctgatgacttgtgtgcatttgtacattgcaaccttagcttacctcttgaagcatgtagagcattcatcacccaccattcattcactgcctactcccaccacagctgtttcgtggtctgtctgctccctgtgccacccccaccccatcaggtgggccttttgcaagtgatgaagtcacctgtgggggaagagctttcctttcctctcctcaactcagaaggcctcttcctcttgctcaagagggtgctgctgctttctgcctccttccccggccggcctccatcccagttcaccttttcagacatggcccctcagtcaactcttcccttttctcctggctttttatttctcccagtctcttaagagtatccttagctttaaaaacaataacacagaggatgggtgcagtggctcatgcctgtaatcccagcactttggagcctggggcgggcggatcacttgaggtcaggagttggagactagcctggccaacatggcaaaacaccgtctctacaaaaatacaaaatattagccaggtgtggtggcgcacacctttgatcccagctacttaggtggctgaggcacaagaatcacttgaacctgggaagccgtggttgcagtcaactgagattgcaccactgcactccagcctgggcgacagggtaagactccgtctcaaaaacaaacaaacaaacaaacaaaaaaacccaataacacagaaatgcaaacaacagatctagccctgctgcttcttcatatacttcaaacaaagaaaccttttttgatatctttttttcattccccctttgtataaaataccttgcattggtatatctttttggtgataattaaggtgactatataacttactgtccaggcctggacacttttgagagtgaaatcgactgtttcttcatcattatcctgggacaacaggcctcaccctggactgtccatgtaaaccagggcatataatcacccaagtgatcatccaaggtttttcagtttgtcagagtggttcaatccactcgtgatgatactgccatttattgagtacttactatgagatgagctttgttctgatcacttcaattaacccatggaaccctcacagtgcccttttgaggtagatggtattaacactgttttgactgtgaggaaactaaggctgaacaagttgctcaaggttacacacctagttacgtcctccacactcaccccatgctacatcagcccccaaggtcaacatccatatctcccctgagctgttagcagagatttctaaatgtctgctcaattaaaaggagtgtacactgtaaacaagagtatcgccttccaaagtaagcgtttagggttgcctggttgtcaagggctcaataacaggagtgaagtacttaattcttctctcaaatagtatgtggagccggctcggaacaagcagggcttcccctatcactaatattctctaaaacacactccccaccccacccacccccgaaatggagtctcactctgtcgctcaggctggagtgcagtggctctgtctccactcactgcaacctctgctgccctgattcaaacgattctcctgcctcagcctcccgagtaggtgggattacaggctcctgccaccatgcccagctaatttatgtatttttagtagagaccgggtttcaccatattggccaagctggtcgtgaactcctgaccttgtgatccacccgcctcagcctcccaaagtgctgcgattacaggcgtgaaccaccgcacccggccaagacacacatttttaaaacaaagaaatggaaaagtctagactctaagctggttacaccccacacagtgaaattctggttatttgtttctgctgatttttctcatctcacaggtttctcattcccgaaggtaatttaggatgatgttacttaagaactggagttaacttagtgaccagatattaagccatgaatttcttggtcttcctaggaatgggaattttacacaagtacaagcatctcttttgagaacttaggcctctcacagatctctagcctgacgtctcattcgtatctcttttctttcccttgctgttgctgttcttcttcccctactttaaaaagcctttcctgccaaaatctgaatcgttactccacggagtttattatttaggcagatccgaagatcaacacgaagtctttttgttgttgttttcttgtatttttttttttaatgccaccagggtgacaggaagatttactgaaagctgaacttattttgtttgctctaatattcacaagcctcaagagtttaaggaagtggtaagtacacccgctgcctcggggaatactgttagggtatgagcataaagttatccacactcgtctccaaatcgcaggcgtcaatctgtagggattatgcagcgggggaagaaggtggctattacccagaagagagctgcttgagagcttttcagcattcttccccacgggcacagagcatcttctcttcatgttcctacaaagtgttatggagaggaaagtagttggtagggatctttttattgtacatatgttttaacacacacacacacccctttctttcagctctggttccctctaaaaaggtcctgttctcatcctggccaccagacttcttccaccaggggtcccttctctctttctttgtcaccaggccaagtttgttaaccatcttcagaattacaggactttagtagctgaggaattccttttaaagtggttccaaactcagcacctttaggcaacacagcacattgttctgctttgttaagagaagcttgttttgaagagctaggaaaatgagttcaagctcagatttctctgggtagaaagggtatcccatatcagatgatgatgtgaagaagcagattgtgaactgtaaagtgaaaaggtcttaaacacgagagataagcaaaggggtgtgtatttcaggtaacatacaaacacaagggaaacagacctctggcatctcatcgcatctataaatctggatgatttcaggcaaaaatgaaaacatttgcttttcttcaatcttgggaatttctaaaacattgagttttttaataataataataataatagcaccatttgctgagccccaaatatatgtcttctgctctactgggctcctgatatacgttctctctagtgggcccaggacctgcaaggctggtattgttactgctgtatagaggttcaaggagatgacatgccagaggccacacgactgacgtgtgtgacagccagaatttcattcgtgtgtgtgtgtgtgtgtgtgtgtgtgtgtgtgtttccgatggagtctcactcttgttgcccaggctggagtgcaatggcatgatctcagctcactgcaacctttgcctcctgggttcaagctgttctcctgcctcagcctcccgagtagctgggattacaggcacctgccacaatgcccggctgattttttgtacttttagtagagaccggttttcaccatgttggccaggctggtctcaaactcctgacctcaggtgatccacccaccttcttttgtcaatttatccagtgatcaggtatttgagtgcctacctgacattgtctgagagacagtggacactgagatgttgtacatagctttgcttgtagcagttcatgacctgctactgggctagtcagatattgaccctgagtctattggaccgtagctcactttctttttatgttgcaaaattgcaaacctgtagaaatgttgaaagaacagtatgacaaacacccatatacccttcacctagatccactgttcttaacatttttctacatttgctttagctctcttttttttagataagtcatttcaatgttaaaagtatcatgatgcttcagtattcatctgctgcactttctgcataatctcataccattatcatacctccgaaagttagctgtgattctgtaatgttatctaggatataattcatattgaactttccttgcttgtttccaaagtgtgcttttttacaaaatagtgagcttttttttttctttcatttttgaatccaggattcaatgaagaccacacctttttggttgatacgtctctttgacctcttgaaattaaatatagcccccagtcccggccccaaccccttttaaaatctttaaatgacatcagcagtttaaagagcccaggctggttgtcttttaggaagtcctactttgtgaatttcctcatggtggggtttgttacccaattattttttaattaaaaaaaaattccattttcagtctgtgttcacactgctttatgagtccagtttgcttagattttttgtgggggtacttagatgtagctgctttgggaagagggacacgtggaaaatatagagggagatggggaatatttagttcagcattttatatgctataaataattatagctgtatagccaaatgagcttttagagctctggattccattggaatttaaggatttttctcttcccctcttttcttgtagagattagtttgttgccaacaaccctggaactggcgaactgcttaaggcataatgttttcattaagaaaggatttaactaattagatttgactagcaagctgacaggttaatcaataagggaagtggggctcagcaccccttaagttgggagtctccattaagtcattatggtgtctgctaaaacattcttcttcacaatgattcttaagaatttttacgtgaatccctctaataaatgttagaaaatcctgtccctttcaaattccgtaaagatctgtattgtgttcatgtatttcagattcaaactgttgagtattttagggagcctcgcagtgtcagacaggcccttaaatattgtcttatttttacttttgaagacccagtgggcctgttcatcctttgtcatgttacttcagcttttacaaactaacttcactgcagtttattatttaaatttaatttgttcccagataaacctgaatgttgattaaaaccagtaatttggttaagtgtcagaattagaagaaggatgtggaaagtgacgagtcggggataggagtagagaacgtgagcttcttgagtcacctgcaatgggtggtgttttataatgctctcttccctaatcatgttaatcaggagattttccttttggaactcctgactgaaagcttcttagtttacacacatgttcctccaggatgaacgctgaaaataactttttcggttttgtttgtttgtttgttttcctctatacaaccccttgcaattgctttggtttagaacacctttggattctaagtttcatggttgttctgggagacaccacattcaccctctcaacccaagaccttgaagatgggaggtttttcggacctcatcatagacctccaagggcacttggaagctcagagaggccaaactgccccaggaccagtgggctggcaaatggcacacctggatttggcagaaagcccctagagcctgcactcttagccactctgttaaaggagctcttctttttgagtcagacagacagcaggaagcgcccgctgtacagattgtcaagtgcatagtgcttggaggcatttgaaggaagtaaaaggctctatttttttccccagagaaactgttttaatttacctttctgagttgtagagaaaaatactcgcgtagctctgctcttatttatgtattttcaataaaacaaacttgtgtatttgggttttagtttaacaggtcattggcccacatgtaaagctgatttgttaggagtcattacctagaaaataaaattctgaaataaagatcaagtattcctgaaactaacgttttgtttatagacctttgcaagtatacatgtagactttttgagaatttgagaagggtttttgagacagagtctgggtctgtcacccaggctggagtgcagtggtgcgatcaccactcactgcaagctccacctcccggttcaagcagttctcctgcctcagcctcccgagtagctgggattatgggcacctgccaccacacctggctaatttttgtgtttttagtagagatggggttttaccatgttggcaaggctggtctcaaactcctagcctcaggtgatccgcctgcctcggcctctcaaagtgttgggattacaggcgtgagccaccccatttggctgaggacttcttttataaatgaagatgtggctgtgattttgcaggcacatatatacctttaggtgttttcagttactttcatatgtgcttatcagcaatttgattccatatttgatttataaccctgcaggtgtacaaaactaatattataactagattctctgttttatagtaagcttatcaaaaatcaaggcatagtgagaattaaaacatcagtttatttttggaagaatgattttattttcatcctgacttttttttttttttttttttgagacagagtctcgctttgtcgcccaggctggagtgcattggcgtgatcttggctcactgcaagctccacctcctcggttcacaccattctcctgcctcagcctcccgagtagctgtgactacaggcgtctaccaccacgcccggctaatttttttattttttagtacagacagggttttaccgtgttagtcaggatggtctcgatctcctgacctcgtggtccgcttgcctcggcctcccaaagtgctgggattacaggcgtgagccaccgcgcccggcctcatcctgacattctttatgtgtaaggtgctaaggtggtagcatactgctaaaactagattagtagtacttaatctagagggatcttttcaataattccatacattaaacaatttactgtctccattacaaggtgtaccattgacttaatactggttttttggggagggagtgagtttgagaaacactaggacgttaaaaactgctatgttgattgtaggatatctggatttcagaaacgttagcacatgcttgtgcaggggtgggagagggagaacctgtgtcttagaaatgaagaactatggtacatttatgtaggatatgatatcacattttataatttgtctgcttaaacaatgatttacagatcttttgagaaagagagcaaggaggttgggccttttagtaagacagaaaaatgaccttccgtttaagacttagacaaattaaattggactttgaaagtggtttacccttttcctctcgggtaaatgtcggaagtgagtgccctggctgaacataagggaaggtccattgtcagcaccctgaaagcctgtttgaaatgtcatcaacttggagcattcattggcagcgactatcaacagcccattttaaaaggatgccttgggtagaatggaaattacagtggccagccgttaatcctttttaataagggcaactgttgaggagaattatgttgtaagaatgaatgaaatttgggagcaactctagtccccatgttctgtcgtgactgtcaacaccaaatgtactttcatttttgcaactgcctaaggattttccatttaacaaacttacatgacaaatgggaaagcagtggcattccctgagagtccaaaatctggtttggctctgccgttagcacatttgcctgcagggattgatgtatctgattgaagaatgttgagttcagccaagagttaaggttaaggtccttctatttgttttgggtcagttcctacaggtagagaatttgaaagccctgaagtggtttcattgcccctagtagagataaatggccaaatgtaataaaaatagacagtgctgtccttaattgtcctcccctttatataaaggacctgggaggtggatcacctgaggtcaggagtttgagaccagcgtgggtggtgggcgcctgtagtcccagctactcgggaggctgaggcaggggaattgcttgaacctgggacattgaggttgcagtgagcagagatcgtgccactgcactccagcctgggggacagagtgagactccatttcaaaaaaaaaaaaaaaggacctgggagaagggaaggctagagggctagagccagtttgtattttattaggggtcaggatttactatgttaagttttaggatgtgaatctggaattttcttttttttcatgttttaagaagagaatagaaagatgatagaagatatttgacacctgaaatgctacctctcaacacattagaagtttttatatagagacaatggatgtgtttattagaaatctttatttactcataaaggaaatctcccaaggaatattttgctgtcataccatacatatatttgaatgagaaatggcatttcttaaaaaaaaaaaattacctcattgactcatttccaccacatatttgaactaatgaattgctgtatggaaatatactaaacaacttacagacatcctattgtcgtatatgtgatataaatgtcaacatttcctatcaaaatggcatctgatgttggccctcttaaagttctgtggcttaaaatactaacagtaggaggaaaataaacagagaccaaaatgcaaactcaacaatgagtaaaaataccacagtacaagtggaaccttctataattctgtatcccagaatttttgagaagagaagataacatcttaagcattaagaaatcccaagaccctgtccagcttattgctgttggagagccccaagaccctttaatgctccagtttagaggatcatattgtcaagtcagagaggcttaaacacaatagcatcttctggaaccctagtgacctgtattgagagtggatctggcgcttttgttcttttgagaggcaggtgtaaaggataacacacgggattatcttattttaaagcatctaaaagccaatcccatcccccttcctcattctctttcctctcagcttttagagtctttgatcaggtaaattctaaaggcagacgctagtgaagagtaggtaggtaggcttgtgttttcacttctccgtgccagctttctgtcctcaccctcctcgtcagttagcactgatgaatgtgtagaattagtgaaggctgggtattaacatcggtaatgtaactttcagaacctctgcagtgtctaaggggaggaaggttatttccaccccacctcgtgggaattcaaaggtagctttccgattgtgatcaggttaaacaattccctccaggccagcgtgtgggaacctgcacattcctaccaaagcaacggtaattgtacacaagtgtgttttcagatttctgtcatagcaagcaaaagggaccacagccgtgtttgttagagccccaaatgcctgtttgccacagggctgggttttttttgtttgttttgagatggagtttcgctcttgttgcccaggctggagtgcaatggtgcagtcttggttcactgcaacctctacctcctgggttcaagtgattctcctgccacagcctctcaagtagctgggattacaggcatgcatcaccacacccggctaatttttgtacttagtagagatggggtttcaacatgttggccaggctggtctcgaactcctgatctcaggcgatctgcctgcctcagcctcccaaagtgctgggattacaggcatgaaccactgtgccaggccaggctgtttttaaaacttacgtttcagaggttaaaaatttgtcttaagataaaaagactttcttaatcatctaatgtatcccaggatctatgtcttggttttataagacaggctggcagtaaatttcagacctgacctaacaagttaaaatcctactcctgggcagaagtcttctgtgttagtgacaatgtggaaatgaaggaaggcttccatttgtggataagtgtgattggacaaaggccaggatctgcaggtaatacagtggaggaaacttagcaggacctgattgttcagattcttctatgttcccctcctctgggaatagggagggcacctctcaaatgatggttttatggtgtatttcaggggaaggttagaaaatcctttctaaattttatgacctgctttggggaaagaagggtgggaaggtgagagtgacctgctgctactgctgttttctcagatcccaacaggccgtgttttagggtagtatgtcctgaagcacatcgcttatagaaacaaataaaaaaattgtttgctttgtgatgctgtcctgatctgtggatcttaattgctattactctgagattttcttaaagcatataattctttttaaatgctttatgccagccaaagttagaagagaatcctaaacttatccttaaagtgcaggattatcatggtttttgtagtgcagcattatctggttggaaaactaggtcagaaagacccttaccaggttgagttcctccaagcaatttcaaagtccatctggaggccgggcatggtggtggctcatgcctgtaatctcagcattttgggaggccgacacgggtgggtcacctgagatcaggagttcgagaccaacctggccaacatgacgaaaccctgtctctactaaaatataaaaatcagctgggcatggtggcgggcgcctgtagtcccagctacttgggaggctaaggcgggaaaatcacttgaacctgggaggcggaggttgcagtgagccatgattgtgccactgcactccagcctgggagacagagcgagactctgtctcaaaaaaaaaaaaaaaaaaaaaaagttcatctggaggcagcaccgtgcaagttgtgcctttgaccattttcccaattggtgattctaccagtgagagagaaattcacatcttgtatttttgtgtgtgtggcctgagtaagagtgccaaggcagcctgcattcttaactgatccattaactttcttcctccacagatcgtttccttaacaatgctccctgattagaagaaatgtctcctctcctcccagttactcagtgaacagcgctctctcccaaggggccacatgaaagggaaacccaggcaccacctccgggcaggattagcagcctgggaggagccactttctgttctttgtgaaagctagagctgctctgctcttgagaacagccatttacaaaatggggcgaaaacgacggccacaccctccatcactctttttctcctggtgctttccagagcctttggagacctgtgccgggggtggggcttggagctcccgtgccgatggttaaaggtaccatggctgggccagtgcggaccccagtgctgttccccactactcctctgcctctctccacttcccagttccttcctggtcaggagcccggcagccccaaagactggtaatagcctggcctgtaccagatgccctgttacttccccaggggtctcctccttcccacacttcatgatgcccagtttctgttctgttttctttccaggaacgtgtccctacctggaatccccaggggggcttccatgttccattagagaacttcacattcaaccctcgttttctgttttaaccaatcttgccagtaagtggtgagatccttcagggtaggacccaggtcttactcttcagtaaactcctagtttcaggtgttgaaatttggcagtcagtcaggcgttgttgaaatgaccagtaattgtttctgtactgtaggtaataaagctgcggaaattattctcttcctgaaacctgaagacttcagaaatgtgaggaagccaggcctcaagtgccctcctctttcagatgttaggataagaggttgagaagttgttgtaattgaatgaactgtataagcacaatgtcatgaacttctaatttcctcttgctgaagatcatgacactgtttgcccattgtatgtatgtatgtatgtatgtatgtatgtatgtatgtatgtatttagagacggactctggccccatcacccaggctggagtgcaatggcgcaatctcggctcactgcaacctccgcctcccgggttgaagtgattctcttgcctcagcctactgcgtagctgggattacaggcacacgccaccacgcccggctaattttttgtatatttagtagagatggagtttcactctgttggctaggctggtctcaaactcctgacctcatgatccgcctacctcggcctcccaaagtgctgggattacaggtgtgagccactgcacccagcctgtttgcccattattaagcagtaaaaggacaaccagtttttttttttgttttttgtttgtttgtttgttggttttttagttagacttcacagaccatgaaattcactcttttaaggggtacatttcattgacttttagtatgttccaagagttatgcagctatcactacaattaattttaggacattttcattcccccaaaggaaactctgtacccttagcttctgtacccctcatcctcccaatccctcagcccaggcagccactaatctgctttctgtctctggctttgcccgttcctgggcacttcatatacatggtgtcatacaacatgtgatctttcgtgtctggcttctttcacttagcataatgttttcaaagttcatgttgtggaatatatcagcatttcatttttaattgccaaataatattccattgtatggatatgccacgttttgtttattgattcatcagttgacggacattcaagttgcttctatttttttggctactttgaataatgctgccgtgaacattcatgcacaggtttttgtgtggatgtaagttttcatttcaggtatgtacctaagagtggaagtgctgggtcatgtattagctctatggttagccttttgaggaactgccagacggttctccaaagtgactgctcagtttttcattcccaccaacagtgtatgagggttccagtttctccatatacttgtcagcacttgctattgtctgtgtttctgtttatagtcggtgtgaagtaatatttgattgtgggttggatttgcaattccctgaatgactaatgatgttgagcatcttttcatgtgcttatggccatttgtatatcttctttggagaaatgtctaccccacccatttgcccactgttaagtgggctatttgtttttttattgttgagttgtaatagttctttatacattctggatcctcgacctttactcttaaaatgatgtgcaaatattttctcccattttgtgagttttcttttcactttcttgatagtgtcttttgaaggacttctttttaaaataaaactaaagactgatcactcattttatttcaccttttagtgagtattcattccaaatgacggtcaagaagatactatttttttttttttactttttatttgggaataattttaaacttataggaaggttgcaagaataagaatagcacaaagctcatatatcccctttacccagatctttttttttttttttttttttttttttgagacagagtctcgctctgttgcccaggctggagtgcagtggtgcaatctcggctcactgcaagctctgcctcccgggttcatgccattctcctgcctcagcctcctgagtagctggtactacaggtgcccgccaccatgcccggctaattttttatatttttagtagagacggggtttcaccatgttagccaggatggtctcgatctcctgaccttgtgatccacccacctcggcctcccagagtgctgggattacaggcatgagccaccgcgcccagtctcctttacccagatctaactcttaatttgttgctccatttggtttctatttccgtttcttcctccccttcccctccgccatcccccccgcacaaatagacaatttttttctgaaccacttgaaggtaagatatatatcataaccttttatgtctaagtaattcactgagtatttccgaggaataagggtaatgtctttcataaccacagtacagctaccaattgcaataaatttttcactgatgtgatgcctttatctaatcagctcttcagattccaggtgacaaaatgtcctttacggcattacttttcccctccagtataggatcttgtctagtgtcgggtgttgcatctgagtgaaaaaattaatgtctataagggtatttcctaaacatgtgattaataatcatactaaagtgtattatgcattacagctttcaaagtgttttcttgtttctttattattaaatatatttatttttcctcatagcaaatacttagaatagtgcttaggttagcatagtaactaatacttagattggttcgtgcatcagaatttctagcaggtctcatctgacccatctgccctttaggattcctcacatggagaagaggcttccatgtcctgagcacttccctagagaagagggggtgaaggagatagggatggaccagtctacctgttgagaaagagacagagaagtgggtctcagtatccgaggttcctgggttgacctgcagacatcacagggccaggtcctttccttcctagcagtgctatttgtcaagacccctgtctgtctcccctgacagaaacattgcggtggtgggggttgtgggggtgcatccagcatgaattctccttatcgttttgactcttcctgttcccgcctggctctcattgaacccacttaatcttcttcctgatgagttggcccaggcaggcccagctttccctttaacaatttgtcatcttatacatcaccagattccaaactctctcaattctagcaattctgctttaggataagaaaaaagcgtgtattacttttgcaaacaggtgcaaagtaaattggtaatcgtactgaagtacattatgcattgcagttttttaaagcattttcttgtttattgtagttatctggcctcataacacacacttgaggtagatgtggcacatgtgatctccattttgtccacagaggaactgtggtttaggaggtggcccctcaccaaagctcacacctgtcttctctgattttgcatcttatgctatttccacagggctgtgcttcctaatcagtttgttaataaaactcagtattgtgcatttggtaggaattggtttatacaccattcaagaatagtaaacatttacaccctagatttttaatgatctgagacagcaccgaagtatataaaaaagttaggctcctgagcacttaattcttcaaggaaggggatggaggaaaatctctatctgcagagataatagcagcttaagggtatcttaaatgggatgcttctcaggactcttggagacttagagctagtggtgtttaataaccacagtttacatcactcagagtcatggaatagttctattgcataaacagagcattttatggaaacttagaaaccctcactgctgcaggacaaatgctgtacaaaatcgaagatgccaattgtctagattattttcccctaacaattttgtatgaaaaatttcaaacatacagaaaagtgaagatcattgtacagtgaacagctttattcccacctcttccactcccacctgtactctcaccacccccctacccccacatctagattatgcagttgtaacatttttctacgttagttttttgggtttttttgagacggagtctcactctgtcacccaggctagagtacagtggggtggtctcggcacactgcaacctccgcctccagggttcaagtgattctcctgcttcagcctcccaagtagctggaactacaggcgcccgccaccacaccctgataatttttgcatttttagtagagacagggtttcaccatgttgaccaggctggtctcaaactcctgacctcaagtaatcctcctgcttcggcctccaaaagtgctgggattacaggcgtgagccaccacgcctggcctctacattagttttatcacataaatccaggctatttttgatatactttgttaataaaatcattaagcatctttgatgttttggatggaaggcaccctacagtctcttggtggctgagtttccttttatttttcagaatccctttgaaccccggcaacatgggacagagctgagagcaagggccttgattctcatactcaagcctcccgacagcccgctgcatgcgccaggcttcacgttgtactcgtttgtccagataccatgaaaaccctggtcgggtgtggtggctcacgcctgtaatcccagcactttgggaggccgaggcgggcggatcacgaggtcaggagatcaagaccatcctggctaacacagtgaaaccccgtctctagtaaaaatacaaaaaaattagctgggcatggtggccggtgcctgtagtcccagctactcggggggctgaggcaggagaatggcatgaacctgggaagtggagcttgcagtgagccaagatcgcgccactgcactccagcctgggagacagagtgagagtctatctcaaaaaaaaaagaaaaaagaagaaaaccttgataaatattagtatggggatacattgtcccctcccccctttttctctcagttaaaaatctgtcccagaatgaggtttggcgggacatatggtttggcgtgcttgtgggggctggcagggtgaggtatgtatggtagtgtagttatctggcatcttatctgctcactggaaatgttgggcactgaatagattagtcagagtttccagaaatagaaaataaagccatataataaatgcagaagtcccctagttaatgtcagctgttgtgtgatatctgccctaagtcattttattgcctttgtaagattcttaaactgtttatcattatccctgccttttttaaaaatggaagcaacatcttcctaaagaggttgttatgagacattagaaggcctgctttcatgcctaatagttatcaaaactgaaattcagtatagcagtgttgaaggtgaaagaaggtttgggtacttttaggtagcaagagagataattataagctttcaacccaaggtcaagataaatataaatctggaggaggaaaaaaaaaaaagaagtctagcttctcattagtaggacagcgttctcattttataagaccttaatacccaataggaaatggccgtcaattctgttcatttcatattctcacagcctgtctctcaggtgggagaacacagctaattcttagggtaagtgtcctcttttagaataaaaccttaccaaaggagagctgaaatgggttgtcccccaaggctgggagatgtgtttggttccctttgcctcacttcgacctttctgaaatcaagaaacaaacaaaatgaaatcgacttgtgaaaggatgtcaaaacgacatggcaaattcagttggtttgttcagaattttcttcctgtatttcctttttgaagttacaacagtcattcaggagcacgtccagaggagaagagctgggagggaggacgggtggcttctagagtcaaggctgggtttgcctaaccctgaccctcacgggggtgatgcggatgttccgaagaatgcattagcctttgactttaaggaccgcgaggagagttttcttccgaatcaagtgaatgcgggtgcatcaccctgtcttcctcattccctgtgtcagggaatgcatcggtagcctaaatgactttccctggaactgaagcatgtgttggctctactgtggtgctttaatgtttcctgaaatcctccatttggaggatagagtgcccaggagtgagagaatactgtgttattagaatgcttgttaagagggaaaaagaaaatagagcattaacagacaggcaatgttccattcccccgaggaagatttatgtgacctagatgaacggaactacaaatcttggagggacaagagacttcagaaatggcaagttcttagtttgggaggctaggtattgaagtttatccaaattaatttggaagtttagatcagttgcaatcaaaatccttatttgattgacagtggggatggataaaatggagtttggatttgaaaatctacataggaggaggaagtaatagtatatctattttattatacgtgtgtgtgtgtataactataacaattagaatatcataacactgttaatagaccataaagtgacaaactaccccaaaacaaatcccattttcacataaaaatttaatatatgataaaaaagccttcacaaatcaaaggggaatgaaaggcaagattattcatcagatagttaggtcttcatcttacaccggaataaattcaattgaactgaagagttaaatatgtattacaaaaaaaaaagccagcagaaaaatcaatagatcatatcaatcactcctctagaaatggacattatgaaaagtagatgtcagtatggaaaaatacttttactaccaagtgatataaaatgtggattgaagaaaaaaggtgaaatgactggcatgctttattgccagttggtttagggggtcaggtgtagatatttttgttacttgttttccaagatctgtgatgtggttggagtaattcaagagaaatgtatttataatatgcatgctttaaggtacgtctattcctacttttaaaagtggcagatttgtgttttttaatgcataaattagttgaatgttcatccatccaaagagggatttcttctgatagattggggtgattagctgaaagactcagttcctggagaagagaacactagtggaaaatgcccaactgttaggggaatgaggaacaacagtgctgttcactgcattcctaacgccggcttatcagagttttgttttctgtttcatacacttaggaaagtattgttgccacaaagtgcatctctgcctgttagaaggatccagacatagcgtagacggattgtgcaatggagtcagaaataggctgtcctgctcccagtgagtgacttccccaccccttcatcctccttgtaaatcaccggcattcctgatcactttccgtggttccagctaggttaacaacagaagggatcatttccctcataacagtctccccattagtcaaaagttttactctcaagtgactaaaacgttactcataactgcttacaaggagaaaagatttattttccttttacttctttaatgcacatctggtggagaccctgataagcagtaagaaatggaaaaagcagggacctagaaagtgaaagtagacagatttgggtagtgcatgcaggctaattaatgatcccaggtgggctggagtgttctggttacattttccatgggtccagccctagagcagagaccatgggcatcagcctgccccttcccattatgtggctcaagcaccaccgtgtgccaaagggcgggaacattagatttccccaccgctgtaacatctgtaaattccacagtccatagaatcaaaatggaagagaacctcacgtttctgattgccagtcagaaggaatttatttttgaaacccagtttgctctgttatttgtagtgcaagatagaaatatcttaaccgattttatccagttcttatttaatgtctgtgattttaggaggaagagactattgtgtcataggtatttgaaattcacaagcccctctccaacctaattttaccgaaatgtgttggtttcccctttccttaaactcacggaccacagttactaaatagtttccagagtggactgacatgcatttttctttacagctctgtcattactttctttattatcagagagtacacaggatattgaaataacctaaaatccagagaggaggaggagccaggggggtgaagagaagtcctgacctattttagagcccttgggcttcataggtaaccttgaaaatggaaacacatcattgcccattttattgaggttgtgattagcagtaaaatataatgcagactaattattatgttgcagccaattagcaataaagagaagcattttaatatacaaataattagattttaaaattttggctttgggaatttacaaagccctctatttgaaggcttgtacggaagacattctgaaaccaactttttgtcagataaagtccataaagctgaaaactgacatgaggaggtatggccgggttttcctgcgtctcacagtgcagttaggaggctttgatacttcatgggcccttctgcaaactttccttagtattaggaaatgaagtcttccaagtcagtcaagttgtaaacatgcaaaaatgctgggagtggcagtctctccaaacaaatgacccgttctcactgcggttttctcctggtgctagaacctgtaactcctgagttgattctctccaattggccagagaaatgggcgttgctgctggagcagatgaaaaggctattaaggcttcctgaagcacttagattaactagcttttttttttctcttggagcaaaaagttggaacaagttttttgttttttttttttttactttttggacatatgacaaatgtgtataaagttgtgtgttgtgcctgaggagctggtgaatggagttgctcttttgagagttgcttttatatcattgctagctgtgaggtacgtggtgggcatgaagagaaccagtgtcagtccctctgcagaagcagaggctgtgagctccactgtgagctgccaaggcccatactgctgggggatctttaatgcatggcgcaaggctcctgtgccccaatcccggaggagcggtgacagtccagggaagagaggggaccacgtgagtgttacatgttcttgatcacatttttctctattggaaaggaggatgttgaaagttaatcatgtggtttttctagtcacttaagtccttaacacactggatatacatagttcaaatacaaggaaattaacctggtttcaaatgtcttttcctcattttatggcacatggagtatagagcatattcaaaaccctcccatcccccactttgtagacaacacatctactcagaaggttttaacttaactttctgtattctggtgatgtccacgaggttttgaggccttttttttttttttttttttttttttttttttttgagagagagacagggtcttgctctgttgcccaggctggagcacggtgttgctgtcatagctcacttgcagcctctacctctagggttcaaacaatcctcctgcttcagcctcctggttaggtgggaccataggtgtgcaccactatgcctggctaatgttttttatgttttgaagagacagggtctcaccatgttgcccaggctggtcttgaactcctgggctcaagcaatcctcctgcctcggtctcccgagtagcttggactacagtgctcaataccacaccccactaatgttgcctttttttccttttttttttttttttgtagagatgagatcatattatgttgcccaggcccctctcaaactcctggcctcaagcgatcttcccaccttggcctcccaaaatgctgatattacaggcatgagccactgtgcccagtcacattttttatctgttaaaaaaaaacaaaaaccaagtttggatgttatgatgttagtagtgtgtctggttctgaagttacaggataggagatagagaaaaattgtgacctgcccaaagtctcaaagctaattctaaataactaaagttgtagaatcttttgtttggaggaccatcttaaaggtgtgatctgtactcagccatttgtctgatgtgtaaatcctcagtctgtagcttcccggccacgtggtcaccaaggctgtgcttgaacatccctgagacgcctttcaaggagcaccgttctgtctttgggcagctctaattgttaaaaaaaaaaaaaaaaaaaaaagtcttccttacgttaggctgaagtctgttccccatgtagttgttccccttggggccatgtaatacaagtctacttcctcttacaaaagacagcccttcaaatgttggacaacagcagtattcccggccctcctggctcccctcccctcatccactaccaaggaagcatggctgtgagtttgttcatcatcctttgaatgtgctccaactcatgcacagcccctttaaaaggaggtgtgcagaacctgattctcccagtggagcttaatcagtacctgtcatccccattttcccagtgacagatttttattgagacagccaacacttggattggtgttgcctttgacgaatttcaggttactgcaaagtgaatccaaataccaactattttcaaataaaagaaaggagaggcaagacttagcagcagcaggctttttacagtccttcaggtttcaattgtgggaccttacacgtggtgctattgcagctccaattttgtttttttcttttaacccatcatttcagcttgttaaactttggagattcatattctgtcattgagagttgtccttccttcctttgctgcttcagaggacttagtgatgcctttattagagcttttactacattgcattatggctctttatgtctttcctcctgagttctgctaggatcataatcatgtctcatcatattcctcttctctcttcaacactgacagctcatagtaagtgcttaatacattttcattgaatgaatgagtcaaaagtatttgctcttccaaattctgcttattgatagtttattaataattatatattattcatgctgtttcaatatttatcgtacttatttgaatatatacatttatatttatataaagtaataaatgtgggtattttattaataaataagttacttattaagtacattgaagaggacaatggctagatgctgttttgcagcccactagaaactttcccctgggccaggcgcagtggctcatgcctataatcccagcacttagggaggccaaggcagacggatcacttgcggtcaggagtttgagacccgcctgggcaacatggtaaaaccccatctctactaaaaatacaaaaattagccgggcatggtggcatgtaccagtaattccagctacttgggagggtgaggcaagagaattgcttgaacctaggaggtggaagttgcagtgagctgagatcgcaccaccacactccagcctgggtgacagagcgagaccctgtctcaaaaattaaaaaaaataaaaaaaaaaaagaaacttttccctgggatgactgttgatctgttctttgacattctttttaagataaggtttattttatcaggaatttccctaattttatagtcagttctgttacaacgctacatacagtttccttaaaatcaccatgctgttcacagtggtacaaatgaagccataagacttatgggagaaatgggattagggaccaaaaatttatcactgacagaaaaaaaaaaaacaggaacccagtaaaaacagtaacttagttttacacatgctaaatggttaagaaataaataggccgggcgcggtggcttacgcctgtaattccagcactttgggaggctgaggcaggcggatcatctgaggtcaggagtttgagaccagcttgaccaacatggagaaaccccatctctactaaaaatacaaaattatccgggcgtggtggcacatgcctgtaatcccagctacttaggagactgaggcaggagaattgcttgaacccgggaggcggaggttgaggtgagccaagatcgtgtcattgcactccagcctgagcaacaagagtgaaactctatctcaaaaaaaaaaaagaaagaaaaaaaaaagaaatgctacaataaatatggcatctaccttgtaaaaagcctgaagtttgctcatgggagctgacatgaggagggttggagccggtggttatagtggcgtggtggaaggaggattatctgaacttggaaagaaggttgtaacagcagatctgaatgtgctacactcgtagcacacacagtcagctgaggaaggcaagggatgcttgaggctgtatggttaatgtattcctgtgggctccagaatgcggctcagttttctccattcaccttgtactttttgcagacaaaattgcacctaagcaaacgttacattcacattagaataaactcacatttcaaagcaagtgtcgcagcagctcctgtttctttgttgtgttatttgcttgatcagtaaagcatcttttttgttcttatagtaattccaggcactggtatataaggatacataaattatactacccactcactctctaaaactcttgttcttaaagattggcttatttttgctaggaggaatgaaagtacatgttaaagagacatacttggctgatctagccattttccaaagtctccccccgccagaggaatatctcataagtctggttcctaattacatttagcagatttctctaaaatctaaaagctggagtttgaatggttcttacttttcagctagtatctaaaaggtgattcacttaggagcagcatagaggagaaacttgtatttcacctatcaagtttctgatttaaaagtgaaatttcagccaggcacggtggcacacacctgtaatctcagcactttgggaggcgaaggtgagtggatcacctgaggtcaggagttcaagaccagcctgaccaacatggagaaaccccatctctactaaaaatacaaaattagcctggcgtggtggcgcgtgcctgtaatcccagctactcaggagggtgaggcaggagaatagcttgaacccgggaggcagaggttgcagtgagccgagatcgcgcccttgcactccagcctgggcaacaggagcgaaactccatctcaaaaagtggaatttcacctcatatcatttacatgtgtgtgatttgatgatggctttaactgaaaatagactaatgccaatagaatcggagactcttagaactggaaaggaccacagatatcaggaagcccaaacttctctctttttcagatgaagaaaccaaggctctgcgaagtggagtgttacatgcacagtcacttagctagtggtaaagccagaacttgaatccagttaattttgaaactataatatgttgccttgcaaaattgtatcatagaaggacataaaatctgtgcatttaggaggaaatctaaactcatattatttcagctttttagtctgtttagtaagggagtttcaccaattcagttactactgataataagcttccccttgttttatttttgtttctttaagaaatctgggccggacactgtggcacacacctgtaatcccagcactttgggaggctgaggtgggcggatcacatgaggccaggagttcaagaccaacatggccaacacgatgaaaccccatctctaccaagaaatacaaaaattagccgggcgtggtgacacgcacctgtagtccaaactacttgggaggctgaggcaggagaaccacttgaacttgggaggcagaggttgcagtgagccgagattgcgccactgtactccagcctggctgacagagggagactctgtctcaaaaaaaaaaaaaaaaaaaaaaaaactagtatgacacaaactcaccaaagtggctattcctcagactctgtgctttataaattcacgtttgttagggcagacagaaaattctgtttctttgtacccaaaaagatttaagcatttgtcgtgcattgatctggggttttgagggggaaacatccttggttatgtctgtgggatttgtggtgccttctggaggattaagatgtcattgcctctagtcagggcatgctctcttttccagttggtgggtcttattttgtttacatctgcttcctcccagcactgacagatttgaaatgtgtgcctgaagtgcacctttgtgccaggcccatagttttgactggggccctcatgacccattggccatggtcactttgcctgggagcaatcatcatttctagggtataggaacttgaagcaaagaatttgctgcattttcaaaaagcaggaaggggtggttaaagtgtggatggaggggtaatctccccccacccccgccccagcccctgttttgtaagagaggctatccaactcatgtatttccagccccgagtgttggcaaaaacattttcatattgttctcacttttctgactgagtccaaaaagttcctgggaaacaggttttgtttttcctcgggggatgtttggatttgaaaacaccaaatttcaactgcaatcgtttgtccaagtgtggtgttgaaagtactgtctagatctgagtaaatcagaatctgaagaaatatagccaacgtcactcattaacaatgggttttccaagggtgagtgacatgaggccatttgtctgcggtgaggtagatgcgctcctcttttcagtggccccctgaggccaccaatgtcacgggcaagcacatcctcggtttggggccattagctgaatgccctctgtttcatcttgccttttctaggccgccctctcctgtctttaaggtcagggtttcagaatgtccttcagttctgctttagtcaggactaaaagccttccacagtgccttgacgaggaggacatataaggaagaggcacaattcaagtaaagtcagtctgtattgattttgtgaacccggggaacagtaagccagccttcagtgccgcctggctgccgggcgcatgccgttgtcagaccgatgagcgaggctccatgcagacaggtgacatattcgaggtggcaagagcagcaagagcttctagatcctgtcattttgcttctgacagtgtctttgtgtctttgtacagttggaggacctgactgacacgtgagccccccttggcagccatcatcttcagaatactgctttcctcccacgggaggagcttgtacctctctcatgtgtacagggtgcttatgtgctcatgagcaggcaaaggagcaggggacggtttcttccagatcacccttccaggtgctctggagttgatgtggcctggccaccttttcatcatcgcccctccagttccattgcagtgatgcattgcaggctctcctcaggaaaatggtgatttcagtattatattaataattagcaatttttttttttgcagttttaaaaaattgactcttaccctctgcatttgagaaaagtccttattatacgtttctgtattgtatcatctcccagtttgatgtgtatgtatcccgattgtatttcactatcattacggagatttttattgtgtcaagacaaaaccctgtttctgtctccccagccccatgtactttgagcttagtcattcgggcatcatttcttccagcattcactgctcctcagtgtttcatttccatttaatttttctatttagtttttagcagttctcgttggctaattttaaaaagatttgtactttgatttgcttataatgagtgttttaagttacctgctgactgcgcagttgtttgactttgtatcaggtttccggatttaaagccagtgttctgttgaaaatttaaatactatagaaggctgaaaatatgaatcctctgacagctcctcataacaattcccagggtagcagctgtttatattttcttatttttttctttctatgcacataaaagtgtgtttgtcctcataaagagtgttgactgctatagacggagcgtgcagaccacaggcgtatacctggaggcttctcccacctttgattattaacactgctcgcctttaacattatttgcttttgattgctctttttgttatacaaaaataaccaagctattagaatcttttatgatttaaaatagaacattagttttattgtatattgaaaatagttccttaaacttcataatggcttccaattatttcacacttgcttgcgttatatactattattttattgcagtatgatgtccaattatggaaacaactccagagagacatgatttttctggcttaacatgtaattgtttattgagtatttttctcattatgatttttttccttttgaattgcagttataaaggaacttgcttagattttgtaaattattatgtggttaaagaaatcaacgatttatcaagtgctcactctgtggaaggcatcgtgtgcagaatcgaagtaaaggcaaagattgaaagaaatcattcctcaaaaaagttgtgtgtattaaaatatgaagagcagtaaggttttttgttgttgttgttgttattttgagacagagtctcactctgtcactcaggctggagtgcggtggcacaatctcagctcgctgccacttccgcctcccggttcaagcgattctcctgcctcagcctcctgagtagctgggattacaggtggctgccaccaggctgggctgatttttgtattttcagtagagacggggtttcaccatgttggtcagactgatctcgaactccggacctcaggtgatccgcccacctcggcctcccaaagtgctgggattacaggagtgagccaccacacctggcgtaggattaagttttattgtcattcaaatatgaacatatttaatcttgtataataaaatataatttattctataagaaacataatgtgttgcttgctaataccaaggacattaagtgtagactagaagttcatcagagcagatggctagcaggggctgtgagactggataggggttaaccgtgaggctgaaagatgggattcgaaagtgcacctgtgtgggaaaggggagagcgcaggatcttggcgcactggacggtggctgaaggagagggagaggggggcaggccttgatgaggagttgggagggattctgtctgtgatgagaagccactggagagctttaaaccagcttttgtgaacacggggagtagcagtgttgttataagtagtgattattgtcagcatgatcgatttacattttaagagctcactcagggtgctggcggacagtggattctgtaaccattattttgttttaaatagcgtcacataagcaataatttacccatgaaccaccagttaatattgggggaatgaaaacaatggatgctgtgattctgagcttagatgatggggacaggacagagtgggagtggaagggggtgggtgtgattttcgtcctgttgagctggaggtaatggtaggacagccaggtagacaaggccctcaggcaacaaggccatttaggttaatttgtgtagctgcttcttgaagaagaaacaaatgaaggccgtattaccttctgccttcttttttgaaagcatctctgaagataaagttcaggtgattgcaggaaagtagaagtcattctgacatgcatttccgaagcatcaacttggttgtctgagagcatttcccttccaggattataattgtgagtggtaagcagcactagtgtattggtgacttactccagctgtatccaaggacaggtaaaacttcccactgtctctttctagaggctactttgtagcatttcagatgtgaaaggtgactccagcagagagctcatctatttattatttatttttgagacggagtctcactctgtcgcccaggctagaatgcaatggcgcaatctcagctcactgcggcctccacctcccaggtacaagtgattttgctgcctcagcctcctcagtagctgggattacaggagcccaccaccacacctggctatgttttgttttgtttttgtttttgtttttgtttttgttttgtagtagagatggggtttcgctgtattggccagctggtcttgaactcttgacctcaggtgatccgcccgcctcagcctccccaagtgctgggattacaggcgtgagccactgcgcccagcccagcgagctcatttctttattttattttattttattttatttatttttgtttttgagacagagtctcgctctgtcgcccaggctggagtgcagtggcgcgatctcggctcactgcaagctccgccttctgggttcacgccattgtcctgcctcagcgtccccagtagctgggactataggcacctgccaccacgcccagccaatttttttttttttttttttttagtagagatggggtttcaccatgttagcaaggatggtctcaatctcctgacctcgtgatccgcccgtctcagcctcccaaagtgctaggattacaggcatgagccaccgcgcctggcccagagagctcatttctaacaagctattatcaccatcctcactgctttctaaaccttataggtatgtagcttcaaagtttatatttgaacgtttttcctttattgatgacaaattaaggataatgaaatgaagtaatggcaagcgatgaaataatggcaaaagattttattttcctacaaagtatttattacatggatgttttatagaaaatcaatgtaaaggttgatagacttgtcctttaaaaaagatacatttcttcaaatatagggaacagcagaatgctccctgtcaccccctttgtaaaaacctctttcagctttgcagccatcatggctggggataagtagatttatttcttctgttcctaaagattattatagatgaaaatcatttggtgtggagattcttcatttacagctacgtaggatgtagcacttatcaaaatttctgcaaatcaaggagaatagtgttcatgaacctaccagtgagatattttaaaagaccgcgttctggaaaagtgaaggaggataaagaagcagtgttcttctgagggtgctaccaacatttgggactctcagaggccctgtagcccagtccccattccactccatgggtaacacctcatggttctttcatgggtgttcagcattctcttgaatgcttcccctaaaggcagtttgttctcctgtgaggcagcctagtccatttcacttgaaaattttcttctgcaatatgcattgtttggtcctggttctgtccatgatgccatttccaatcaatctgcttcctcttcagtgtgagaagcatcaggtccttgaaggtgctcacagttgtacttggggcaaggctctggaactcccttttctgcatggtccagtgaatctgcatagagccggactgggaacagtgcctcaaacaggagctccctgttgctggctttcgtgaatatgttgtttttgggggtagctcctaatctggtgaacatcaccactgcctcccaccaccgcatcctgtccaacctacatgtcggtagaggacccaccctaggaaggaatgaaggaaagaatttctaaggttgggtcttgggaagcagagacagagaaggatccgcagccttatggacagcctccctcagcagtggggcttgctgaggctctttaaccctcccagcagtgctgtagaacagctctgtgcaaacttgaatgtgcatggggcagggctgggcggcacggggaggggggtccgcgaatgtaccgtcctaacaagctcctggatgatgctagggttgctgggccgtggaccacactgggaatagtgaggctgtagcatacatcgaagtcatagtgtgagctggtagattgtttgggaccagaaagatcaaaacttacttagaaaaaaatgtcaaagtcctcttttccctgctcctcctcctctaacttaaagaattaagggctgtgtgatagccagaaagctactttcatggattcattttagcagcatctctggtgctcacgcataagctagtcagggagattgcagggggttggcagcacccaggtcccctgggccatagcaggttgtgtgaacagacttgaggagaagttttgtcttctgtcctcaggagtacaaacaggcatgtctgaatgctgacagagaagtcatcgccaaaggatagtagatattacccaaggcaaagcctgcttctcagtgaactgttgcctatgggacaagaatgatactgggaaaacagtgattgcttttaggatatttgataaagctctaaaggaatagaagagcttccacctacactacactccaagtgacagctgtgtgaacttggtggaaaacttgactgaggtcgctgagactgctggtggaaattaatcaccctcctgctctgcagtgatattggcaaaagatgagcttagggccagagtggtccacatgcctgggtgtctgtggtccctcccctgcagaacagaatgaaacagtcactgccataagatatcacagacacttctttctactagggtaacttggagcctttctttggctacctggaccctgatgagagggtaatctggaggaataggaagtgggcacagggatagtgcatggtacaggtgactcgggtgcggagagtatgtgtgtgtagggccagagctaagaaaaagcctaggataaactcgacagatggaaagtcttttttttttttaaacagggtctcactctgttttccatgctggagtgcagtggcattgattacagctcactgcagcctctacctcccaggctcaggtgttcctcccacctcagcctccacctcccaggctcaggtgttcctcccacctcaccctccacctcccaggctcaggtgttcctcccacctcagcctcctgagtagctgggactacaggcacacgccaccatgcccggataacttttgtatttttttgtagagacagggttttgccatgttgcctaggctggtctcaaactcctgggctcaagtgatccgcccactttggcctcccaaagtgctgggattacaggcgtgagccaccacacccgtccaacagatggaaattcctactttgcctcttggcatgcatacccagcctcttttctaaatgggtctcagtgattgtccaatgtgtgccccaaatcagatgaaatacaatcatcagatgcaaagcaggaaggtggtagatgacggacagtatgtaagtcggtctttgctgctagtggctttacttcatccttgagaaaatcatctttggtaaagtcataagtgttgaaactcgaaactagggtttaccctagacccacccattggccaaccttaatgggcacactgactttttaagagtgtgaaagttattagctaaatgacttgttccatggccccattatatcacagacatgttgatgtctctgttatcaaaagacgtgcaaaacaccccaaaatcgttgatgacattaacaggtaaaatgacaggggcgcgttgcaacacagaatgtgtgcttcagatggtgaccagggctggattagcctcatggttatggcccatttggggtgtggacatcagcttctcggatgaaggtgttagggttagcagagggcagcggtaggaaggaaggtgtcagatctataatgcaccccatctgtgagcctcgcggctttgccttccacacaatatttagtaatgtaaatactggaagcagggctgcctgtatctttattttattcaacttaatgtgaaaagcaggatggttagatactgggaagactatctttttaatttttttacaccaaacatctaaaattattcctattcagtgccttggtctcacccttgggaaaatttccaaaataagctaacattttccccattgtcttcccgcctaaggaatgtgtgctgtggcttttaggtcaatgatagccttgtccttcaatttcatctttactcagagtaggcgtgctgtgtggtgcaaatccatacatgtttgtttgaaaatccttttagaaccttgccttgttaggacctcctacacctgtgtcacagacacagaagtaccgtgtttaagtattgagcatacactagttttttgtgacagaatctcactctgttgccaaggctggagtgcagtgggacgatctcggctcactgcaacctccgcctcctggggtcaagtgattctcctgcctcagcctcctgagtagctgggattgcaggcgcgtgacaccacaccacctaatttttgttttttttttttagtagagacagagtttcaccatgttggccagggtggtcttgaactctggacctcaagtgatccactggccttggcctcccaaagttctgggattacaggtataagctgccacgcctggcctgcatacactggttttaagggtggctgtgcttgggctgtgtatgtgcgtagtacacagtgtcatgtgagcacttagttaacagccaggcaggggtggacaggccaggacagctaagaatcgcggaaggagtctgggggtagcaggaaggctgcactgggaatggaaagcaagcaggagatgatcttatccagaggaagcagctaataaatattgaggctggcaggaggatacaagcaaacaaacaaaaagtggggccgtgtctttaaaagctttctccgaaaccaatatttggagttttcctgtgttcttggaagtgactggagattgcatccttcataccttatttctcctgtcaggtctctacatatcacatcacaggattcagctgatattggcctaagacccttggggtcggtgcagtgggaacgtgttatagatataaatgccttaccgttgataactcagaataagatataggatatcatcattaagtctgattatctaagcttatctgtgagccttacagaaaacaaaaacgaaagatcaggaccacaggttctttgactaccatttccctatttttttcatttgtcctgaacagggcctaacacaaagataggcacatgaggcagggtagtacaaatgagtttttcccccgtatgaagtgacaatcacatggattatatgtgaccttgacattgttgagtttctaaagactttttaaggatgccatacccacccccaatagatcacaacctatttctctcattctaatgttggtcatttgattacatagtcctttgtggctctgtttgcttgagactgcaaaataaacaaaatgtttgcaagtccaggttgaccctaaaagctcttcattctgtaggccaaagccatgattcagagaacctgtggtctccacagtcaagattgtggttgatacaccccccttgaaggcagatgttttggttttaaggcatcaggaatgtgggcatgtgcatcaggattgatgtgttttggtgtggggtttaggagcaataaacttgaaacaagtttaagtacactcaactgcggtgtgttgcttttcctttaatccctagcagattaacccctatcagggttaatctgctcaactagatgatagccaaactagcttctctgataacagcagcctctaatccactggactccacacagctctcccagtgggctgctggtgttttggcagatgcaatggctattttttcctatttaggattttgcttttaataggaaccctgaaggccctcagaggtttgtgatacagacttcagcccacagctcagcctcccagatggtaattaatgtttacacaacatgacaagcacaaaatagaatctcttcgagccctgccaagcacccatcattccccctgatcttccactcttgcagtgtttgaaaattaatttgccttgaacaaacagtgggttttcctcaatttatttgtacagtttcagtgaccaagaagaagagctgcaagactgaatgtcatccttccattcgttcaagtaattgaatcttctaatggaacaaactggtctctgcttaatgatttgaagaaaagagggagaggaggaaaataaagtgaagtgtatgttagagaaagtggacatttttctgcaaaacatcactgaatgtagaattttggagatacaatcaaaacttagcagggggaatttaaagtattgctaaattaactcagtagggcggttggggttttaatacgtatatacaatgtgcagtctttgcttaaaaagagattttgtttgaggcaacagaatagacaggtgaaggtaattaaataatgaacattggccgggcgtggtggctcacgcctgtaatccccgcactttgggaggccgaggcgggtggatcacgaggtcaggagatcgagaccatcctggctaacacggtgaaaccccgtctctattaaaaatacaaaaaaaaaaatcagccaggcgtggtggcgggtgcctgtagtcccagctactggggaggctgaggcaagagaatggcgtgaacccaggaagcggagcttacagtgagccgagatcgcgccgctgcactccagcctgggcgacagagcgagactctgtctcaaaatagaataaaataaaataaaataaaataaaataataatgaacattgattgggcagggtggctcacacctataatcccagcactttgagaggcctaggcgggaggattgcttgagcctacacgttaaagaccagcctgtgcaacatggtgagacctcatttctacaaaatataaacaattaaccagcatggtggcacatgcctcagcctcccagctacttggagactaaggtgggaggatcatttgagtccggggagtcaaggctgcagtctgctgtgattgcaccactgcatcccagcctgggcaacagagtgagactgtgtccaaaaaaataaaataaaatagacattgctaccagcttgaggtaattgcatgttgattcacagaaatttgatatttccatatgtctctgggattgccagtgtttaaacatttcagtcccttattaatgttcgcactttaaagtctgggttaattttcttatttgactgtgatctgtagtctttctgtgtggtgtgctctttgtggctttgtcatttggacagtaacgagagaagctaactggaagatggaataataaaaataggacatgtctctttctaagtcataaggattagatattcaaaaagatacggatgaatggatgatgcatggatggatggatgttctaggagctagtgccccccacatagttttcttgatgcctttggaagcttcttcaggtttgctgcggtaatgaccttgtagttagtaagtcctgttaggagacttcgtaacagaatatgaagatgtgaagaccagaagtgcagaagctgtactttgggagagttggttttttgtgtatttttgtttttgttttgtattcctcctcctccttcatcaatattcaccctttcctttctgtccaaataatacccagttagaaccagttagaaattctgaagaacaggtggaaggtttaatatgcaccatgttctgatgtgtgcctgtagtcccatctcctcaggagactgagtggggaggatcacttcaccatgtgagtttgaggctgcaatgggctatgatcactccagcgtgggcgacagagcaagacccttttaactttttttttttttaaacacatgcaccatatttttaaaaattaaaactatgcaccatacacagagtcaaatatttatctgtcctcttggtgaagagatttttaaaaaatctattcaatagtccaggcatggtggctcacgcctgtaatcccagcactttgggaggccgaggcgggggtggatcacttgaggtcaggagttcgagaccagcctggccaacatggtgaaaccccatctctactaaaaacacaaaaattagctgggcatgatggcaggcccctgtaatcccagctactcggaaggttgtcagaagaatcagttgaacctgggaggtgaggcagaggctgcagtgagccaagattatgccactgcactccaccctgggcgacagagtgagactccatctcaaaaaaaaaattcagtaggtaaggcaatttaaaaagacttgaacgatcactttctcagttggcttattttaatggtagaggtgtattgtccgcgaaaagagttaattttaaaatatagcatctctttttttactttaacaataataatactcttatttactttaataaaaatttaataagtatactttactaattacagtaaataatactattatttaataactatatataattatttgctgtgtttaataacaaagtgaacattgactttaatttttatattgtgcttaactttccaaattttctataatattcatttgttttgcacttttcctcctcctcctcctcaattttgaaagttaaaagcacaatatgagaattaaagtcaatgtttatttctggatgatgggactgcaattaatgtttatctttccagtctcttttctgtgcatacttgtatacatttacacacgtagttttcactattgagatcacactgataatagtgcactttatttaatggcaattttgtcatgagatattttctgtgacattaaatacttcttcacaatagttttgggaatattgattgattacttacttattatgtgttgtgcattgtggaaagcactttacatggcctaatttatttccacaaccaccctaggaggttgttactgcatttgtgcagtaagtcattggacttttagaagtgtaggagttcatcagagtataccgaatctcaaccctaccagacccagcataataataagaaatattttatagcgcattcattttttactttctggaatgaaatagatacttaatgtacccatctacatacataatttaaaagtatatataaagccctaataaaatataaaggagaaataagtggaaaccaagtcatttataataacatacctttaagtatgtaagtgcttgtttatattagaagacaatgtttgactttatatctagaatggtatctaaatacttctactacaaatgcagactcacacaaatacatggtcatggagattcagatacctggagcagccttaccattgtgtcatgattttcccaaatagccatcaacccttgcatatgacccagatataacaaagtacagtccctgcattcctggaaaaatcagcgtatattaaaacccatgcaaagaattactttgtgtttatatacaaaaacagaggtggtgggttctagggttttcagctgcacaaatgtcgggtggaatttaggaagtgcattgagatgttgtcgtgtggggttgctgcgcacgttgcagcaaatcagacatccctaagagccaccagtgacctgcagtcatagtgatagccacacactcccacaaatttccatctcttcccatagggagtagtatcctccaatgggaactatctattacgtgactgacttagttcgcgcttttttgcactgaaaaacactttgaaaaaagcaattttgtgggggaagccatttctgaaggtttacaagccctgtaattttcttgttaggttcattcccaggtgttatggtttttgttattatgaagtggatcctttctaaacttcattttctgactgttgctggtgtatagaaaagctgaggttggttgtggtttttctttatttggatatctcattgcactctcttattagttctaatattttctcagctggttgcctctgttttccagctaggtaattatattttttgtaaacagtttttcctctttcttttgttgtataatatttgctgttggttttcaatttagttgacaggaataatttgtttcttaaaggtttggccaacattgtctgtgaaacagataccttttgggaggggaggtgaaggtttggattattgagtactttttccttttattttgatgatcctgttgggtttttaagtcaattttagcaatttatattttttcataaaatccattttattttcaaatttattacacattcacagattacattttcttatttttttatgcatatatacacacacacacaccccagttccctgtctatccagttctcactcctcccaagcccctaaacaggtagtcactgctgttactgttttcttgagtattcttccatggcttctttttttttttttttttttttttttggaaacagggtcttgctctgtcactcaggcttgagcgtaagtagtgcagtctcagctcactgcaccctccgcccaagtagctgggatcacaggcagacaccaccacacctggctaatttttgtatttttagcagagatggagtttcaccatgttggccaggctggtgttgaacttctgacctgaagtgatccacctgcctcggcctcccaaagtgctaggattacaggcgtgagccgctgcgcccagccacacggcttctttgtacgtaaaataagatgaatatatatattatttccctccattttccacaaaagatagtaaatgctctacgttgtacattcggcattcttttttacagctgcaaggtgttccattgtgtggatctgcaaacatacgtaaccagtctcctaatggttacatttaggtggcttccaaacttggtattcaaaccatggtactatttcattgtgtctgtagactaaatccttaacacaccacaccaagggaactccatttgttattttgctaaacctccacagaggttgtagagtttgcattctactagtaaagtacaaaaaaagggcccattttccccaggcaacttgtatcaaacctatatcaaaatgaaaccaatttttcctaatctcttaaagtttgtttattgaggtacaatttacatgcaataaactcaccctttttaccgtaaagtacgcaatgtaatttgaatttgcatgtattttagtataagcatgatgaactatttttataatcacaagaagagagagttttaaaccccaaaatgtaatgaatacaacatttaaataagactactcaatttgtacattcttatgtctttcaaattcagcaactttcattctttcctttatcctttggcaaattcagagtatgcagtgcaataccaagcgatttcttaaaatgtgttgctgccaattttggagaagtacagtaagacaaattgactgtcaagatggaaaagcttaactgggaagatacatttattgaataattgaaaggaagaggaaatgcattaccgattagccacaaaaatgcctgacgcctgtgcctcaagagactcttgtaaatggggagtcataaaactgtttcagcccccgaagttcttaccagctcaaactcatcactgctttgtttataggttgcagtaccagagcaacgatggactgattgctttcagggctggctgaagtgcagtgttacagccactctttgtagctttactaaccctctacactttaagtctgatgtacttaaatattttaactgaatcctggatttatcattacctgctttgctttgagacttctgctttttaggaggcagcatagtatagattggagaaaaggcagttggtgttggcagagttgggactggaactcaagccttctggtttacaaaacaaggacgtgacttccagcaagcaagttccttcacttctctgggcatattccctatctggtcagagagtgttagattagatcctgctactcaaaatgtgatcctcacatcagcagcctcagccttacctagaagatcctcagaaaggcagaatctagagccgcatcccagagctgtggaatctggatggggattctaatcagatgttcaggtgatttgaacatgcattaaagttaaaggagtgccgtacagatttgcagggttccctggagaggttggggtcttcccttcatctctggtagcttgttggaggtggtgctgacggccacagccttggcaccactcctcatgttctagctgtggttaggttgagattgagacagtgaggcaacagaggagacaagaaagtcaactccagtggcctttccggggccttgggaagcgagcccacgcctgcaggatgccatctgcaagcttggctgtgttatccaaattcttgaggctcgttcaagaacaaggaggtaaacagagtcaagctagatatctgtagtacttccttatgtgtctctgatgtgcctccttaccagcataagtaagtgtgaatgatatactccaagtggtgtcctttggaaaaggaagctgattttgggagggaatttgaatgtatacttaccaagatagaaagtatttattgatgtcttcaccagcccagtctggagaaaacagagtaatacaaaaagatttttttttttttttgagacggagtctcacactgtcgcctaggctggagtgcagtggtgtgatctcagctcactgcaacctctgcctcccaggttcacgccattctcctgcctcagcctcccgagtagctgggactacaggcacccgccaccacgcccggctaattttttgtgtttttagtagaggcagggtttcaccgtgttagccaggatggtctcgatctcctgacctcgtgatccgcccgccttggcctcccaaagtgctgggattacaggcgtgagccaccgcacccggcctacaaaaagatttttaaaaagtgtttctgccattgtaccaagcataaaaatcctgaattagctgtcagtgtgagaagagtcctgctcatgtacctagaacttctcactgggtgaaacccctcctctgttttgtgctgttaggatttctgggctgttcttactttctgtcccagacctgactcaaaggcctggatcatgcatatgaagcacgtgatttttcaatgcctttgataatagcttgctgtgggaaaatcctgtgaaagaaaaatatgggaaattttgtgaagacacatggagagacacagagctggatccctaactgtgacatctctgaataaagggccttccttcctcattggatccaggagctttgctagctggatggggacctatccgcagcaagggcttggggtgcccctttagccctgaagttaggaacaaaggttttgagaagcctttcaatttcagctttatcctaagcaaaaatcttcccagaaaggttgataagacagcactggacagaaatgtcggaagtccagagttacttttcatcagcgctttgccaagtgctcggtcttttcatacctctgaagcatgtgaagaaggcagctttcttcccatctcgctggtgttattgttccaggctgtttggagagacctgaagatagccaagttctgttagccaaaaatttgctttgtttataaacccaagttttgtttttgcttttgtgcatgttatcggtttgatctgtgttaccaaaagaacattgaaaataatgaattgctttgatgagaattccaaggaataatggcaaacaagtgtgtatatacaacagtacgtaaacagaaatatgtaagccgggcacagtgcaggcacctctaatcctggctacccaggaggctgaggcaggaggatcacttgagcccaggagttggagctgtagtgtgctgtgattacacctgtgaatatccagtacagtccagcctaaacaacctggggagaccccacctctaaaacaaaaaacagaaaaccccagaaatacatagaaccaacaagaataccacatacttttcccgtttgatacaatgaggtaagaggagaaagttaacgcccagggcagttcatttaagaatgcctgaaaaacaccttcatttcaaaggatgttgtcatctattctttttctcttttgaaattgtgtagtaataaaaggatgcatcttttcagcacaaaaatatgggaaggataattttcccccagttgtatacaaaagtacttactcccaaatggggccattcttttctattgagtgccctactggtctttcgttattctgttttgagatttttatggagtttggcttatggggtaatcaagccattctactaaatgtggcccttttgacctttggagggagatcttttgacctttggagggagtacatcttttacatccatacaggagcagctattttctatatttctttcacgattgtagaatttcacttaaatttaatatccaaggttagtctcaatgtccagcacccctttaacttggttgagtggggaaccccatgtggtcccaggggactttcttaaaagctctagcaagtgtagttgatgggaaactttatttcagttcccgtttgcacctttgatctcagaagttgctgggatcaggtgacgggcattaagagacctgccttttcacttggaagttgagcacttgctgaacaaaaaattatctgtaaatgtcaagtgtgtccctttggtcaaaatggaaagtggggaggaagggaaggccaagaaaaaacatccgtgtgatgttaaataatgtttgactcatttcaatagaaaacacttctcttttgtatgttcaacaaatgtatttgttttaaaagggaaaaatcaacttgtcaactattgtttcttaattgtgatgccataaaagactttctggagattaaggaaaacattcattttcagaatgtagtctaggctgctgttttttctcatacagagacagagtctcgctacgttgcccagggtgctcttgaactcctgggctcaagcgatccttctacctcagcctcccgagtagcttggactgtagtacacaccaccacacctggctaatttttttttttgtagagtcagggtcttgctatgttgcccaggctggtctcgaactcctgggctcaagcaatccttccaactcggcctctcaaagtgttgagattacaggtgtgagcccctatgcctggcgctaggctactttcttgaatgcagtctcctctggccagttggcctttctctcccttcccacacccccagggtcattgctccccatggtcaaaggctgttcctgcatctttctctgtccaccattgaccccatttgctgtgggcgcatacccccgcaggtggtggagacaaggacccaagccaggagggttggtgccaggtcctgttgctggagttgtgtgatagccttggagtttcctttccctccttatgccacactcgcatgtcattgcctgtggttttgtctttgctctctcccatgcagatccggagttaggtgttggcacgctaccagaacatgacagccaggatgcagggccgattgtccccaagatatcgggtctagagagaagccaggagaagagccaggactgttgcaaagagccaatctttgagcctgtggtgcttaaagacccctgccctcaggtcgcacagccaataccccagccgcagacggagccccaactccgagctccttctccggaccctgacttggtgcagcgcacagaggccccacctcaacccccacctctgagtacacagccaccacagggccctcctgaggcccagctccagcctgccccgcagcctcaggtgcagaggccacccaggccacagtcccccacccagctgctccatcagaacctcccacctgtgcaggcccacccctctgctcagagcctctcccagccattgtcagcctacaacagcagtagcttaagcctcaacagtttaaggtgagtggcctgctcttctttggcctgacttttgccctctccctggggatcaggtgggtgggagtcggggagggatccctagggagactgaggtttccttgttggaaacatcatccttttctctgagactagagacagggaatggggctgttgggtgagactcgggtctcttgggaaaggacaggttgggatgggtgggtggtgaggacattgtaaagaagtaaaatatttatgggcactcgagagtggaggcggaaggagaggaaggcttggaaagccctgggccagggagacccagcagcagtgggaggcagggagtcgaagcctggggcatatcagaggccatgcagtgtgagcagatcctttcaagagaggctctctgcctctgatggaagaagtgttaaagaaaactcgtctccctgcagctccaaaggcaggaagattgggacctgatgagtattccagcttaaggattttttttttcattctgatttacttcctcctatgtgggtcagagaagtagggaagaaacaaaacaagctgcatttagagaaagtgagaaatttctttatggaaatccaggctctctcctctgtcttgtttttgccaagttacaaagaagcgtctaaaaagcagcacagaggaacacagcaaagaaaagagaggcagaaacccagtgtgcagcgccaagtagagccgagccctggtgccccgggggctataattctaacccggcacagctcctgaggctgtgtgtctttgttactgtttttcttttgaaaacctggtggctttggtggttccgggccttgctttttcctaagaggggaaagcacagtctttggggggcaggtttcctccttccccaaggagccgggcccggcttctgccccctcggccgtttctgtggcctccagaccataaagtgatgtgagaacccaggcacctgggtttcacctcttctttgtgtgtcttcatttaagaggtaacaagacagatggggggaactcagatcatcgctttttttattcctttttgttaaccgttgctttataggagatgtagctagtggaggatggaaggctggggattttctaggggcattgatgagaatctggccacaggagcgagagaggccctgaggtttaggcagaatgagctgtctcgacaccaagatgccccacagccctgaagcagcagtttcggtttgctctgtctgcagtagcgatgggaaagtttgcaggagttgtgatttcagaaagtgtgctcgtacagggaggatctgtaaagaggaaggggcaagagagactgtggtgagggtttaggggaaggaggtaggattcttttaaagagaatacattgcttacctttttttatttttttcttttcttttttttcttgttccgatagcagcagcagaagcagcactccagcgaagactcagcccgccccacctcacatctcccaccacccctctgcctccccgttccccctctccctgcccaaccacagccccctgcacagcttcacacccaccctccagccccccgcacactcacatcaccccaatatgtttgcccctcccactgctctgcctcctccaccaccactgacatcaggaagtctgcaggtggccggacacccggccgggagcacttactcaggtaggacggaggggcctgtgctcgtgaccccgacccccaccgcccctcgctgtgacctcaccctacctatgttgtcccgattgcaaggttgcatttgcctacaattttttccttccttactgtgatcttcctcaaacgctctctggcctgaggtccagcaaaaatacctgtcagcacccatactaagctagctcagcccctgtgaatcagacactgcccgaagagagtgggtttgtttggagttaggaggcatttccagctaaattcagccactgagtggtcagacccaggtagtgtgtcccgtgtcgtctgggctcccctgagggcgatggaagcgtccccaagcccatgtctgtctcgctccaggatcttagattgtgtcctggtttaaggggtttcttttcattgggcagggcagggccttctcctgtctccttgggaggagatgacacactctttgtgacaatatatcccagaattttaagggcagatctcatgttagacacagggtccttgtctcctcacctgtgttaatcaggtcaagcgtcccagttttggtccagtgtagccatgttatgccgccaatacagagagccatatagcagtaattgacacttgaagaggacatgcgagccctgccgtgtgaacagctgacatttattagtgtgctatcactgttcccaagcacttaaacgtgcaaattgctttaaccctcaaaaatcaaacccatgagttaggcaatattattgtccccctcttggagatgggaaaactggccctcagatgggttatttgccatgcccagggtcactcagccagtggtgacagctggaaatcggactttggcatttggcctggagtttgttccccagattgatagactgcctgtccctgaaagctgggagaccagctagagaacagggagacagggtgcgaccgggccttggtctcgtctgcttcattgattgcccccgtttatctcagggcccagccacaccctgtcacccctgccactgtgtcaccagccccgtacccctccacaggaaggcagtccgatgtccttttctgaaggaaaaggcgtcatcgtctccctcttcttctcttccagagcaagacatcttgcgacaggaactgaacactcgttttttggcctctcagagtgctgaccgcggggcttccctgggccctccgccctacctgcggaccgagttccatcagcaccagcaccagcaccagcacacccaccagcacacgcaccagcacaccttcacgccgttcccccacgccatcccacccaccgccatcatgccgacgccagcacctcccatggtgcgtaccccaggcagaaatgtgaggataagtagagcacgactcttttctttatgcagcacgtgggaccgggctgggcagcggggccaccagagatcgaatggggactgacggctgttggctggagagaagggaatgtgtcctagtgccctgcctcaggcagctctgacttcaggggcctaaagtaggaacttctttctaggcagttgtatccagcactgcgggcggaaatgattccatctgccctcaaaacagtcatgtccagtgttgatggctaacttcttaaagggttgtttagttttcttgaacttcccgggggactgtcaccaggcagaaaatgcacctgcttgtgctttgcatcaagtgctagcacatacattcttgcagggtaatgggggtgaagaagagagaagagaagggagagagacctctgccaggaggctgggactgcattgggtgccacctgtgcattccgatggcttccctaaacccactttgttggaggtgttatatttcttgtgtttcataagacagtccctaatctggtattgtgctctgtcagccagtgttcagggatccccgcagggacagaacgctctgccttggggcaagaggaaccactggccatgacatggtcttgctttaactgggggctagcacatgtccagaaccagtgaggaatttttttttaagttaataacgataattcatagtgccatattagaatgctaaatattctcagatagagtcctgtctaacagtgagtattagagtcattttttacttatttaatttttaatatttcaggaaatactggattttaaggccattactataggcattgtgagaataaattgcatgattttaaaaggagtccacttcacccaactttgcttcctctccttcctctccctccccccatcttgtttaacttactttttaaaaatgtgtttttaaagtttgttttataaatttcatttcaaggaatattagcaatgaggccttgtgaccagaaatatgttcttaatagcaaatcctgtatctcttttttggatgaattatacttaacaattagattttgaagatcctaagattttgagaaagttttctgctggcctgtgtgagctgtttcacaaataaatttaaccaaaggtagttatagcatcaatatgatgacattatttagagggaacaatagtatactctttttctgttccaatgaaaggctgtctggcctaccccagatcactttgtatttgggtataatacatttcagaagacagctgcatggcaagacagtttttctgccaaagtgaagatgaaaatagggggaattcactgggtaaatcagaccaaatgctcacctctctctgatttatctggataattggctgttctctcctgtttagaggtttggttcgtgccaatctgtagaaagaaaatagtaggaagaaaggcatcctagtacgtgcagaactaaaacgtaccacttggtttttaattttgttcttccatttctgttggcttcttgtcagggagactcaggagctcagaatggtttcatatgtaatgaggttatggggtctcatgacagcttaatgacagggaagctttgtagggccacctccactgtagcagtgaacaaaaatgcagattaagtaactagcttttgctttgatccctttacagtttgacaaataccctacaaaagttgacccattctaccggcacagtgtgagtttcattaccatgctacacattgaatgtaactgctttgccatttttgtgctcttgccacagatcagtcaatgactagcagccttccttaatcatctttgcaagagttcccattgctcctcgccactttggatgcttgcttttgtggtgttttgcttttggtaaagatgcagtatcatcttctgaatcaaaagatcataagcattccaaaggcttgaaagcagagttgctctttagtggcagtcaggcatctgtcctgcaaagtgagatgtctgcaatggagtcagtagagttccaggagagtctgaaatcacagcatttcagtcgtcagttgaaatgccactaacacagaagttctggaatgcaacctgaattatttcctcttaaatagaaagtcccttgtctttttgactcatgactcttcaacaagtagattttcatttgctctagactaaatgtagaaccttcttccacatggctggtattgttctgttgagtttgttacaatagaaagtaaaaatatcacttaattaaaagaaactcccaaaattgaaatgagtgatattttctctttaaactcattctcctttatttaaaaaaaataaaaaaaacttgttttatgccattttaagagtatgttctggaacttcaattgataacaccctaagttataggttcagttaacttgtaagacaagagcttatttttattcaaagaccttgaatatttccatgatattttgatgatggggtgaatactgcatcatttttatctgaaaatttgcaagtttctttgccagtgatttcttttttttttttttttaatgaaaccagaaaaaagagaaggttaatcatgcttgtagccgtgttgattcaccatactcaactgttcttgcttaggtttgtagatagtgttatcatttgagaagtgctactttaatagatcagcaaagactgaattcattcatattctgaaccagataattagataccatgttagtcaagaggttagctgagaagtcaaggctagaaaatattagaaatcaattgaaaattatgtactctaggggcatttagaaataacgtaagatgaaagacctcttcaaaaagaagttagaaaagtgtatttgagtgatgcctcctccccctccctcccaacatggtccccgctgttctgctcagtaccagaatacaaaaacatatttcacggggacacccaaagcccagtagacctatgggtttcctctttgggtctggcccatggatgccaccattctgcccttagtctatactctgctgatttaaagtaaggaccagctaacaaaataattcaggctgggtgcagtggctcatgcctgtaatcccagcactttgggaggccgaggcaggcggatcacaaggtcaggagacggagaccatcctggctaacacggtgaaaccccgtctctactaaaaatacaaaacattagccgggcgtggtggcgggcacctgtagtcccagctactcgggaggctgaggcaggagaatggcgtgaacccgggaggcggagcttgcagtgatctgagacggctccactgcactcctgcctgggcgactgagcaagactccatttcaaaaaataataataattaatatagaaagttgagcacccaaaaagtggctcagatttactttctaggacccactgcggtgccttctgatacgcatattctacagtcctaggccaaagatggagaataagcctggaggcctgaatttttggaaggtgtatgtattattacttaggcgcttcaggtttttagtcagggggaggaatagtcagctatatttatattctaagaggtcaatgatggaataaagcaaaaagaaagtggtaagaacatccagtttttaaattgtaaacattaaagggaaaagcccacctggaggcagaatactagaaatttgagtgtgtttcactggggcatgtatttaattactcagctttattcagtgtactgtgggagagttatttcatattaggagttatagtggataatatatgaagtactcagtctcccctgctttggggattaggacattataaggggaattaagatgcaatgcactcaagtatctaaaacacaattttagacttaaaagtagttttaaatgagggcacttggcttgcaatcactgtttaagtggatttagttcaatatcaattagtctgaaaaactttgctgcatcattgaagggagcaaaatgaaataaagaccaacagaaaaaggacgtgctctgaacacgggattgcgaaatgtgaatttcagtcattaccaaaaataactaacacaaatactttattaagacgagcttcaattattgttgtaattttgacataataaaccaccacgaaggtggggcattatttaaaatatttgtatggtggcttgataaatggaaacaaaccaataggacctcaaaaagattaaatttttagaaggagggaaagttgtgtttgcattgtcttcagattctctgtatttttttcctcaattgtgtccttttataggctgttgattcaggaaaattcatagtcttcattcagaatcattcttttaccatcatagagtggactcctacgtgaagggcttggcttgagtatcctccaaagagcttgttcatttaatagcagataccattcagaagtggccataaaaactcagacttcatatgttaatacggaagtgctttgagtacctgagacttaaacaagagcaactgaaagctcgatagtgatattccagactcgggttatttctgtgcaactagaatccatcttctagacaaattggcagctccatttaaagtatacatcgagtcgttttattttaccctttcacaaatatttgtcattattttagatgagagaattaaattgtcctctggaactgccacttctgcaacaacctaatgaagcaaggattgtgaatatactctcatttcctcaaactattaaaagtctgaaagtactaattgagttttaatggtataaaatcctggcactcatgaagacttctttttcttccccctttttttttcttttttctgtctttttccccctctaattaacttgtaattttctgggcatcttatttggctcaggatccctcctgtttttgaaatgcattaaaatctccaatcatttaggacttctatctgatttaacaattaataattagaaaagctccctttctaatgatgccctcacccgggatgtcatttgctggctgattgatcctgaactacttttaactttttaagttacacattcgtggcacgtctgtgtgatcattccatcatggcttcttgactaatggcatcaaactgagattacgtggcttgctcatgtcgatgtctttctatgggacgggaatttgaatatgtcacttgcctcctactaaaatcttttttccccctctccgtctttggccacagctcttccattcctatcctcctgcagtgtcgggcatcccccctatgatcccacccactggcccttttggttcactacaaggagcatttcagccgaaggtaagaaacctcacagtgaaaacacacaggcatgtgtctaagtggcgtcccgggccaggcgtgcaggaagttctgcgtcctcttgcctgtgcagtgactcattaatcaggtcctaagtgaccactgggattagagtgagcctatttttcttttttttccaagtccatctagttttaaatggccgtgaaaatttacttttcaaactgtactacccagataatctcagttaagctaagatttcttgtgctcttcaaaatatacacaatatttatttttttactaccaatatcgtggacataacttctggtcaggaattctatgaaatatcagacacatgtgcgccaggttgttccgcaggtgtatgtaattagtaaagacacaaagctgggtccttactgattttagtagaagtggggataaaggttccacaactaaaattgtatcctatgaattctcattctccctcatttccctcgccaaccccatcggctgcaaacagggcctgccggcaggtggggtggtcgcctcccattttggtcctcctttctttctccctctctctcagccatcccacccctgccatggttacactggccaaggccaagactttgtcatcagttactaacatcctagtgtgaaattaacctttcatcctttataaaaatcaaattctgttctacctagtcagtgataatgccgtccagcgttggctacagctgtctctaaaggtcaatattgaagagtcattctcgaaacactctctttttaaatatacttacaatttctattttaccttcacacaaaaataaaaagagccgtactttcatgtgggtaaccattctcagacttgaagatattctgctgtgtgccattgggttttcgtttttcttttccccaccatctcatggctaaggtaaaacacagttttggtccagagtcttccaggataagcacataactgcatttccaaagacgtgtttcattaaaagaattaaaaggcattagaggtggggtcccctcccccttcaaaatcacctgcattgaattgcattgaattcagttcatctattgaatttgcctgcattgaattgcagcctatatgcaaggttacagatatacagggcttttatgactgcctcgttaaacacctcctgtctggagataaaatgatggtgattttaaactccttcccccagtctgcacctcactactccctcagaccctggtctgtcccctctaggttacaccaaatctctggggcctccccaaacagactggtaggtcatttaataaattagactatttccctcgctcacaattatccaatcacacagaaaactacatctgggcaagaaagtgtctctcctggtgttgaaataggcctttccaggccatcgtcctgattgaatatgtagattgcagttcattagtggagttcttcatatgtatgcaaatcaggttgttaacaactccagcttaattgttagttgtactgcagctgattgcttttctttctttcattcttttcccccccttctccttgtaggcaagcttcgggcctaaacttgagctccttttccccacgagtttaacttcctggtgtggggggtgttcatagaagttgtgatttcttccataaaatagctggtgtcgtgtcctgaatcctttcccactagaaatagtgattgtgcccaaagtaggctttttattgttgctaattcaaaggacagaagctcacagataaggttaatattagcaatatttgagaatggtggtgggaataggtaagagcaagcagaattgctttagaaatcatcaaagagcagatccgcaaggtccctaaattaggttctcttgtcccatttccaccactgctaatgagtaattactgagtataattccttattattgtctaccagttaaaacggagagcttaatgtctgtaaagtacttccagttattctgatgagaaacacctgatactgccaattataataatgttcacttaagcgtttcttggaatgtttggtgattaagcaaaaaaacagtggcagtccctgccatgggttcattcagaggaagaggagttccaggacagcatttacgtttgttgcttctcttttttggtcctgtgctttttattgcagtgaaatgttctggggacctctctctgcttttacatgccattgctggagagagcaagctgtggtcaggcccccttgagaaagagcatgtgtggtccctgagaaaaatgaatcttgcgtttcagaaggaaacaaacaaatgaagtttggcttctctcatttagcagaagggaaggatcttgctttcatgtcacctgttttgtgcttcctaagtaagctgtggtctaattaatttgtagacatccaaccctatcgatgtcgctgctcggcctgggacagtcccacacactttactccaaaaggacccgagggtacgtgcaaagtcaggcttggtctcaggtaacaccagggtgtgtgtgtttgcacgggacggccagcccagtgctcgcatcttccttagctcctttgagcgagctgctgtttcagctgttcttctagtttgtggaagaaaatgccaattactcttagaaaacacagtctctcctgctcactgcgagcataggacacaaagagaccgacttgccgatgggagaaaagaggaatgagttacggtctgagcccagaaattggacagtgtcagcttgtatagtttttacttaaccaatcttctctgtctgtatctccttaaattgtcttacacaaatgaagtagctacagaatgttttgaatggaaaagcactaaggcgcttttcttcctggaagtcaggctacacacatccccccgcttgcctggggtcaggaagttattgtactgcacggctctttggccctctatttttaatgtgctagggatccttttgtactctagagctaaataaaatatccattatgctttggttatgttgtttattcataatttattaccactgcctgcttccaaaaaaggaatctgaagttatacgatagatacaatcttgcctcattgttatttgtagtcatctttatacgaaatatgaaaaaatctttaacaatattgtctttttacctacataagggcagtcagaaattgataaccagagttagatagaagtttaaaatgactcaactatgtaagtatgtcatgatgtatagtgaacttctggaaaatgtctaatagctataaataatgtaaagtcatcaatgtaagggtattggtaaagagagcctaattctcctggatggatggaaaggacacctctccccagataccagttagtagacagctttaaaagccaggggtctgaaggccattctccctcagacctacccggtgtggtttggagctcaaaacagtgaaactcctggtgtgtgatgtgagcaaatcatgttgccagagggcacattgctattgattaaacttgtacaggggcttgtcagcgtagatgtaccaaggcttgtgaagtgggggaggggacacttggcacttttgatagtgtgaaaatgggttaattattctctaaaagggcttcatttaaaagtaaaattctaacattttaatttcccctcctaatgaagcactacaaatttgttaattagagcaattgtttgagtgacaggcatgtaaccaagttgtcattttctcttcacagttgacagatcctttcagacctatgttaagggtaagaaagcttcttatagaactgttttgcaacctctatttgactccctgtgggttaaaaatacaagtctattacaaggaaataagccatagaaatgttggaataagacattggaatgacggtgattgggtttttcagatagtgtgattgaaaatggcctaaactgttttgctttgaccgttggaggccattggctttttttttttatctctacaacagagaaaagtcaacgagtccgatctcttgttagcagttctggtaaaaggtttgactagttggaacttaaggggaaagactgaagctataggctgaagttagtctctcttgcacttagaaaatatgtagctgggtccatttattttggctggtggctccctctttctgtagtaagtgacattgacttgccatagccgtttgacctccttttaaggtgcaggaaggaggtactataagcatctggtttgttaacatcttgcttaaagcaaattgttctcgaggtctggagactggccagtgtgatgacctctaaatgaatcctggtggttgggggtaagacagacatgatgaattgttggacagaagatggatggacagcagatttcttgctatgcataactcatttctagggcacataatcagataatttgatttctccaggggaaaaaggagaattgtgtcatcacttaggtgaggcagtatattatttgtgatttcaaactacccataatttcattgcaagagaagagaactgacccagacttgcatttaagtatatattttcggaactaactccatactgtagaaaccagaagcttctgttcttcgccgatgtagaatgaggctgtgttttcttctcatctgtccagtagtcactgagcgcgcacgccgagcttatgggtagattacttagcagaaatgaagtgaaaaggtggtccctgcccgctgactggtagaagagaatacactcacagcactccactccttataaagcaagacatgaaataattggggagatgtggattcaaattcaaccccagagggtggaggatggacttgagatctgcagaggcctagatagagaacaggaaggaaggaatattcttctctttgtttctttctttaaacttaggaacagcgcccaccaacacgaatgggtagttgactcttagcatttacggtaactgggcttcaatcaaaatgtgaatttctttgtaccactttgggggttaaaataaaaaccaccacggtcttgggggaggttaggacaggttctgtaccctctcttattttgatttgactcacagacattcactaatgagctcttctgaacagctgatttgcattatagcatggcaacatttgttaagtagggcttcccactctaccaggtctgccagctggcagcagaaaagaaagagaagaggcacagagtgggattcaggcttttgccgtcttgtccttggtaaccggggaggcccttgtcaatgtggttttctgagtagcaaacccacgtggggagagagggggagctggctgtgactcccttatgactgggcgctggagagctactgatggaaggcacttggagagtacaaagcactcttgtttcacgaaaaaagcctctgcagccaaaatctgctgaaagctttggggaaattgaaggtggttttctctgaaatgtcttcctcctaaccacgttgctctttcttgttccagaaaccagggaagtggtgtgctatgcatgttcacatcgcctggcagatttaccaccaccaacagaaagtcaaggtcagtccgaccttcgtggtgtagggaagaatgggatgcacatgtgagtgtgtgacgtgctcgggagaacctgatgaaggaggcatttaaaacacattttacagacccatagttaggaaggatcaagcctctcttggaaaagctactcagaagtcttacttattttttcctagagtcagggtctcactctgttgcccaggctggagtacaaggggacaatcatagctcaccacagccttgaattcctgggctcatgtgatcctcccacctcagtctcccaagcagctgggactttaggcatataccaccatacttggctaatttcttgattgttgtttttgtagagatagataggggtctcactgtgttgcccaggctggtctcagactcctggccccaagcagttctcccacctgagcctcccaagtagctgggattacagtgcaagtcacagcagccagctcagaaatcttactgttaattagggaaaccactagtgaaattacaaaacaaaagcaaactgataatgccccagggttttgttccctttataattttgtcattttattgatccaaaggtcttgaatatggattaaatgctaaaataaagcttttggaaataaaattatagtgaccaagaattagaatacagaaaatactctgcatctgggaagagctacaaatgaatgttgggtttgggtttttgtaaaaatagtgactggtgcattcttttcattttatggctgtgggaaaatggtagagtcatgtgtgccctatatgaagatgatgccgctgaactgtcattggtcctcctgatggtcagtgccagggattggaatacagtcagtacttgcaggagccacgttctggctagttacctcgctgtccaaagacgatttttcctttttgtctatattttcatcatagggatgaacatattccatgttctgctagagcctttatgactcagtaggggagagatcaagaacttctgcaagtccctggatacagcatcagcgcttggcttagggaacaaagtaactgacaagtctgtattttacagtctgggtatttataggctatgttacgatgcctgcaaaaatgggagcaaacaagcaatcaagtaactccaataagcttcacttaatccatttcttcatgaacaagcttttagtcctaacagcatttgggagttctcatgaaagaaatacaggagaccaatgagccaggagatagatagagctcttcatcacagaagagacatgtttttaaaagggttacgtgatttttaaaataaaacaacccaagttccagtcactctagaggctgaggcaggagaaccccttgagcctgggagtttgagtccagcctgggcaacatagcaagatctcatctctaaaaaaaaaaaaagagtaaaaaataaaaacccggttaaaagttttaagatgcaaacctcagtaaatgaggtcactaagatattttgctttggttgtcagatacctgctctttcttataacatgccatcagtgagtttggctcatttgtactttattgttaggggaagtttaattggaagccttgtggtctatcttagaaaatgtgtgtgctttgaagagctaactagattttgatgattagttcaattcagtttttgttctggttgatgtggttagtggaacggtaggtaaagcacatcttccttgtaacttctttggttaaaagagatgagggatgttgcacgtgccactttagcaacttctttcccataaaagtgtccccagtgacttaaactttcattatcccaattcaattagaaagacctcttgaacatgagataacttcgttcatcttcccttttcagcaaactgcttgtaatccccaagctccattttgcttcatggccctaagttgtggttaatggaactgtgctatgtaccatgcaatattagcactaaataatttggccaccaaattaaaggaggtattcaaaagaattttatagattcatagtgaattagaagcttggttttgaggcttggctattactcgatactgggactttcattatagcattccctgtagatttgagcagaaattacatcttccctctctctgtaacgttcatttacgcattcttttagtcgttcacccagtgtttattgaaagagcctacgcctgcaggttccttactgtggcgggctgggggcatgcatccttcctggcgtctagttgcttagagttcagtaatgaggatcagttgtgtgtaaaaagtgaggaaagtgtgtgtgccctcttaatgggtggtgtcatttccagctggaggtgcacgggtagcttttgctttcagtaggggtgatgggtgagtgggacgttgccgtcagcagtaagagaacagcagacttccctgtctcagatcctcacgccatgctctgtcaatatagatgccccctcatggggctttgctgttgtacagcagggcaaggatccctcaggacatgagggagattgagctgaggctagaatggggctaaaggggctgagagcatcagatgagtccgggagatcagaagagtagccaggcacgatggctcactcctctaatccaagcactttgggaagccaaggcaagcactttgggatcgcttgagcccaggagttcaagaccagcctgggcaacatagagagagagacctgtctctaccaaaatgaaaaaacattagctgggcatggtgacatggatctgtagtcccagctactcaggagactaaggcaagaggatgcagtgaactatgattgtgccactgcatttcagtctgggcaaaagagcgagaccctatctatctcatctctttaaaaaaaaaaaaaaagagtgaaagtcagaagcaggtactaagggcagtgaaaacccaggagactgatggggaagaggtcatagcaagggaaattcaactagaagcttcaagtcccaggaccccatgccttgggagcagtgcttatccaaggcagtgtgaagccagttcaaagagaaagctgtcaagaaacaaggaggtggggcagctttgaaaccatgctggtgcaagggcctccagcctagagaaggatgccaggggaaaagattgagaggaagattaagacccaatttctactgcctaagaggatggtaggcggaaagattagcctgaggatagataaataagacaaaacagagtgatttctgtccatgataaggacttcacacaagagtttgttttttttttttggagacagcctcggtcacagcaacctccgcctcctaggttcaagcaattctcgtgcctcagcctccccagtagctgggacgacaggcgtgcaccaccacgcctggctgatcttttgtattttagtagagacagggtttcaccatgttgcccaggctgcccttcaactcctgagctcaggcagtccgcccgccttggcctcccaaagcgctgggattatggtttacttgtctggatggacactgccctcccccaaccttcctcaggtaattacaggtagtaggaagagaaagggcctctgttagttaaattaatactcctactttgtttttctttgttattgttatataacagtgatcatttgaaagttagcttatagacatgcaaatatttcttcataacttttggttactaatgtactgtgagctattagagtatggcaaagagtcattaaacaaacaattaatttatacagcagattgttcatgcagaattcctaataaaatgagctttaagacactattattttaaaccttactaaaatgggcctttacagcaaaacactgaactactttgggagtggtggcagtctccataaataggatatggttttatttctcaagccattaaccttgaagaccaaacatagctgggtgcggtggctcacacctgtaatcctagcactttgggagaccgagatgggcggatcacttgaggtcaggagtttgagaccagcctggccaacatggtgaaaccccatatcgacaaaaaatacaaaaattaactgagcattctgggaggcacctgtaatcccagctacttgggaggctgaggcaggagaagcatttgaacccaggaggtggaggttgtagtgagccgagatcccaccactgcactccagcctggaaagcagagtgagggagactccgtcacaaaaaaaaaaaaaaaaaaaaccagaccaaacactagtgttgtcactagacatttctggtgtaacaggcactaccggcctgcagatctgacatttgagggtgaaatggtttttgtgtagctgctttctctcacagtgtttgtaaacttgaacccaagtgcaccgttcacagtctccagctccagctcttcactaacacctttattccttgctgttggccttgggacccttactgttccccttgctgtgtagaaacagatgcagtcagacccacataagctggactttggactgaaacctgagttcctgagccgccctccaggccccagtctttttggagccatccaccacccccatgacctggcacggccttcaactttgttctctgccgctggtgagtgtgggtttgggtggggggacagagctgagaaatgtagttctcaggtaactaaataaatgaggtttgggctctgagctgccgctcagtcaccacctacaaaaatacagttaatgccagcttgcaaggcaacatcgcagcacatccagggagttgggaatcttcattgatacactctctttcattaaaggaggaggcagagatcatctttcccttacagggattcacattgcttcggttcattatttgcttctatattaaaccagtataactcacaagcatgtcagttgctattgagaaagatctgaaggcttgcaagggcagatcggaaggaaacaatgccaggaattatagaaggatgcggtcgcccttaatacggtgcccgcagagcactgtaattttgcaccgggatgctcagtcatgccgtgttttaaagtcctgaggataaagaaaggcgattaaggcagttgccaggagtatggtctgtgatagggaggttgggccactcggttgctggttttctctgctacaaaacgtaatactattgcctggttggttatagcggtggaagaaatttaggaaacggtgtaaacacccaagtgacctgctcatcggatctgtaattcatttaacctctgagaatacacactgtcaagtgtgcgtgtggaaggggtgaggtagagagtgacgattatgctcattcctgctccaggtacaaacaaaagacagcggctgtaaggactgtgtgtgtgctggatgagaacagccctcttggtattaagggtttcttgtcattctgtcttctctaaagcttttttaagtgtaatttctggcacacagagctcagctcagttaacacttaaaaatgatggcactgagctcattctgctaataacttcatacccactatgctaagtagaatttattcttctggacgtaagcagtcaaggggctccccatttctgatccttacgagacaagtcttacagccatcctgccagctgccaccccaggcttttatccaagactcactgttggtggacctctggctcttctgttcaggaagagagaagcacccacactgcaagaaatcatcattataatgggccttagctaccaaagcaagtgcgtccccctggagggtagatggaatttgctaaggtctcaggtttttctctgtcagtgctgtctggggacatatttgaaggctctgttaccatggcacctaggctctgagacagggctacatgaagagcaatttttggaaagaatagatttctctctggcttccatttgagccaagtggatgaattggcttcttttgcttcaataattctggaactgcaaggcacccctgggggccctgggctcagcaaagctctggtcttcattgaagcattaattagcttgcactacacagacagtatgtggccaaaattttatttagctgacaacactgctaacggcctgatgaatattctggaatatattcacttggtggaggcggggtatcatttttacacttcccaggtggaaaataagccagtatgcagggctgaatagataactcctcaggtgtcttccaattccgaactactgtgacggggatgatgttcctcctgtactgagtggcttcctctccaaacccaggccacaagacttttgcagcccagggaacagcagtccaaaacataaatcgagttaacagagtgtagacagcaacaacccctacgtttaatccattttcctaagggaatttatatttgtttataggaacttagacaaaatgcaaaggattatggaacagtttttagtaaattctttatccaggccttgtttatacttccattctagaatgtaaccttctttagcataagcagtatgggattctgcccaaaatagttatttggtgaaccttgtaactgatgtgtataacttgtacatacttaagaaatccagccattttcatcttgctattgggtgctaatcccatgaatataaactagagacttcttcagatgaccctggcaaatctctcgtctaggacaaagcctgccttccaggaagctagcctccttagctagtaagtagcctcgtattaacaagcccatttggtgccctaaggcctttagaaatgtccttccctaattcacatttgcacactctctttctctgtctccttccttccttcctttcctggcttccttcaggaacaggaatagaggcatcttcaagaagtacacattaggcaaaatacagagaagaggaggaaatgtggatcaagggacaactgaaggaaaccactaaattagacctgagttccctggcaggcaaagcaaaaacctgtcagagtcagttataagattttcagtgccccaaaacataagaatcaaccagcttttcctggcattgaaagttgagagacatcagaggacttcatctcctaaaacctaattgagctcacaataatgagttttatagagtcgggtcttatagtatccttcgatgtgggtgcatgcgaactaacatactcttcaggagaagggattctgcaagtccccagagcagcgtagccaagaaccacagcttcaggaccacccctcctgagccagagatgataacgggctgggtttctggaagtgtttctcaaagtgaaaacttggtcctccgagatgctctatgaggagtggattccatgatgaaatgttcccctcttagagaacgaaggagcctataagcttattaataagcttattaatggctctaagaagcccttcagtaaagaaacttgcttagctttttttaatccagtatttctccaaatttacttggttataaagcctcccctcctcccatgacccagggcagttatctctgtctttgtaatactgtgtgtcatcggcttaaaaaagaaatacctgtttttggtggtggccagccacgctgggaaagagaaagagggatgattgattttctgcttcctaaaaaaaaaaaaaaaaaaaaaaaaaaaaaaacacacattttcttttaccctgtgtcttgcctgcaggggcctgggtggacttcagccatgacctcccttgaacatattttctcacggggcccttaagcaagtagaagccggttgcatcttcgaagttggctttttgtaaactctggtttcgttatgtttgacttaacaggtgctgcacacccaactgggaccccttttgggccacctcctcatcacagcaacttcctcaaccctgctgcccacctaggtgagtcgcccaaaataatgggaactgagatgtgtgcttcaggcaaccctgctgtgtttaccatgctcccgctgcacctccgggcaagctggtgggagtcccagataccctgcttaccatttaggcaggagatggtgctctcttaggagtttcagtacatcccgtccagcttccagatttcatctcttacaccgcattctttcggtagtagagctgtgctcggcagtggttctgcctgaacttcccatggtgcagtgggtgagagccattccttggtatctcagggaatccgagtttacaacagcctgttcctgcccattggaagaagatggtgagctcttgccccatagcaaaggtcacctctaggaagcggaaagaaacacaagctgacgttatggagaggagttattctacatctcactgccccgataaatgagtctcttcctaataaaggtgcatgctttgtgtggcctttgtgtattcgatcccatctgcaagtgtacaggcagattcaggcattggcttgcacaacatcagggcatatcataggcacgccctcagagtttcatcatggattcagatgccacctcctttctgttctgttagaatctgcagagtgcattcctggcagaggcgagactgggcgggaaggcaagttagtacatcctagcttgagtagtgtccccactgggcaaaggaagagtaatacaaaatacacagttgtagaagaagagtcctcagaaatattttgctaacccagtgcctaaatccaagtgtaatgaaaaccttttacaccatctggtaggaaaagtgggacaggccaggtgggggcgtagagagggcagggatcccgcatcgccctgctcccaggaagctctgggttcctctcccagcagagcccctgaccatttccttcttccccatcttgtttgcagagccttttaatcggccgtctacattcacaggcctagcagcagttggtggcaatgccttcgggggacttggaaatccttccgttagtgagtacctctaacttttaaaaatctgccttggactttttatctcctgtgatccgcatatggctcaagacctttctagagaaaaggaaactatgctctggggggaccagtgtaggttatatcactgcaaaagcaggccttcacagtggggtgaggtggaagtgtgcagagccaccactgtgagggcagccccctgtggctatccagttctgaggggcaggaacggcagtgtagttgatgaccacagaaagtttactcaagtgcggagtttcatccacatcccatctctgctctccaagattttggctgcagctcacattacaagtgaaagcaatagttacagcaattgttacatttcatcttgcccgtggcattcgtggaattgaaaaaagcacaatgaaaaatagcaggaagacaccaccaggctgcgacaccaccaggcttgggataatcaagatttggcaccattttattctccatcatctaggaggactctgcagctttctactattaaaaaagcccatctcgattaggagaagaattacaaccccatctcacgttctaaacattagtgtttagtcgctgaatatgcaaattattttctttcatgctacataccatatattccgggtacaggaagagctaaaacgtgtctctgagcataccgtcacaggtcggtctttatttaaaacacaggaaggagacctgtgtgtctggtgagggcaaggtcctgtctggtctctggtgacacttgagagggccacggtgggtagaggagacagtgacttctactgtgaatcaatttagaattgttaatccaaatcccaccatcataacacacccttctgcatgcctggaacttctgcatgcaccagatacgttgaattaggtcatctcagtacccatttggtcccttttcctttttaacttcccctgtccccacctttgcttttggttttaaaaagaaaaaaaaaagctgtgagctacctctccagtgtaggacaagacttcctctaatgaatttgttaatctcctttccttttccagctcccaataatatgtattcattttaactctgaatgctgttaaaagttttttggtaagtaccttcattacagcagattatataatttctcttaaacctttttgttctccacttcaccatttcagcacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaaggtacggaaagaaaccgctctcgagtccccacgggggagcctgctctatgccaagtaccagtggaactggccgcccaccctccctgtcccagcctcgtgctttagccgccccggtagcctcagctcctccccacagccagtgcccgcagcccctcgcagtccccatggcccatagcatatggtgaccgtaggagatagcagagctagcgacagattcctgtctcagtcgcagttatacatcagcacgtcccaagtccctgttagcgtgtccaaacagaagtctttctctagaagacagggagttggagcttcgggccagacacacacagcatgaatcaattccatatttgctttcaagtccgtgcagtccatttaaccatccataggtttttctcgctcttttcctctttttgttttcttttagaaagccatgtttgcattgcctcatcatatttttctcaaattttgttcaaactcaaagcctggggctcacagatgactaataaaattttactcacatagatgtagagaaacgtcgacaagcagttttggtttggttttggtttcactagtggataattttgttaaccgttgtctctgcacttggtaacccatgcctaaaaaaaaaagtagcgttaaacagggaatgtcttggagttttttttccaaagaatatcgtaacgcattcttgacaaaaatgtctttttttttttctttctttaggctatttattttcactttaaatgaactgataaggaatgcacaaatatgcttgacagaaaatacctaatcccaatttccttgcagtatttaagattcaaatttgatccgaatctttaatgtttcttttctttgtataccgtgtatgtatgtgtgtgtgtatatcctagtaatttcaaagaaagaattcaactttgcaggctctaaatggggcagattagtagatactcatcagaggccatcatgctgactgataaaagaaaaacaaattttccttcaaggcagtatgataacaatctcttaaccactgggaggaatgtttatgacattcatctctgagctgtgaactgccaaaatgaggcacgcctagcaacataacctggccgaccctaggccgcgagctctctgtacacagcctgtcactaggtgcaatgcaggatgtggccaccagccctttgcgtgtttttctggatggcgtcaaaatggcctcttggattaaagtcaggaagcttaataaataaaatatactcttcttccatccttcccttaaaagttattcttcttctctgcatgtgggcaagaaacagcccttataggggagcctcctgaatactctgtggtcctctgatccttgcacaccagcaccaagccagcatggcagcctgctgctctcctcaactttgccatatctgtcttggcaccatccgtaagacctgcctggtcttagttttaactcaagttttaccttattgtcattccatttgtttttgcattttctgcccaatactcttgagcccccatccaagacaggtctctaaaattcttgtctcgtgttttcactcacagctgctctctaaaattgttttcaatgtccccatgaggtttcgtgtttagggacctgcttttcctactgccttccctccgtcttctcatcagactttggctttcttatcccatctggtgcacaagtgctctttgcaacccaaaagtcctccaactgtggcttccttttgagcctttctcacgtgctgtgtcttggagatggctctgtatccacgttctttgctctgaaactggtcacttgtccttgtaaggagcaagagacttctgtgacactgatgttgaaccctttcttccactggttcagtgttgcaaagttggaagaaaagtgatactgggcgttgggctcttaaaacgtgattctttacactagatgatcccgggagtccagacagtcgggctggattgccacatcattgccttattgaccacatgcagccatcttggctttctggaagctcttcttctgtgctcttggttgaggctcttaacatgcagagagattcttgctcccagcagactccccctcaccctcatccctggtccatctcccccattaagcttcctctaaaatctaggtaagtaggataagggtggctggctctgccctgtccagggcacggctgctgccttggcgaccatgggaagcagcccccagcctgtcctcttcacaccaccatttcacccgcagcccctggcccggccgactcgcccctttcatttcatctgcgtccttgtcttcccctctctcccccagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgcaa

SEQ ID NO: 563 - DNA, 1193980 bp, Homo sapiens
gctcgcagtttcgccctctcttccgctaatgattgcattattatgctcccctctctggggggtctcgcccctcttgggtcgctccggagccccggcctcccctggctgcatttcttaaaaatttgggagcctgggagtgagttttctccgaggcgtgtgtgagaggcggcgggggtgttttcctgcgcgaggggcgggtgaagttcattgcccccacttttcccgcgacctttttcggacccgattttggatcgagttgaggggggcgcgggcgttttcggggggcggggggcgcggcggagaatggccgcggggagggctccccggagcctcccagtctcttgatcaaagcattccgctattctgatttattgcttgcttggtgagttatttttttttcctctaaaggagacctgtgtgttcagccattactttgctcggcgctgctcccaggcatctccgaccctcggtgctgtggggagccccacacttgggctcctcgcctctcgccctcgctccccgtccctcctcccctctctccgccccttcccccttttctttctcctctctttcttcccctctctcccttctttcggccgccgtctcccccgcgccctcctcggggcggagggaagccgtgaagggggagggagggctcggtgtcaatttttttttgtgtggctgcggccgtagcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccgggcgctctcactcgcctcgtcgtcgggctccgacaaggaagacaatgggaagcccccgtcctccgccccgtcccggcccagacccccgcggaggaagcggagagagtccacctcggcagaagaggacatcattgatggatttgccatgaccagctttgtcacttttgaagcgctggaggtaagggggaccccccttcccccgggttccctttatgcacgaccccactcggctgcgcccggctctcctgcctccctcgccgcgctccgggctgtctgtctgtctgtctgtctgtctgtctgtctaggctgaggtcttattgttggtggggggagctgggggcgcgggcagacaggcagcaggagggagtcgcaaagccgtgcctggtctcgtttcctcgctcgcctttcccctgcgccccctccctgcaccccctccacagcagatgggcagaaagaaaggggttcgggcatcacaacaatgcgccccctctccacagagagctctgcccccactccttcctcctctccctccccaatcatggcttcttggctggtggaagtctctttgctgggtttggggcgcctgtggacggttctgtgtgctttctacagagtcatatgttcgtgtgtgtgtgtgtgtgtgtgtgtgtgtgtgtgtctgtgtagtatatacctttcccgggtgtcctcgggactggagactgatggggttttgtgatttctttgcgcctccccccattacccccccatattctttttttttttttttttttggtgaagctggggaagggggcgttttctcctggttgggagaaaggagggaggaggggagagaagagggaagggtggaatagctctctgtattctgtatggggttctgttacagaaagggttaattataatattatctatacacatacataggcacatgtgtgtgtgtacatgagcaatttagttaaaggacagaaaaaggtacaccagggaagactggtgggagggaagaataaaatcctagctgctatctgaagggcttgtcaccaattgtccctctccctttccttttttgtgttttcttttttttctttctaagtgattggctttgtgtgtgtctatgtgtgtgtctttctttattccttgggcacctgcagcgttgattttcaaatgcacattttccttccagccaactggctcctagggtagggggaaagggaaaagggagggagggggagactgtccagggttggggggaaactgtctttgcctggacctgtctcctttggtgtggtattggtcattggcctctataaatttaaccgcctaatttcctcccccacctccctgtccccaccccccacacaccatgcacacacacacagaaggctttgagattctgcagagttggtccacctttcttaagcacaaaaccaagatacggtttatagttggcttatagtgtttcatgcacctgatgtgatggtttgaggttcctgaaggaaacttttccctttccatttttttttttgcgttattatggtattgtttcacatgctcagatgcaagctttgttaatgacagcttaaatctcacatacggtaactgtacaggtttagattgctggttctgtttatgtgtttgggtgtcagctttaaatatttttttcaaaggaaggcttcctatcagtgttgtccttttctgtgtgaactgcttttggtttgggctgctggtggtgatggtggtggatggtggccagtggttgggagtaagggaggtattggtggtggtggtggtggtgcaggtggtggtgatggtgatgttggtggtattggtggtggtcgtagattttgatgttagtgattgaatcagttactctctggttctagaattggtgctttattggccaaaattttgagtgttgaggttcaccacttattagaataattccaactgtggctttaagtttgccaaggtgggtggtggttaccatacagtgtgacctctttctgtctctctctcttgttttaaaataggagttgaaatggcagcatgttcctattagaacatgctgcttggaatttggttcatcattgctgtctgtggttgttttggaaagtacttgtaagagctggttacaagtggttctgctttctgcatggttatcctgagctcagcaatcaagaggggccactggattcccacgaacatttttggaggacaagtagggatatatgtgtgtgtgtatatatatatatatatatatgtgtgtgtgtgtgtgtgtgtgtgtgtgtgtgtgtgtgtgtgtgtgtgtgtgtatatctcacttatgcagttctttttgatggttttatttttaacaaataggtatttgactgggcttgtgatatatatctatttatttggcttttgcgagaaaatgtgctcattttaatttattttgtgcctaaaaaacttgtaattttaaaagcagaccaagttcaaaatgtacagttaataccatttctttctttgctctgattatttttttctgctacttttctagattaaaatccaggatattttggttagctgaatactatgtcaccttcatatctaaatatcatatgtctatctatgtgtaggtagaaaaggtctaacttttaaaaaagtttacttaaaattctgtagaaaaaattaaacatacagaagtagacagaacacccaacatccaggtttgagaactaccaactcatatctcatcttgtattttctatatttcatctatttcctctcccacatatgatctcatccatatttctcacacagaaatacttctgtatgaatccctaaaccataatgactccaaaaatcctcagaccccaccaaaacccgcacagcagtattatcacacttaaatgaatgtataacagttcactaatatcaaatatcctgtcagtgtttacattttaagaggcccaacttttgtagggaagccgtaaatacatttgtcagattaaaaacacacaatgggaaatagaaatcatcatatatgtctggttctttggcaaaaggtagttttgttggctgtgtgctatcacattgtgtccatgctggatggtcagaacatatgtgttagtgattgttaaattaaaacctctggtggtccactctattcagtctggaagatttattgaactatcaccaagaaatgtgagggcttattgggaacaggcaactaaactatgagcttggacaaaaatgtgtgttgggggagtgtttgtaaaagttaagaattattatagatgctaagagttatcctaaatacgtagtatgttttcgggccttgtgtttagaaatgaaatcagttgtcaccacatgtcattaaggctgctgctggtatgatattgtgaaaagaaaccagaaatattggcttgcacagctaggtttatagcttgtgccagttcagagcaatagctggcaaacagtggagtagcatactttgtgtgttaatggacacattatttgactccatgattttgttctgagtagctggttttggacttctcttttaaaaaagaggctcctaactcattatgaaatgtgctaatataaatagttccagttcaactgattttactgatactggagtaaaagtgataacttgcctaatgagaacctgcatttttatcttgattattttttgctgttgttggattcttttttgagatgatgaaagctttaggggtagtttgacaagtctcacattttataggcagtgaaactggctgaaacagtttcatattcacagggacacttctcttgagtaattgtgccctgaagttcaagtgtatgattatgaagagcctcatgatagaagataagagggtaggcgaggaggctaaagttgaacatggtgttcttttcattatgcagttgagaagcagaattaacgttggtatatagtatattgtttgtttggatattcttcgagtgacaggatgagagcaaaaatccccagataagatgtctagttttcttaaaaagtggcttttagcaaagtataaatgggaatgttggggtcctactaccatcagtgtgtcctgatgtgttagatagtgttggctttctgctatttgggttttttttctgtgttgtgtctattaggaagccacgtgagtaccatggctgaaaacttgactttgcaaatccattatttttcccctcattcctcttttgtgcactgggttcttagggcagcctccttttgtacagctgaccaagggaagctaagatgaaatttgtggaattagcagaaaagaggccaattggagctttataggcttatgaaagtaaaggaagactcatttctagtggttagagcatcaaaccaagactttgatgcggtcttcacttcctggctctgttttcagggcttcccccacacatcagtagcataagtgggctatacagaatttggtgtacttataacatgccatgttaataggctctcacaatttattatggtcaaatcactttagttgtttaaaaaacaacatgagtcacatgccttctgtcagtctgcagatatttatggagtgcttaatatgtacaaggcactaagaatatagagaaaccaaacataaatctagcgttttgagaaagtatgtagtttagttgataaagccagcacctatgaaataattttgaaacaggtacttgaatgcctgatatcaactaagcgccataggcttttagagacaggctagtgagataggctgaagtgttccagaaggcttcatgggtggggaatgggacctagaagggtgaagtgatttggatatatggggaaggagttggagctagggagagcattctaaaggaataatgaaggcacaggaacaagatgctacatggttaggacttgggggcaaggaaaggctggtggaaatgagtacaaaggtggtaagtaaagagtgcttgttagtggggcaggagacctgtggagacccacatgccaggcttggcctgcctaactagtgtggcctttgaaagttaactttctaaaagcatcatttcctttatccattagtggagaggtttaaactagtttagagtaaagcttctcaagctggaagggaacatagctttacaggatgttcataaattgttttttagtctgaaacagagtgatctaccgccaaatagtttctgaaacttgatgggctagacaaaattaaatggatgccatgttctgtcagaattaaaagtctattgtgtgaatgtgaattttgaatatcagagaaggcaatgtgttgtgcctaatttcctaaatctattttgaccacagagcacttttattctctgcattgtaatctataatccagtatgggaaatactagaaaggatccaaaaaagtccctccagatcttggaatctggtgatctctgagtctggggtgagtgggctgatggtagacgacttggaaaaccaggcacagaagcttgtagtcggtgcgtgggagctgcttcttaagcaggagtggcaaggggagtgaaagtgaggaagatgtaaacagtgagggagactagtccatgtcttttcctgctcccctttcctgcctgacatctgcctttttactgattgttaccaaccccaccaggaggtgaatattggtgagtggttctcattaatagctctttcagtgtgatgatactagcccaattctgatgccaccaagctgcccttcagccaatgttttatcctctttgtcccttctggtttcatatattgctgctctttggcaacctgtaaaaaaaggttggttgggaaaggaggttgacattgatgttaaaacaacgatttcaaattatctgcctttggcttgctgtatatgaagtggtagttcaaaaaagggtcagaaccgctcttttgctgttacatagccaggaaaagctgtggaactgtgtttctgttgcatttttcactttcttttttggaaaatttggccatgggactgtaaaataaatgggtcagttccagcatttgacttctgaaagtatgcatagctttaggatctgagaagggatgagagaatttggaggaaaggaagggtgtgaatagtgtgtgtggttatgaattcaagtattttactgtacttactgagtttcattattttactttataaggcagagcatcacttgaggagtatttatgtgagatgtggttgaacgttgtgatatgatgattccatgcagcttttgttaattgtggagattaactacttgcaccttttttttggaattagaatgtaaatgaatccgtgaatttaaaaaatgaattatgaggttaggaattgagcctttgatcctgagagtagtgttctgtagttctcactgttgaaaaagggttaagaaaacagaacagtaaacatgattcaaggagtgttgagggtgatagattctgagactcttctacaccacagttttatgtattatcaaagataaatggtgattatttagttttaaagaatgttaggattagaaatgaggtccccagatggacacaacaatagttgaggctagctattaggaataatttaggtctaagagctacgagatttggaagcctttggacgagaaggtctgtggcatttcgggtgtttgtgtatgtgtgcacgcacctgtgtgcacgcaaagggtgaaggatggtgggttagtggctttacattttattttattttacccctatcctgtatagtagtcataatatactaaatgcagcctaactttgtaaaagtgtttcatgctgtttttttcctcctcaagaagcaacttttttttttctttcagaattaggattaaacccaatatgctgcagatgtaggataaagaacctagtaatgggagagcaactgttaattttagaaagttctgaaaagattcaggtagatttgaaaacttagatcattgaagtttagaagagcaatatgataatgaatttggtaaaacttgagacaggagaagatcaaaaataattagtgagctggggcagaactgttttctcttatataatcagaacctgttccatgaatgtagacttttttcccctctgggaggtgaagaggacatagaatttaagactggtgagaccctaagtgtgtcttctttcttccaaatctgagctgtgttctccttcgtttcttctaacacaatagcagagtaatgatagtttctattatagctttgcatctgttggtatgcaattaatacatactgtgaggtcacaaagaataggccctttttatgctattagtatgaggaggggaggagtgagttttctagaatttgactgcccctgcttgtttaggaagaaactagacaagtacaggcttctgtgtcttagtcctgttcaggtctctgattccatccattgcaaggggctctggaccctgaaatcatatgaattggtgccttctttgaaggtgtttatttcatatattagtgtatgtggctctcttagggtccagttagattccccgctcacctgctgcccacctccctcctttcctccctttctctctccttcatatccttcttctttctctctcttcctttactgaggtagagctatcaaaattatgaatgctgttaataaaaggtaatgcatttaggacattgtgtatgaaacgcagaaattcaaaaatttttaaatttcattatttgaactgtgacaatctgcttgaggaactctaatttagctctctaaaggtgaattgcttgccacagttttcttggccattacagctcacttttctaatttctcagcttatgtctgaattctagttagtttgtttgccagagcaaaccttataaatgatcaactacatacaaatatttttaaaatgacttaactgtcattttagcttgcactatacctcacggtgccatacccccttgttacctctggagccctggaaaacccatgtgcagtaaaatggagtcacaagagaaaagcccacagtttgtaagtaatggaaaattgctaatgcaagttgggattcatttttggcaaaaagtctttaaattgcaagtattgtgtggctgctattaactgaagcacagcctgcaaatatagattgtgactcttggttacatgggtgaaatctgatattttctttcttttattttgtttttttgagacagtgtctttctttggttgcccaggctggagtgcagtggtatgctcatggctcactgcagccccaaccttcctgggctcaggtgatcttcccacctcaccctcccaagtgctgggactacaggtgcatgccagcatgcccagctaattatgtattttttgtagagatagagttttgccatgttgcccaggctggtttcaaactcctgggctcaagcaatccaccctcctcagcctcccacaatgctgggattacagacgtgaggcactgcacccggcaagaaatctgatattttcaaactgtggctaagttctaaacctgagactgagttttagtcattgccagggacaagttgtgatgacgcctgagggatctcattttccttgttgtccccacacctaccctcgtctgcagcacaaaatctcattttaagtttttgtaaagtttctgatggcagtaatattttagaacttaaaaggaggaattaagagattacagtcccatattataagtatttcttagttgttatgttgaagtagacttcttttttcttgttttcttctagatctctttgttcagttatactcgttggctaaaggttgctggttaaatgttgtttagcgaaatattctatagttaaaatctttacaaagaaaaaagtaagaatgaagatgtggatagcacaataattgaacattagattattacttgttttctagccacatgatagaaattgcagtgacttccacccattctgtctgtacatgttcagttggcaaagagaatgaaggtcctggaccgtgcttttctaagaaatgattttatatagttgacattatactttcactggagcaaaaagggaaacaagcatttgattagtgtgtcttactgcatattgtggtctgctccctcatttgttacggtggtcactatgattgcttgacaattacagttttgagattaatatgcagagctaaatctttaggaggtatcctaaagttaggacctaaactttttcatagcagccttttgatccattttattccagccattgctagttgatgtgctttctaagccgtgtggcatcagaggcacagatgttgtctttagtgatgtagttctacctctcattttgcaaatgaaaacaacagcccacaggggttaattgacctgttcaagatcacactgggagttagaggctctcactgttaccctatgaatctaggagtctgcttcttgtaagttagtactggggagtcccaaggattgggaaccttggaaggagattttttaaaaacaaaaagtcttactacaaatgtggatgagcacccatgattgtaaagcttcccatttcagctaagaaatgttctgatttacacaatatcaagaacctttaaaaagcgttgttctctccctgcgctctctcccagtgtatcaccctgaaattagttggcctttctctgtaggtacattcatcgtttttaaacactgcctcccacctcccttttataaggatgtaaaataaaaaaataaatattagggtggtttctcatcattgaatgtctagtggaaagataaaataattatttggaagtaagatgaccttaatgtggcccatgtaaaatttttaacataatttctttgtgtaaaatattttctttagcctagcaatctgtggaaactcagagcaacttcataacattggtagcaggatgtatggagtgagtgaactttggagtatagtggagttgaaggctcaacgaaaattttcttcgaggaaatacttaaaatattaaatccacatgacgtgttgactaaggcatcttgtctgttcattgctgaaccagaacatttataacaactgtttctcatgtgtatgtattcatagccattcatataatgaaaagaagttttcatgggattgtaataacatatcaagatggatgtaattaaaacagaagcagattgacaccctgaattaaatgtaaaccataaaccaggatacctgagcattgtgccttacatatttgctgtagggggcagtcagccaaatatgcaaataaaaagacattgatgaatcttcctgggtgtgtatgtggttgcagagaacccaactattttattaatcttttatcaagcattgtttagatttgcagcagccatggaatgtattaatttggcagaccaaatagcttaggaccagaaagtaggaaataataaagggaagacatgattgatacgctgtcctataaataacacatgcgactgacaaaggggctgagtaatctttagatctgtgcttcatttcattaatggagttgttaaaccaggatgtttgagttgaacttcaatcagagaggctctgcctcccatttaaaatgcaggcctacctctactcactctctggactgatatgttgacaaaattggtgtaaatcgaatttttgtaaattggatcaaatgcactaggggaatcttgctgtgaaaaatatgagtcctttttatcaactatagtactcctcctctctgcagggaggctgggattttggtggagtgagtctcttcagatgggcattgcttcctctgagacagtttcctgcacgtgttcccggtgctctgttccccgtgctcctggaagacagtgactgtgagatttgcattttttcttcaggttttatacctcacttggtcggtgcttccaggaataattggtggtgatttgaataagcccgcatcattcagatttcagagcttggttttcaagtgcttgctaaggagggctcccagctatgaatatggaatatgatttccatatctgttccattggggagtccaggcgtgtcataaccacttcagagtcatgattgtatcgagacaccctagctgtaatttttctatatgacagttcagttttaaaattgtaaagatgccaaaagcagggctgcattgttattagggaagtcagtgacatctgttatatcttgttaaccaggggaggaaaatgctttaatcaaaacatctaattataccctatgaactgatgaaatatcctttgctaaatttttggaattggccttaatggaagaagctggcctctatcagaactgtgaagtaaatttaccctttttatttggaaaaatatttattcctaaccatagtgacataagggtattttaattgtatcagattacttttatatgtctgttgaaaatagttatttttcagaagttgttcaagccagcatcacgtttttgtttttgtgctctctgactcccttagcatatgaggcccccagagggagtttgtatttccagatgtgagcctaggaggatatgtggtgtcttagagccacctggggagggagcaaatgataattgcaggtgagatgcagggggataattcagcctgtgtgctgggaggtgcgatttcacacctgaatgttgagacctgctgtgttagacacttgtgttgttttaaaatgttttattactctaatatagaaatggaccagattgttccaggtcaccttcagttgaaagaatataaatgtttttaaatattgaagtataatgtgattccagaaatggttcctgtgtttaaaagtagttttacatatatctgaaagcattaaaatctgtttaactcagcatgtctatactgcctctacctctgttgatcattttttaaaaattgtaggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaattgtaaattattttggcaatgtggctttccactttgaatcattcaagcttcaaactgtccagtaaaactatccttttatctatatttcaaaactagaattaattttaactatagctgttagttgtttccagaatcactgacgatgattataatattaatgatagtacattattgatagtcttaatgctgggatatggattatttctgagaaatgattaggtctgagaaatgctttatttcttagttttgggggtatttcatctttctgacatggttttcccatgtatggagatcttggggcccacctgaaggagttttttgaagtgttgactgtgacactatgggcttcatgtttactttgggatctggtgggaagttcaagtgctattaatttttccttggtctgttttatgctttgtaatggctttctgtgtgttttttgggagttaagactagaaccttggaaaagagagagccagagttttctccctatatttctattttaaaacttttttttttttagacatgttctcgctctgttgcccaggctggagtacagtggcgcagtcatggctcactgcagcctcgacctcctgggctgaagtgatcttctcacctcagcctcctgagtagctgggaccacaggcgcgtctcaccacgcctggctaatttattatttgtagagacggagtcttcctatgttgcttaggctggtcttgacctcctgggcttaagcgatcctcccatcttggcctctcaaaagtgctgggattataggcatgagccactgcgcagcattttatttcttatgtattgttattctctctgtattctctgcctaaatgtaacccctgcactctttctgtatatatccttctggggatatttgaggctttcagaactgtttctttcttcactcagtaatctatgcatagtaggtactcagtcattgcttatttacagttgacaacaattccatgaaaagaaatttttgaagagggagctgctatttactattcgccttgtgccaggcattgtgctagcaattttgcattcgttatcccattgacgcaccccatgaaaaaaagaataataatctctgtttgatagttgaagaaactgaagcacagagccgttaaatcaacttggccaggatcagtataagagaggcaagaaatgtagcagtttttgcctgacttgaaagcttgggctccttatccctttactcattttcatacagatgcattttgtgaaagatggccacatggtctctagtagaccacatttgttcattgttgtgctgaaaattgttacaaaggattttctaggtataataataggatttagggaggggagagtacttattgtccaggtctttatttcctttgaaaagttggagcttacagttaggttgctgccactcatacaatatatctgtaacatattcgttgttgttttttctctgtttcactgtttctccctgttataaaatctgaccttttcccgggttatactactcaggtagattttaaaccattgtcaaaggcaaggattcaggctgatgatatagagggttattgtatgtcagtgtctgttctaaacccttgcactcatttatctcactgaattctaaaagtagctctctggaacacaaatgtaaaattggaatgaggactagcatgccctcacagattactgtgcatataagcttatattctgctatagattctgaagtattttgtcttgtctgcttttaaactgttctaggaagcagcacttgtcttgagaatctatttcacaataaaagagaccttgttttgagggctaggtgtatttttttaaaatctattaggaactctattctttctggtaaaagaccacactaaatagctctttttgcttttcttgatatctgtatcttgaagataccaggtgacaaatagtccattgatttcctctgtcattgtttcctttcattattctaagcagatttgcaaattgttctctcccatttcccattccaccctgttaaggtttgtttatgctacaaagagtatgctaatgaatataactgttagatttacttcttaaggaaatcccaactgcatttagagtactgtacatttttgagaaggctcctcctcatttcccctcggctaagatgggcctcctcacaggtcattctctgggacttcacgattcagaactggtccattaccattcatttacaaggaatgggggttagtataaagatacacacacagaataccctcactgggcctgaattttctaaagatttctagatgaatatgaagatcagtcaagttacacacttctctcaagagtcactctccgtctctttctttctttctttctttctttctttctttctttctttctttctttctttttttaagagatgggatctcactctgtttcccaggctggagtgcagcagtaatcatagctcactgcatcctgaaactcctggcctcaagcgatcctcctgctgcagcctcctgaggacctgttggtgtgtgtcaccatgcctggctaattttttaatttttttttgtagagacagggtcttgctgtgttgcccaggcattctcaaactcctgggctcaagtgatcctcctgcctcagcctcccaggtagctgggactgcaggtgtgaaccactacccctgctaattttttttggaggggtagaaatggggtcttgcaatgttacccaggctgatctagaactcctggtctcaagtgcttctcctgccttcacctcccagaatgctgggattacaggtgtgagccactgcgcccatctgagtgtccgtatgaagagaggtggcagtttcttcttggaatcaccatgctctgagacacacagtcttgcctttctctctccaactgtctcaataaacacaattgcccctttgtatgtcccgaatggaaataccatactagaattctattttacagattgtaattgttggggagacccaagtcaaaacatgttctttgaaatttaaatataactgtaaaaggaaccacaaagtctagggctttaaaggtgatcttttatgctttgattttatgtatttgtaaaatacaagttctatattgactctagggcctgtctcagattgtaaacccttagatagtaactgtgtctttttaactgttccttgtatccttccttgcccctctggtggtctataatacccctgttgtgatgattttgattaaagaaacatagtgtgaagatgggctgtcagggatgggtgtcagtttcacttcagggtagtgggtgccatctattttctgattacaggtgaacattactttagcattatttttttttgagacagagtcttgctctatcgcccaggctggagtgcagtggcatgatcttggcctactgcaacctctgccttctgggtttaagcgattctcctgcctcagcctcccgagtagctgggattacaggtgcccaccaccacacctggctaatttttgtatttttagtagagacaggatttctccatgttggccaggttggtctcgaactcctgacctcaggtgatctgcctgcctcagcctcccaaagtgctgggattataggtgtgagccactgcatccggcctattttagcattcttgttgtagatttctacatctgctgcccatatttcagctgtactcttattttgtttagtatggtgtacctgggattagggacagacaaatatgtatgctcagcctgatttggaaattacattgttgaaatacagcccatatggccattgtaaaatggttagtgctgcatataattgcctttccaatgatgtgctttgtcattacttccatcttccaagaagcactcctgtagcatgctgacagcaatagcatcattagaaaacatatggacatgcaaaggcattaaatcgtctttagtttaaggattagattacagtgttagaggataggtcaccaggcttgcaatcgatgactcttgcttagttcagcactgctagactggatgatagagatttgcaaaagtcctatttacttgtctgctgagtgtatttcatatcttccctgcaattgtgagaaggtcctttagctgtgtataagcctctatcacagtattgcagccagttggcttctcaggagtgtttttttcaactattcatgtcctgtgcagaattcttttctaggatgctccctcaacctctgtttttctgaatgtgagcccaaagcaggctaagccaggaattattttatttgggggtcatttagatataaaaagagactaagtggtggagtcaagaaagtaccaggtggctgccatgttgcccaaatatttcctcccttgtacagcatctatctccacatgggtctcaagtccacctcccttcttcctttcccctcttagaagcaatgggattattgcagcctagaggctcagtggtaggtcctagaggccgagggaccatgtgatagagcctggaaagagaccaccccctgaatcctgccctttgtagttggatgttttttccccccacaactagataggtttactatctggctgtaaatattctagggatgcaacagttgtgggacatggtatgatttgaattttcagggtcctttttgtagttgccagtgaatagtaagtgaaatcgcagaatggaacatcattcatcaaatttaatatttcttctttggagtttaacagaaataatgtggatttggggactttcagagtgataagggactttggagatcctcatgggcagtggttttgggtacctcagggtacgctgagtcatttgaggggagatcctgactttattaaatcagaactccacctttacctgtcttctatatttatacttatgtattaggattacattctctttgagaagaaaaaagtgtctggatttgtttattctttcattcaaaaaaaatttattgacagcttctgtgtgctaggcaggcagtactccaggcacaggaagtaccatagtaaattagaaaaaatagatatctattttaatggagtttatattctaacaaaggatggggggacatactgtaaataaacaaatatataatatgttgggaggtgacaggggattttataaagcagggtaaagcaagagtgagaacttagcacagcaggtcctcaaataacattgattcttttcattataatgttgatgagaaaaaaaattgattcctggccagggcaactgtgtggagtttgcaccatctcctcatgtatggtaaaattgctttcattatgcatcgtgtcacgtatttaactgaggactcacttgtatgtgtatgcttacgtgatgctttatccagggtgggttagataaggctcctctgaggaggtgatatttgagcagaaacttgaaggaagcgagggagcaagaaatacagataacccggaggagagctttcaaggaaaggggagaacaagtgtaaaggctttgaggaagaaggagtggcatggtatgtgagcaacacaggagatgttggcggctggaacaaagccattgaggaggggacagagagtggggaggggcctgcagtcactttaactgagtgacgccagaagcttagaaacagcagaaagcaactgtccaaagccctcatttcccaactgaaagtgtttttgaatttccccaaggtcacccagctgatgtataaacaagagcacatctggagctcacgttatattcttttaaagtagcttctcattgtaccttgtgccaccactccaggtcttaggagacatggggcatctttttggagacaagatttgtgtctcctttcctgttagtgggtatggctcctccaagagatgtgcttcaagactctacagaattccagtgcccagtcatcacaaagtgggaaacggctttgccagtgccagaatcaccaccatttggggaattattttaaccacaatggctcatgtttatcacaggcttactgcttgtgatgtttgttgtacccagagctttacatgcattaacacatctaaccctcacaacaactctgtataataggtcacattatcattattttagagatgaggaaattgaggtgcagagaagttaagtaatttctgtatggtcatgcagatagagttgtagagttgggatttgaatttagactatttgcttcagggcctgcactgagcctctgacaaagaggagggggatgagcttgtctctagataaactaattggaatatgctcccctcgcctccattttaagatggttctaggtagggcctagccttgggagtaataccaacttgtcacaacccacttctgtgactccaggtgttagtttgtgtagaggatttcacagccagtctggctcagtactggcaactttgctgattttaggtggattcctgattcagcaggtacctttggtctttctgagctgagtttgactggagcgtttttcaagacctgcatgagagtgtgttacggaatacaggccagtgttttcaagtcagcggacccagttttagctggtctgtcttttttagccccagtgaagtaaaagccccagacaccaccagtgcccataatccataggaatgtaaaatcatctttttagtactggtgcttttgaggaccagtacactatgtgcttgctttaaatttgtctaaaaatgtatgcatatgtagatatgtgtatatatgactatgaaatattttctaggtatggaaaagtataaagcataacatagccaacacccatgtacccaccaccaactttaaaaaaccttatgactttactgtaattttcttaaaattgtaggttatttttagtgagcaggaaccacagtcaaccgtaagttttagagtccaggaggctcaaacctggccacacattagaataccctggggataccctggggagctttaaaaaagtccttgtacctctgggagggtgcaggaagcccccacctctatcatcagaattttaaaaagctccccaaggcgaggattctatcatgcagtcagggtaagagacctgctgtttggagggttgtgtttggtttttcttcactgggttctcagatgcctggtaccaagccatgtgtggtactcctggactttatatttcattttcttaaagcattttttaatgtggttctactttcaagattctggagggtaatgtcctggggagttcctctccttagactcttccctcttcagcaccttatgaggcaagctgcggatatatttacatattcattacaaagcataagcatcaggaacttagagagtaggagtgaggcattagagaggggactaagaaattcagaagtattgggagctactgtctgttgaaagtgtttgagatgagtgaaagttatagcattaccttggaagtcagggggatgcagggttacatttagaaaacctggagtcacacataccttcacaggaaggctctgagctgtgggatggtagttgagggcctttttggtctacatcacaggtttatcagtgaaatatgtggtaagatgtacaaataagatgtgccccaccaccagaatgatcagttctgtgtggacacgtccgtgactgtaccctctttcagaagtgctatcaattatgtgttatgtgtggcctgattatcctctgtgggccttggctccatgcagcacctccatccccgtctgcccactcattcattcaacaaatagttgctgagtttctcttctctatgccaggttctgttctaggcacttgggataaaaacagtgaactaaacaaagcttctgccctcaaggaatgacattctggggatgtgggggagaggtgggtgagtgggtggtgttacattctggtgtcgcattgttttttgatgtgtctaacacagaaaaagatgtgtaactgtaatcctcctttagaaagctctaggggagccatttggcaggtagggaagtgttttgcctaatttggcttaaattatgattttttgattctgaggattttgattacaaatgccttcatgaatctacttcttcaagagaaattaagtgctgagacattaaagcttccagggaccttttgaattggttggattttattagcagcttaaaatgagcatgacatacagtaaggttcaagcttaggggagatgctgaagaaataaggatacttgattttctttccacttgaagtggaatccactaatccatctgtgctcataaatttgagagaaggagggcggaaaacgaaagtttatttctagggctctctactgggcaaggctatcaggttaccttcattgaaaagacttaatcagaagtgaaacttaaatctgttacagtcttccacagctgtccagggaattgggcactgatgaataccgtcagatggacccctgaatagagggaatgccttagaggtcatgtttggagttagtcaataaaatggatctcgagaagaaaatagaaagtttgagggaaaaaaattactggaaaagaaatcttaaagcttttgggttagatgttagatggatgacgaaaacagtgggtgatatgatttcctttctggattaccatcttcatcagatattgttgtcgactacagaaaaaatattcccagcacgtaaggactctttatacctgtgagctcttaaaaagaatcatctaaaatactaaaaaagcaagaatatgttgtttcactagcttttgattcctaaagtagattttgacttccgggtgtgggaaggtgggtggaaaatgagtttttgttaatattcaaaggcatgaaaacatttttaccagtttatgttttcctggtgcatttagaaatctgtggatccttggggatggtgtatgcaggcaaatagagaatccagtacttgtgaatctgcctgaatccacaggtttgggaataagggcagggacttgagggttcacagatgtgaaggttgtacacagaactcatgcagagagatacaagatctttttgttccccctttgattagaaagaataggacatgaaagtacttaattgtcaacttcgtcttcaccataagcccagtattgatgcaaaaatgataataataatgagaacaagcatttattgagtattgggtattctaattgcttaaatcaactcatgtaattctcacagagtggttctatgaggttggtgccgttttgattcctgttttaaaggagaggaaacaggcacatagagtttacacccaaggacgagtgtgtcagtggtggagcctatacattctggctccagaacccgacttgaaccactacataagggaactaaataaatgcttcttaagagttttattctgatgttgcttttactgggactttcactcttttttctacccaacccaccccacccctaccccactcgcctccactttatctttggatgtcttcagaatctataatatatcttaagcttgcaccttattacagatgagaaaatagagagctataaaattatgttatataattgttctgtatgacctagtgaatctttggtagaacagggatgtggaacccaggttttctaatatttaggtcactgctttttctcactgcactgtatggcttccattaaaaatattttaaactaactgaactaaaaatttataaacttaatttgtgtcactcatacttctgtggatgaactacattaaaataactaggtgctgtgagattttgctctagggaggagggtggtagacattttaggagctaacatttgcctctggggttatttgacctcctcctgaggatgtctttctaatctttggtaggcgtacttaaaagtgaggagaaagtatttgaggaaatacaagagccattcgcagactttagtatgatctgtgggtttatggaagggcttttttttttctttctttcttcatttaggccttttttactttaacctccagtggggacacaactaacttaaatcttaaaaacaaataaacaaacaaaaaccctaaatacaagccttctttcgctattgtttggcaaataagatttcacaagagggtagaaagaactgccttgattcttggtgttttagactttcctatagtctagttttttgtttttgtttgttttttcttttggtcctgtgattccttttgttgttacctgtttccttggctaatgctttgtttaaaaacaagtgctctggtattccaaaacaaatttccagcaggcttcccgattgtgttctcagataaaagaccccagggtagtgctttaacttgaattttggttgcctatgcatgcctgagagcaaaattcagtttactaggtggcttccaacccagattaatatggttatatctaaaacgagggaatatacatttgaaacaggaaatgtggattggatttaccctttcaaagagccctaatgtgaatgtaatgagtagagttttgtctggggttagatactgtgggctccagtttgtttttgagtttttagctgaatgaatgactttagtcctgtcattaaacctctggaaatttaaactttcaacaatgtaataatgataatgaaaatagggaaaggctcctagactgtgctgtggaaaaacacatgttcagattttactgaagacccagaatcccatgtggccacagataatttgatttcacagtttctatttctagatatacaggatggggttgccagcagaagttacatagtgataataacatatcagcttcctttttagggaagatattgtaattgtgagaaaaatattcagaaaagccttggccaaatattgtttgtagttggtaagagaatactcagttattaaagcttctgcgaaccttttccaaataattacactttttccctaaaggaatcctcccacctcagcctcctaagtagttgggaccacaggtgctcattaccacacctggatgggtggatggatggagatatatatatatttgtagagacggagtctccttatgttgcctaggctgtgttacattttttgtcacacatgttgggtatggagaatttggagtaggtagtttcagatttgcacatcacaagttcttgccttgtgcagtggtttctaaaccgagttgcatatctatactccatggtaacttggtaaacatactgattcctggaccctgtgtctgatctactaaacattaatccctgctctgtggctctggaacattagtgttttgttttctttttggggtttgtgacagggggacaaggtctcgttctgtcacccaggctggaatgtagtgggacagtcatgactcactgcagtctcaaactcctgggctcaagcagttctcctgccttagcctcccaaaaagctgggactaccaccaccacgcccagcaatttttttttttttttttttttttttgcaggggtagagacagggtttcaccatgttgcccaggctggtcttgaactcctgggctcaaggaatctagctgcctgggcctctcacagtgctgggattatgggtgtgagacactgtgcctggcctggaacattagggttttttgtttgtttgtttgtttgtttttaacatcaagttccagtatagaagtttcagaaacactatttcttaaaatatttttgagtgttttcctggggcagtggtaatggtgatggtttacaataatttatttctatgctatgtaacttttctgaaaagaaaacattcctgtgtatttggttttaaaaccttatttactgtaaaatagaacacatcctggaaaaagtgtagtgtacagctcaatgaatgatccaatgaatgatcacaaagtgaatacccaggtaaccagtactcaggtaaagaaatagaacattgccccctccccacaaaaaatgatttttattagattcctcaaattttcttttctattcctcctcaaatcccaagaaattagagatataagtaaaggttgatgaaacaatataataaggtgtaagtgaaaaaagcattgtcttttggtaggtggtgtttcttaattactcttttcagtaagtttttggtgatgttaagtttgtgttgtttatctatgttttgattcagccttaagccagttcttgacagtgactgtctattaatgctcacagctgatattaagattacgttctaagatctatcttttctgcaatctgtttcactgaaaatattctcatgatagttttgaaaatgcgtaaggacagattatcttctgactctaataaacaagtgagtcttgtcattactgtccaggtaacttaggaaacctgtctcagtagccaggtatctttatctggtacatgataaaatgtggtttcttagttttttttaaaaaaagttccttcctcctctctatccacccagaataatctctcctccattccaacccaatcagaacatttaaagccctgatggtttttcttttttccactgaagaatcattcaattcttagtgagagaaggtctagctgtattaaatagcaagcttgcccattttctttggaaagggatgctcatggtaaaaggacctcaagcaaaccctgcacttaagctgtgtgcaagtggagggagagagctgtctgcagccacctgccagcagctacacatctgtgctctgctagcaagcatgtgggctctgtggatgtgagagctgctccctttcccctctctgcctcatgctcccccatcttagtgatcgccactatcaactaaacaggtgacaagactccaatcaccctgctctgaatggctctccatcttcccaaaagtataccagaggcctgttttgtttcagtacattgattaaataaatattcctgtgtgcacaaaggaactgaaatctgttatggcactctgcagttatctgtccattaatagtggagaaactactgccagttttctcccctcggtgcccccgccccccaccccctttcttgtcactaccacgcagattctcaaaggtgccagtaacagataaattatctgacctctgctttcaggcttgtgtgaagcgggaggagtggtgtcatgctctttggtgaggcatgccgttggggcagtgcccaagtgtatggataataggagagcccgaatgatttagattagaagatgctttcttgctttggggttgtgggacctttgtctctccccttcaattcttagcagaagcggactcagaaaggtctttcaaattagcttgcctctcttttataggaaaagggtgcttctggccctgaagtagttctgtgtgtctactgtcagatgtggaagccacaaagtgcctgtgaaacttggtcccttgcgtttatttacaagtttctttcaaatggcagtggcaggaaggatctttaccatttgggcagatagccctagtggttgatgggagggcttggtggaagggcaggctttgtgaaagatccaagtgtggaatggtaggaattctagccatggtggtgctgactggtttcctttcttttttggcggggcaggggctggggtggagtgttggttaaaagaacacctagataaaaaacatgacggatttcgaaagtgttatttgggctgcgcacggtggctcatacctgtaatcccaatactttgggaggctgaggctggaggatcccttgagtccaggggtttgagaccagcctgggaaaaacagtgagaccctgttctataaaaaatttaaaaattagctggatgtggtggcttacaatggtagtcctgtctactcgggaggctgaggcagtaggatcacctgagcccaggagattgaagctgcagtaagctgggattgcccactgtactccaacccgggtgccagagtggggctctgtctcaaagaagaaaagaaaagaaaaagacagggaagggaaagggaaggagaagaaagaatgacaatggaacataggaaattagggttgtagagaagactctatgaacattattgtggtgtgaaggaatggcatgcagagataagtgtgatggaagggaggtgttgaaatgtttacagctcctaacatctaccaccaaggagggggcacccctttgacagaaacgagagggtgttcctgagtagttgtgacattaaaaaaaattgcagggaaccttgtagctgcatggatggcagagacacataagtagggaaaaatgttggaataggtaaagtgaaatctcttagtgtgtgtgtcttccaactgactgtgggtaattagttggaaatgacattaacctgagcttaattgtaattttgcatagtaacaacataccagctgttcactgtattctttcctggaggtgcgatttaattattattatttttttttgctatcttttaagctccaattttctgttatgttttacttaaaccccgcctggttgccgtgtccacagtccccacagtttagcagtaatgtcatttttgttgctttcatgcccactgtgtgctgagggcttgggatgctcttgattttgctaatgacttggatttataaagggccacattggaaggtcactgagaagcatgggtgattggaaaccttgtgttttgggctcttccacaaggttttagtttattatataaatcatatgcataattctaggcctatcagaggtgctcaaagtatcaagtgaacaagctgaaagagaagttaattactgaacagtgattgttctgatataaccaattattggatcattaaatgtttattaccttttatatgctcctttcccccataagggcagtttcttttttaagtcattaaaacagaaatgggatcttaaaaaaattctgcttaaaaaatttccacgagactgaagtattaaaaaggtcttgtgtgatctgacagctaaatagcctgtttttctttggtctgttgaattagtaattaatgaaatgtattgcctgagcagagaaaataagattagttttgtttaggaagaaaacaaaagcaaaacattaacccccaaatgcaggttaatattaaagtgcagtataagaaatagaaataaaacagtcttcttgaatgataagatgcctaatggtaacatttgtttcattcattcattcgtcactttcttgagcaccaacattatgtttagaaggaatgggtttatgtaaatacagaggaggcaaggtgccctgtccccaaagacacatgggttagcagagcagttaaaccagacactttaggcggccaggcacagtggctcacacctgtaatcccagcactttgggaggctaaggtgggcggatccctgaggttgggagttgaaaaccagcctggccaacatggagaaaccctgtctctattaaaaatacaaaattagccaggcgtggtggcacatgcttgtaatcccagctacttgggaggccgaggcaggagaaacacttgaacccaggaggcggaggttgcggtgaactgagatcacgccattgcactccaacctggacaacaagagtgaaacgccgtctcaaaaaaaccccaaaaaaacaaacaaaaaaaaacaataaaaaaactcagacactttagtagctactgttgcaatgtagaaagtggtaggataataggtacaggggcatttctttggggaggagtggttatgaagacaggttacttctggaggctgaggcatcctgtggattaagagtaggggagagcatggttatgaagatgaatcttgctttttgaggtcacggtgtcctgtggattgagtagaagccccattacttgggttcacagcccagctttgccactacctagctgtgtgaccatttatctcagtttccttgtgtataaaatggaataatagtaatgcaaccctcacaggtttgaggattaaatgagttattatatgtgaagtgcatataacagtttacagcacataatgaacattataatcttaggttgtggttatgtcatttttgtgggataatgtgatagaacttcttaggggagattgcatttgattgaatgatgaggagcggaaagatgtttcaggcatttcttgtattgtcccatgtagccacatacctaatttataatgcctgcagtaatgtgtcggtaatgtgtgcttatgtagtgccattgtcaaaagattacaaagggcatttacagacgtttattctaagaacagtcccctgaaacgagatggtttatgcatattcttctgaagtgtgagagggtgcagagcaagcccatcctgttcttccattgaggtgtgcttggagcctgtgtttgttgtgggtaatttagactcacagagagaggaaacttttaaatcttttaaattatatcttaaattcttaagttatatttgcaaacaaatgtggtaaatagattttaaaaatgttttctgtagcttctagcaatagtggaacttgtttattcctgaggtaccagatcataggcagttgaatttagaggaagtttataataatgaacatttgtcgtaactgtgaggttgccactctgtattagttttcacactgctaaaaagaaattcctgaaactgggtaattttataaagaaaagaggtttaattggctcatcattccacaggctgtacaggaagcatggctggggaggcctcaggaaacttacatggtgaaagttgaaggggaagcaggcgtgtcttcatatggctagagcaggagaaagggagagggggagatgccacacttttaaacaagcagatctcatgagaactctttcacgagaacagcagcaaatggagaaatctgtcccccaggatccagtcacctcctaccaggccccacttccaacattaggggttacaattcaacatgagatttgggagggatacagacccaaactatatcttattatcctcattttacagtgaggaaaccgaggcactgagatgttcaggagtgttgctgaaatcaaaaagaagtgttgacccaggatctaaggtctttattgcatttgcgtaaaccatttcatttgatttgtgtgttttacaataaccctttgagaaaggtcagtcagctgctacgtgcattttgggaagtatcgtttatgagaagttggtggggcatcacagtgagcttagcatggactgaaaattttggggtggctgttgtatacccttttgctacttcaagcaagacacttttgggcctcaagatctataaaataacagagtttggaggaaacattgagtctgtaaactatgaaattcttgtgtagcttggagtgagacccatgtgggaatctttggcagccaccgtttaccaccttaacttttctgagcatgttttattattggtaatatggagctgtggtactccctttcttcagggctgttttgaacataatgcttataaaatacctgacagaccttgctagctctcagccaacggaggtgggattcttgttaattgtttcaaactaggggtcatacaggtagctgagcctgggtgagaagtccagcttcttaactcctctggggctggttctcttcagcacccaagccatattgctggggataaggaagacattttaatgagatgagccccaacttctcattagaagctgcagtcctgattctttctctagatcctatcaggttgccagttgatccagtaagtaatgtagtaaatgtaatggatccagtaaagagtttggggttttcatggagtaatttcctaaaatcaccgcagtcagtagcctgtgagccacatgagggcaggggacttgctctctgtggtgttcaccttgtataatgcaaggtgatgggacagctggcacatagttcggagtctggcagtatttattttgtgaaggaaggaaggaatgaacaacctcagtgagctgtagaaaatggtatgagaaagggaacaggatttttaaaatttcagttttgtgggacagaggaaattgaggcactgaatcaggcaggttatgcccagtctctgtggtcaccaggccttaaaattgggcataatttatacccttgaagatgttgcatggcaataccttctggtgggtggatcacctgaggtcaggagttcgagaccagcctggccaacatggaggggaaaccctgtctctactaaaatacaaaaattagccaggcgtagtggtgcacacctataatcccatctactctggaggctgagacaggagaatggcttgaactctggaggcggaggttgcagtgagccgagatcgtgccacttcactccagcctaggtgacagagcaagactctgtctcaaaacaaaaaccaaaaaacatatttctattgtgaaacaaaattttatccatgtcaggaatttcctctgaactagagtatgttcattcctcttttgtgatttgagtctgtgggagtcggaacttgtcaggaagacttagtgtagctgtgcttctaaggatgtgctattctcacaggcagccgtgctaaccatcttgctgtaaactagccacgagtaaacgtctggttgtgaatcacagcgtgacctttcagggaaaacaaaacaagcaaaccaccaaacacatgaatcagattttctttagtatcaggattgtaaagtctggtatttaacagtttgtcaggcccacttggagcagttgagacaacttcctttctctgtttttgtttgttcaagatgtggaagtgtatatccttctttagcaacatattaggataaaaactttaaagttttcttccactgagttaaactatattagttttcctaactgtcatggactttaaacaattaaagattcctggttaccactcaagacctactgaatcagtctcttggagtgggacccagaaatctattctgaagagcaccctaagtgattctatggttaatcagatttggaagccactgagatacagaatgataatattgtattttctatccacccatttattcttttttttttccttctctgtggtccgaatatccatttgttcttactcatttatccacgtcttgagtagattagaattgattacctatagggcattggtcattttaagaactaggcgtagaaacaagaggtagaacacaatgcctgccccatggggttcacaggtggtctcagaagtttttaactttgggttgagtgttaaaggattcacatacttcccaaaagccaggagcagaagattttgtgtacacacttttttttttttgttttaagctttcatcagattctccaaggggtcagtgacccataaaaggttaagaaccaaggtcttgtgcttgcacagctgttctggaaaaagtagaagagggcagtgtttctgttgccacttaagatgtttttgaccttttgagaggcaacagcggtttgaggactgtacctgttttctgtcctacttaaaatatttaaaaagaagaaaaaatagtttaacatctgggtcagggtcagaacaagaccaagggatatggaaaatagttatttcgtgaactgcatcacatttaatgttaaagagctgctgacagccaaacagcctggtggttagcgtgatggaggaacttcttaagctggatagcataggcaaggttcattccagttttcttacagtatataattagccaaattatggataacaattttcaccccatggatatacataaagactaattgtcttatttttgttccattttagccccagcatgtccattgaattgcttaattccaaaataactttgccagccgtacagctgatacattcttctttatcttctaaaatccccaaataacactgttcatagcaaaacagagttggatattaagaaagaacatctttaactgctgtggaaagtgtttactttgtaaaacactagaaccttgtatgtataatgttcttatccctaaggataactttataattgaatttcaattaaggatgttctcttccttttcctcctcctcttctctctaagttgtactcattgaattcatgtttcaatggggaacaaaaatttttcaaatattgttgttctggtaatgctgcattttaggatctggagagggcagtcagtgggattaaatgttatcaaataggttaaattatttggccatttactttggtatagttcctctggagctcaggaggatgttagaggtctttgttgtcagtgaaatcttgtaaatgtatttttaggctgttcaaatgtctggatcacctattttgaacttttgcatataccaccttacattacttatttttataaagtggacattttatctttataaggttttgccttgctggacagtgattatgtgttctaggtctttatagctttgccattacccggcatactgagcacataacagacactcaataaatatttgattaattggatatgttgattgggtacccaagaaaccagaagatgaaataagtctggagttagaacttgatacatgcttagaaaggtaggaacgtaaaagtggattatgaggtctatctcttaggctgacgtgctctcctttctccttccccatccctctccaccccctctcctcccttctctcttccatcctgcctctcctctccctccccctctcccctctcccctctcccctctgccttctcccctctcccctcttccctctctgttttctttctctttcctttccctttctctttccttaattttcttttctttctgttcatatataggtagtagagccagctcacgtttgctagttctttaaaaatcttaagtatttagaattccacagttacaagaattttatggtagagccacaacactaagttttcatttggaaaatgttaaatgtagtgaaccttgagagaggtttttattagttattgcttttatttatttttaaaataagtttcattgtgtatttgtaagatatataagattataggatgcatagagatagtaaaaaggttactatatatagtgaagcaaattaacatattcatcaccttacataggcaagagcagctaaaatctactcatttagcattaatcccaaatacagtacaattttattacctttagtcctcatgttgtacattaaatctctagacctgttcatcctacatctcctccatttccttcctacccctagtaaccactgttttgttctctgtctctgaatatttgaaaaaaatttttaagattccatatataagtgagatcatgcaatatttttttttctgtgtctggtttatttcacttagtacagtgtccttcaggctcatccacatttgtggcaaatggtaagattgagtttttttaagggctcaataatattcatacacacacacacccacccacacacacacaccccccacagtttatccatttgcctgtcgacagatgcttaggttgtctccatatcttatgaataatccttcagtgaacatgggagtgcagatatctttataagggggagatttcatttcttttgggtaaatgcccagaagagagattgctgggtcatatggaagttctatttttaatttctttagaaacctccatactatttttcacaatggctgtatcaaactacattcccaccaaccgtatacaagagttccttttctccactctttccaacatttgttatctttttactttttgatgtaagagctgtcctaatgggtgtgtagtggtatctcatgaaatggcattgatttgcatttccctgatgagtaatgatgttgagcaccttttcatatgtctattggcagttttatgttttctttggaaaaatgtctattcaggtcttttacccatttcaaaatcagattatttgtttttctactattgagttttgtgagttctttatacactttgcatattaactccttatcagatctagtttgcaaatattgtcttccaatttgtaggctgccatttcattggttatttcttttgctgtgcagaagccttttagtttgctgcagccccatatgtttagttttgcttttgtggtctgagcttttgttatgttatccaaaaaaatcattgccaagacaaagtccaggagtttttcccctgtattctcttctaggagttttattgtttctcgttagttagtgcttttaagaaggaaggaggcctcaccagacttgattattattttttttttttgagacggagtctcgctctgtggcccaggtgggagtgcagtggcgcaatctcggctcactgcaagctccgcctcccgggttcacgccattctcctgcctcagcctcccgagtagctgggactacaggcgcccgccatcacgcccggctaatttttttgtatttttagtagagacagggtttcaccgtgttagccaggatggtctcgatctcctgacctcgtgatccgcccgcctcggcctcccaaagtgctgggattacaagcgtgagccaccgcgcccggcccagacttgattattaaaagacatctgctactcaaatagatgccacccttaatctgtcctaatcaagtaaaatcttgttagttatatttgggtagaggaaatattgtaggctaatgaacagtggctgtcaacagttatcttgaaaatctagacttgtagccttgaaggagagggacccgaactgtgaagagatttgtcactaaccatgctatattggatgtaaacctgggagtggttacaggaggtggcttagggtaatatgtgctggcatctttaagtatttcgggaagagggatttagatccaagtggtcactcctactcccattggagacgcaatttggcattgtgtataaaagaagagtttttctaatagtgctgtgttagggtcctgaattccagctgctgccattcaaacaggctcacttaacactcacctggattattctaatgggaattcaaactgggtattggtgacctttgagggctctccctcccaaagagactatgagtgtgtgatttttcagggcaaaatgttctaagtaaatcaagtcatggttcaaagtctagatccgctccttgtaattttttttttttctttttaaagaactcagtcttgggtgctgtttacttcatatttaagcccatggtccccatgtgtattgaactggcacaaactaaacttgtctgctcctctaggtctcttctcatagtctgagttcttaaaattaaggtcagttaaaagaagcaccttggcattttccttattggagtttgctgtgtgtttgcaaatcaaaatgggaattgattcagtcatttgggctatacaggttttcatctcaagtcacttaagtgaaatccataaggaaagatgttcatgctttacctaccatagggctcactcacctcttttcttaaatacaaaacaaaaagcacctgccagttttaagggactgaaaaggtgttttatgatggctgaaaatacatctgagaataataatatagttatacctagactggtgatacatcattacagtatctgcggggaaaagtagagggtggaagtctgtatgtggggtcagtcttaacaaggaaagctgacatgaatgctctagccctgcagtaccagagggcacctggattaatgttctgggccctaattcagcgtcctgtctctcagacacttggcactgatttgctcatctcagagctgaagtcttaaggactaagaggagagaggaacacatcattttctctgccagaggaggtacttaaactgggaaaggaggaggagaccttaacaaatcaagccttggcaaggaaatctgtcatgaatcagcaatgccttggaaagcctctttcgctgtattttacaaagctaaacacttgtcgctactgacatttctctattgcttaccttgaggatcagctttaggtagcactatgaatggaatgaatccttttttgtgtgtgcccattttgacattaggtaattaatttacaactagctcaattagagtccagcccatacagtgtgtacatggccttttaaagagcctttgttttgacgctaattgaactggttgtagcagagacagccaaacaatttgcattcatctttggcagaacacaagggctctcccttggtatggacagccccattttttattccttctaccaagtctggcactaaagtgatgtgtgcttattttatttttctaatttaaaaaaactttgaagaggacaaaagccacataggtttattgtagaaaaattggaagacatagataagcaaggaagaaaataaagatcatacattatcttttcttcttaagacggagtctcaatctgtcgcccaggctggagtgcagtagagcaatctcggcttactgccgcctccacctcctggattcaagcgattctcctgctgcagcctcctgagtacgtagctaggattacaggtgtgtgccaccacacgtggctaatttttgtattttttgtagagatggggtttcaacatgttggccaggctggtctcgaactcctgacctcaagtgatccgcgcccccccccccccttggcctcccaaagtgctaggattacaggtgtgagtccccacacctggcctggagcacacattagcttaataccaagagaaaaccatttacaacctagtatttttctttctataccttttctgtatatgagggaatgcatgcacctgtgtatgtaactgttttcatgtgttgtttttacaaaatgggaacacagcatacaaactgttttgtagtatgcttttttttcctacttaataagatggaagtgccttgtcattttataaaatgttgtcctacaacatttttttttgagacggagtctcgttctgtcgcccaggctggagtacagtggcgcgatctcggctcactccaagttccgcctcccaggttcacgccattctcctgcctcagcctcctgagtagctgggactacaggcgcctgccaccacgtccggctaattttttgtatttttagtagagacggggtttcaccgtgttagccaggatggtctcgatctcctgacctcgtgatccacctgcctcggcctcccaaagtgctgggattacaggtgtgagccaccgcgcccggcctgtcctataacattttaaatgtctgcataatagtcaattgtgtggatgtaccaaaacatatttaaccaatctgttattattggacacttgagccctttccaggttttcgatgttataactagccttgtgatatatattcatgctactaaatctttgtgaagtcttaattatttgcaaccaataaatttctagatattgaattacttggacaggggcatgcatgttttaacattttttatgcatactgccaaattgcaacaatttccactttcagtaatgacagctttatgtttattcttgatattcaggagtacagtatagagagtattgactcagaagtggattaaatcctgatcagtgattttgctattgcccctgaaatttacgtcagccttataatcttctgttcccagtatcaggtgaaagaggccagtttatatcatatagtacaatataggtttacttatcttgactaatatgtgttatttagttttgaaaaattgtagaataaaagcaggtagctgctgctgtaagacaaaagtgcctttgtttttcgtaaggcaggattctgaaacagtgttttcactatgaataaggaccaacctaaataaatagatgaaaatcaaagcgatagtagatggttttgctaagtatatgaaaaaaatatttggatcttcttgaggcagtgaaacccaagactggaggagcaagatgaactgtggcatcttgtatcaggggtggccttggagaggctgttatacctcgtgtatgtggtctatcattgactgaacatttgttatgctgctcatgattgtatttgcagcacctgaaagtgcagttggacaaatagatgctcattgttgactgaatgaataaatgaatagaatagatacacaggagagtgagatttcagaaaaagacctttcaggtcatctaagaccctccccctaattttattttactttattttttgagacaggttcttgctctgtcacccagactggaatccagtggtgcattcacaactcactgcagcttcgaactcttaggctgaaatgatcctcctgcttcagcctcccaagtagctgggactacaggtgcatgccaccgtgcctggctaattttatttttttgtagagacaaggtcttgctttgctgcccaggctggtctcaaactcctggcctcaatcagtcctcctgcctcagcctcccaagtgctgggactacaggcgtgagccactgtgcttagcccatccagttttctaattaaagacatagaagttcagaaagatgaagtgacatctttctcaagactaagttaatgatcacagcagaagttgtagttctctgtatcaatgtatttctgagattctcatagtactagaattgtatgtttttcccttgatatggtactttgtatgattaaatttcaaaatcaatagtaaaattttaatttcaaatgcagtataagcacaatttccctaactcctctttttttcctctgtttggaaatagcctcagtttttgttaaaattcaacacagtcttaaacttgcatttcttttttccttactttctttctttctataatattttcacctatcctatttcattcacagtggaggttttaatttacttcaagcagtattgccatctggatgtcaaaagacattgaattgacttcttatctgtagatcccaataaaggtctcacctgcctagaaacaaaagatttagtcaggaattgaggaggagcaaagcaaaggcttcaccagaggcccaggtgctacctatctgcccacttgttctttgattgacagtggggcacagaggtgccttgtgtttctctaggaagtagcttttgcatacagtgtttgtttggaacttttcaatttgctagtgctgaataatgtctgcagtaaaagttggtttagggtaaacccggagaaaggaattaaagagaagttttaacatttctattgtttttcttctgtgactttagcctttcccccttcttagtgaattattatagagttttattaaaatgtaagttctggaaattagacaccatggtatttagaccagcatgggatactgtactcttaggttccataatatttcatagtacatctctttattgtatgttaaatgatagcgaagtataataaaatgcacctagagagtacttatctattttatgtcctgtaacattcagtacttgatgcaaatgtagcagatctcgattcaaacaggagcaaaactggttataactcaagagaaaggggataggctcatcttgatggaaagttccctgttggtggcataagttcagcaaaaccatagaatttgaggctctaagggacctttgtaacatctactccaatcttttattttgcagatggggaaagaattagccactggttcagtgtcactcagcaggttaaagaaagacctgtgggcagaacctagaacttaacgcctgctctgctgtgtcttttcattttctgatcacaattgaagcatgtggtctaccctgtctttaaaagagcataccatttgatgtttgttagcttgaaacctgttgtgcccaagggcacctaaaggcttccgtcttgctcccttttcctggatgcccaggtcattctgtgcctctgagggtgggtttggatatggctgaaatgaaagctgtgttgtggcagtgcttagagaattgtctctgatgataggactcttttaagaaagcagtgaaaaagcagtaaggagactgttacttcataaaacaattggctctggacttggagaagacccaggtggcggatggttacatcccttggcagcagctgtctttgctatatctcttacagtcttagagatctgggagtctttggctcttaattttaacctagattcactgtatgatcttggtcaaacgcctcacctcttgggcctcagttaccttgtagtaaattcaaggggagttaaagtggatgatttctatggcaacttccaggccttgaattattatttttataaaagtttttccacatgatcaagtaaccaaacatgtattgctgacagtccattttattactgttttgattggttttcatgagaatttggaaaatgtctgcagactttactgtgatcaggctgctagcaattatttacagagcacccatcaagtgttcagggctataaaagaaatagtgtctagcttcagggagacagaaagacttcttgatctccccagccggggatggagggcattctcttccactggatttaagctctgtgagtgcaggggctttgtctctcttaagtagtgcacagttcagtaaacattggttgcattaatgaaagaatgaatccagttgtcagtcttgcttatatttactgaagatatcccactgagatttattggtttcttcaacccgtaaatgctgctaacttgaatacatttcccagaaagtattccttaccttccatagaaaaatgcggccaggatgctctgaggctatagggaaaaaccataaatattccactcctttcttgaaattcaatttaatattagcatattgaatgccctgagattacctgccttcaaatattttggtttaacccagcatttttgaaattcatttgacctcagaatattgttcattccactctcccatgacacacttgttaatatcccccagaactttgatttgtaaaataaaaaggttgatatagggagtaataatatggaataaatagaagcagcaacattagttaagaataattaattgaacacaatggagcatatacattaagtgctgttcctagcagctctgtgtgaaactgtggtagacttgtagattttttttcttttaaaaatgactatctatgtctcattacagatacaaggttgggtggtagagagattgaaggaagttgcaagtgacctaatagctaatttacagttacggaagttgaatggtagcattttaacttgtgtcaagggctgccctgtcaggtactgcaggggaataacgatgaaagggagtctgtgtctgctccttctggagctggctgtccagtggaggagacagacatgtaaacagattatagcaataaagtactcaaatgtgtaatgaacagaaataggacacaggaaggaatggtattttcccctggtttagaacagggttgctgttcatacaataagcccaaaccacattaactggaacccctctagatcctccagacaaaattctactcatacatcaagattcaaacaactcggcctcttcatgctttcgctgatccagaattaattgcatcatctatattgcctgcagagccttgcttacacctgtgtcataggccttatcataatctgctttgtatgtgaattacttgagggcaggatagagttgtctttgtccctgtatctctggggcctgcagttacagcatggactgcatattcgctgctttgtttagacttggagcaagttattggactgtgaaagctactcactttaagtaaattcagtaaataaaattatgttttatggaagacagattggacaggtggtggtattattagcattttctctcaatgcttaaatatgatttacatttcaagatttcagttacattttttaaggaattcaacaattctgcatcatgaagtattctttcacacaaatgttccatagtcattagtttttacagaacccttttcttatattctgcatttcatctggaatactataagcacaagttcagtttggcattctgttctccactagtgattgagtttgaagcccaaggtcaggatattgattgatgacatttccctttaaagtatttgtatccatttgcaatttggggacagagtgattcccagtatggtgcaggaaataactaaactggaagtcagcctgactcagttttgtagttaattttctttgtgaccttgggcaagtcacttaaccttccaataactgagggagttggcccagaactagcacagtcttctaatgcagacattccacgattctctagggaggattcacttccatagaggtttaaaagtggatacatttttaggttaaatggctttgttcatttagtttttttctccttaacccattttggagcaataagactgtcatggagtaaaaccaaattacctggaactctcaaaaggctgcagttcttatcctattttttttatttttaagggaagggaaaaaaatggcaacaaacaaatttatatccatgagtcaggacaaatccatcccagttttctaacatacacagtgtacataaacatattcaatgaagcactgcagattcttaaccgaaaatggaatatttggtttgacttaccatcctaaatgtgggaagaactgtactttgatatatactttttgagtatttttagcaaaaattgatataagcagttgtcttggttggcaaggacttgtgtataggaacctggctcccagctcagtgacgagtgtattctgtaactttgaataagtcactgaacctttctagatgtcagtgtcctcagctgttagatttgatactgttctgattactaacagatctgtgattagacatttccatgcatttatttcaggcctcttcctgttctcttccttgagagattaacaaatatacccaccccttccctcacacagtctcaggcaattattgatttgtgagggaaaaggggtattttaaaacactttaaatgatacattcaagaaaattatctcgtattggttatcaattgatatataacaacattaccacaaacttagtgccttaaaataatacacatttattatcccacagtttctgtgagtcaggaggagtctgggcacttcttagttgggtcctttgcaaggctgcaatcaagatgttgtcctgggctggggtctcacttacacgcttgactatggaagcataagctactgagcccactgtgattgttggtggaacttatttccttgcagctggaggactagagggacttaatgtttttgctggctaggggctgccctttgctccttgaggccacccacatatccttgtaatgtgtgcttccctaacatggctgctggccccctcagaagcagcaagggagagaacaaggcagtgctgcagtcttttggaatgtaatcacataatcatgtatacataatcatgtatgtccatcatctttgctctactctggttaaaagcaagtcacaggtccctcccacgctcaaggtgagatgatcacacaagggcattgacaaccaggaggcaagggtcatgggggccgtctgaagcatctgtcagccacaccatatttcaggttttttttttttctgtatcttcctttggatctgtgaataagtatctcacttcatactaaagcctcaataaacactgattgacagaaagtctttgtgctcatttaaaacttctcagctccacagagtatttgtaccatgcccttgttttatggagtccccagatactgatgagggcagggtttgagtttgagggctgttcattcttctgcccgccaaccccccaccccgcccccagcacagaactgccagtgttaggtgctcattaagtgtttgtcaaaggattataactgttgttccaattgcagcagtaagtaaatttgaagaagctccctgatattgagtgaattgtattctccaccccccaaattcgtatgttgaagctctaacctccaatgtgatggtagtcccagctaccagagaggctgaggtgagaagattgcttgaagccctggagatgaggctgcagtgagccttgattgtgccactgcactcaacctgggcaacagagtgagaccctgtctgtaaataaatatgtgtgtacagacatacataaggttcacaattcaatttaaaaaagagaaagtgaccatctacaagccaggaagagagcccccaccagaaccctatcatgctggcaccctgatcttggatttccagcctccagaactgtgagaaaatcaggttcgcctgtttaagtcacccagtctttggtatttcgttatggtggcctgagctaagacaggccctgtgttctctgtgtagcaagaggcaggaagctaagcacaaaggttgccagatagcagggactggctggctgttagtgagccagggccagtggcatttaattgcagtcattcccattctttgctgagctttggtcataactatttgtagaggacccctagactttttttttttcttccaggacaaaagtgatccaaaacatactgtcttcagtttttgagcattggactaccaaacaggaacatttaaggaaaacaaaatgttgctgttgtaaagccttgatggtgggaagttatgtagtgaattctcaatttcttcttcctgcatcttgtcttaaaaaaaaaaaaaaacttttaaagtttttgtttgttcatcattcattcattaataagtcaagatgtagagggctcagtagccttcccctagttttctacatttctgactttggtaaacttcctttacttctgcaatttccctaattgtaatattaacatatatctaaaaagaatacaatggttatgtaaacctcctagcacttaataggcactcaagacaatatgacttaactgtataagaatgactaatgtgctatgtttatttatttggcttcattcattttgccagcaatggtgtagtatatatgtagtatatattaaaaatctcttgagtaagagaggtttggaatgggaaaaggaaccaagaaaatctcaccatctttcttctgcttggcagcaagtcttgaattctgttttatttttcttaagagacggggtcttgctctgtgcccagactggagtgcagtggtgctattatagctcactgcagcctcaaactcctgggctcaagtgatcctcctgcctcagctacctgagtagcggagactactggcacctaccaccacacccagttaattttttttttttttttggtagagatgaggtcttgcagtgttgccctggctggtgtcaaacttctgacctcaagtgatcctcctgccttggcctccaaaaatactgagattacaggcatgagccactgtgcctggcagagtcttgaattcttcaacagggcttttgaatattttaaagccacataaaatttcctttttaaaattgcaatgaaaattgtcaagtaaagtgggtcattttttgacctggtgcttaattgtacttagaagcaaatgcatatctgtaagtaaggggaggactcagaagtgatttaaagggaggattgtaaaagagtttgggaagtccatccctttcattttacaggttaggaggctgagggcattgtgcaatgatgtatagtcaggtagagagaggaaacaggaatcataaatcttaccttttgtacaaagtcaatgttttcagtaattttgttgaaaacaaacattaaacaaatttggacctgtaaaatccattgaactggtggaggtcagcctgacctagcaggacatgtggcatctctgttttgtgatgctgtatctgctttgggagtcccagtgcccaatcccctcagtgttgaaaacttagctcctgagtttaaggtggtttctgtggggttatggggcagggggagagggtttggaggaggggaggagcggaaaaagagacttccagtctggggctcctgctgtgttaccttaggggatttagggcctataaaaaacacatttacatctctgaatggcaacagataaataccaacgagcgttaattgaaaaggaggagacccaatggactagaggtcaggactctacagtgatgactggtggcctgggggtgtcagctgaaacggtctggattttttttttttttttttctccttcttcccctacctccttcctgggcttagaaatgctggaaggaagaaggagggaccattagttgaactaagaggtatgttgtttatactgttgttgtggttgtccctgggtggtctgaaattttggaggagggggtagggaaaggccccctaaaccttttttaaactagtataatacaacctgactgctacctgcagtttcccaattacccaattataacacaaatttgcacatttttttaaaaaagcaggctgctactgtttctccttatacaaggattttagtcactgtacatcttgtgtctttaaataatgtattaggaacattttcaagtctgtaagtgcttttttaatgagagtgtgaagattttaatgggactagattgcttttcatgacatttcagagtgacttaattgtaacaatgttgagaggctgtattttaaagtttgctaagtatgtctgtgtggattatagtcagacacttaaaaggacggatggttggatagtggaatcagatagcttttccttactactttctccaaatattagctctttgcaaatatggttataccaaaccaggcacaggtcaggattctcttaaaccttttaattttcagataggaacagaggctaataacagaccaatgtgggtaattttagagacaatttccttaaaacttagttggactgcaatattggtcctaaggcctctcctctctccttttgtagacccaggaggccaggctgtctttgtgtatacttcctgttagtccctgaactctcttccctgtttgctttaaaaacatagtgaccttgaccgggtgcggtggctcacgcctgtaatcccagcatcttgggagggcgaggcaggcggatcacgagatcaggagatcgagaccatcctggctaacacggtgaaaccccgtctctactaaaaaaatacaaaaaattagccgcgcgtagtggcgggcgcctgtagtcccagctgctcgggaagctgaggcaggagaatggcgtgaacccgggaggcggagcttgcagtgagccgagatggcgccactgcactccagcctgggcgatagagcgagactctgtctcaaacaaaacaaaacaaaaaacaaaaacaaagcatagtgaccttgtgcctcatttttttttcaggtatttgagttagcgtttctaaagcattatgactctccagataacagtttaccgttttaatgattggaatttcagactcaatttttttcttatctccaaaacaagaaggttattcagaggtcttttcctatgcaaacattattaggattctagaacctgtggcagacttctcaaaattagatcaaatggtcagacactttcactatctttttttttttttttaatggtcttgctctgtcacctaggctggagtgcagtgccatgagcattgctcactgtagcatcaacttcccagggttgagtgatcctcccatctcagcctccttcctgagtagctgggactacaggcatgcaccagcacacctagctgatttttaaatttttttctagagatgaggtctcactatattgcctaggctggtcttgaactcctgggctcaaacaatcctcctgcctcagcttcccctaagtgctgggattacaggcgtgagccaccacgcccagtctcctcagtgccactcttaatagaagcttgtattagtttccaaggctgccataacaaagtatcacaaactgagtggcttaaaacaacagaaatagtctcatagttttggaggctaggaaatgtgaaattaaggtgttggcaggaccatgtttcctcttaagcctataggggaatctttctttgcctcttcctagcttctggtagtttattgacagtctttggcattctttggcttgcagctgcataatttcaatatttgcctttgttgtctcttagtgttctccttgtgtctttacatggccatcttctggtaaggacatctgccctaatccaccctaatccagtatgccctcgttttaacattggtgtctgaaagaaccttatttctaaataaggtcacattgtgacatactgagggttagggctttaacgtatatttctgaggggacacaattaaacccataacagagttctactttgaaaagtgcctaggagattctgatgcagcctgcatgggttcccaaagcatgattcctgacctatctgtacataattcatcaagagcactaacaaacttacaagacatatatgtataatggtatataagtatgagtgatatacagaagaaaaataaacccaaaactcatgtactcatcaccctgcttaagaagtaaaacattaccagtacctttaaaggctctggaaagcctggggtgtttgtttaaaacataggttctcctctgaggggttaggtcagggaggtttggagcaacaatgtgtattagaattcagtaactttaaaaaaaaaaaaaactccacgtgcattttaaagttggtctttaaaattttactttggagtgggatgggattttttttttctattagcgaatagaaaacgtgcaagaaaagatgtagtaacttttttcatagtgtagtagaacagtctttggctcctcttctttttgtgaggtttcttgagaaatctcacctgtacttggtataattttccaaattaatttagatctctgacccagagagacttagagtgatgcacagtcatgtagggggaggatgtgtatgtgtgaagggacctgttattgattatacgtcttacattcttgcctttcttgtgggattttgtgaagattaatatctgccagataggtttaagtttgcaaaatgccttgagttccttgggggaaactgttacataaatgtaaataaattatgcagcacctgaatttggttgttcatcattttttatagtgtgttttaattaagaacttagtgctatttaagttggatggctggggagagggtttaatcactccaagatggttaagtaagtaggtaggagcaacatttaggctggaacccatggaggaataaatgaacaagactggagaccagtcattttccatggcatttgctgagcggagctgtggattaatgtctcttcttgtacgtgtgtacatggtgctgttagaaaatcagccagtttttcactacactttgtctcggacctgtagataccttggacctctctggttttcctgagtaagctggaaaccctaacaacagccaaaacaaaacaaaaacggagtttgtcttacagtctaggtacttggggagcaagaggcatccagcaaactgcattggcttttggtacactgtgtttctgtagtccaatgagctgggttccaaactacctccttttgcctgttacatacagctttgtgttccagtggatgatactgttccttaactcttaaagagtggacatacgaaacagttgccaacaacccgtggtccagttgtgcctcctttgtttgctgctttgtcagagtctcactgtatgcttttttttttggcctttggcgctgtgagcagagtcacctcatcctcctttccgtggccaactcaaagacttacaacctttctccctcattcctatgtatctacagaacactcactagttgctaactagtggatacatgtgaattatgttttgatgccatagggctgtctagtggaggatacaaacattaaaaaaaaaagctaaatccagcaaatagctataattagatgagggttatagagaataaccacagactctttcagagcatataaggaggcgaatctaacccagtctcggattctggcaaattgcttctgaagagtgactctcagcaaaatctggaaggatcactgggaagaaattagcaaggaaggaggaagaaaagagaacagtgccttctaagaaatataccatgaagtcatttttttcctattcctttctctgcccttttccttccccacacagtcttatgcagcagcacaattttagccatccaaactgggccagttgttttgttacactgtggatggttggagattgagagctatgggaatgggtaggagttaaaaactgaatataaattaggtgacaagagatggcaaaatcatttattgggatgattaacttattaaattgggctattcccatgctgtttttctaaaattgtgctctgatggccattttggaagcctggtactacccacagactggagtatgtcctaagtaggttaagagcttgggaaagatgcttgctgagggagggccttctttgtactctttctatcaataagaaataataaagagttaaagcatcgttacattttagatatactttctcaaactgctgacatcagaattgccaggagcctgttaaaaaggcactttctgtagccttcctatcccaggccttctgaattagaatcttagcagtaggattcctggccactgtaaagtactctattgaaggcgtggattaccagtgggttattcagaggagaactttcatcattttagccccgtgggtccctgcctgatttcctgccatctctcactaccaggaccagctatgtaatttgtgaggccccttatttaaaaagaaatattaggaatttcgagacagtgatggtagagcattaaaccaagtatggggccctttctggatgtaggtccctctgggattgcacgggttgcaagcccatgaagatgttcttgttcaccattcctgtttgcctttttaaaatgctcctgcagtaatgaactgcttattgctccctgtgcatgatactgttttttgcctttgtcccttgggtctcactatgtggcatgctgtgtttcatctcttttctgtcacctgggcttacctcagtttttgcacatactgcgttagaatcctgtgcaagtcgcccgtgctatgctgtgtgctttgagggcccggatctgctcttcctcatctttatattccctgcccttagctgaggctctgccttggtcttctgttaagtgtgctgaaagggatacttttttaacctgaatcttttcttaaaacctaattaggttataggccattgggaatgcagatttggttcagagtgaggagttggaggctgtgttgccctagtagtgtcgtgaggactgcctgggcgtgactggtctgagacagtgtgaggaacggggtgtgaaacaaacttatgacatctctggcaagtagtgcatactctgctgttgacacctttgatagctgctaccctctgataaccagtgtttttttttctggatctctcattgaactctgagtttctgggaacagcagatttttctgagccacaggttcagatgtgttagcagaacctgaggaaatgtttcttgcaccaggaaggtggccattttactccgtggctaatatttggaactagtcatttctggattgtttgaactagcgtgttctggggaattccccaaagctggacgcacttgttaaatgaggttatggctctgtggggtgagaaatagacccgcctactatacttaaaaggactgactgtgtttctgccttcaggtaaccagaggtagttatgaatttgggtgaaacctcttcatctcatgatagactagcaactagaggttcagagaagttacacagaatattcaaggttgattcagatagtgactgaattgggactagaatccatggtttctattctgtggattttgagtaagatcactaatcaacatgtgaaatcttccttgtgtcattcaattagaatttaagtgtcaaatggatggtaaaatcatttcttagcttatgtagatcataaagattagcaaatcaaggcagaaaaagacccccacacatatttgttgccaggtctgcactaatttctggataaaggttagtatatatttggtctacagggtgtgatttgagtgtaagttttttctttagtttttagattattgttcaaagtccccactgacagaatgcagggagacagccttgattagattaggccagattagattaaatcgaatggttaaggcctttggagcctccagcttgtaggagacaccataatggccttcatagcgtccttaaatcctattaggtaagttaatcttattgaagatttcaggtctgcataaagcagtattgctcttatactctctatggtgggctctgcttgttaaggtgagcaggcattttaactttccgggaataagttggttttattggtttggggcaagttaatctaaataacttgaaagtagacacctgtgcctgatagagaggccattccatgtagcaaaataggctgtctcctggcttcccctttgcttggtggctgttagtacctgtgacagggattttttttctttgccctgatttggggaaagagagtcaggtgagatgtgtaataataatgtacggagacagtagtatggttatgacactgaggcactactagatattgagaataaagcactttggaacttaggagctggaagcattcttagctgtcattttttgagtgtttatagttttattataggtgctagttggctcttgcctgtttctacaggtgcagtgaccatttttctgaagcaaaatattcttgttgtcacaggcttttcctcaatttgtgaatttatggacctgcaaagttttacaaacacatgaattatgtcaaattttgtaatgtcttttgaaaaaaagggggaaaagtgtaagaaatttagaccatgtaggtctgaaagtatgcttactacatcgatagtgggggctggaggaactgtgaaaaaagtaatagtaaatttccttttttagatctttgccaaaggtagttttgttagatataaacaacttcaagacccacaagtgactactacacactggattggccttcagagatactgggattttctttccaagtatctttaaaaatgaggttcgtagtgctttagctaggaggctgagtgcccactattaagatcctgtgagttaattggtttggttcacaaactaactcatattgcagtgtatctggctgttttgtggctgggagaaggttcctgcattgaagggactgaagtgacactctgaccttgggacttccagtgctgttgtggagtggggacttccttcttcatgtgggcttgctggctcttcatttattgtcccacctgggctctgcctgttactcttctcaggccaagaagtgagttaggttccttatttaacttttctaatggggcagctctgcatctgtgtcctgtccccaaagactaaagagaaatttcaggtgtgggccagattatggagcctgaagaacagttttatgattgattaatggttttgatttgcttttaggaagaaaagtgcaactagcccattggatgaagatagtatctctctccagcactcctgtatcaagtgtacagtgttctcttcctgtatagcacttgtattttcaagagctagggtcattgagagaacacttctcactcatgagtttcagagcgtagcagagtacacacacctgaagcaagaaatgtaattttctctaagtgtactaagaattactttaattctctgtatgtgcatgcatgtgcccacataatggtggtgggtttggttttttttttttttcatgctccttgaggagaaataacccgttttttgcttttattgattcacgattacctacttttcagggttacctttgttaggaagcagctgctggaagaatgtgtgctcattttgtacttgtgtcctttacttctatgtcctctctgacctgaggctcaccctgcctgccacctcctctgcatcagcccagctttgttcttctgggcctgttgtttccactctatgaagagacctccttacttctctctgtctctacttagtatccatttctgctgaggcagatccagatgggcagaggttggggagggaatttgaatgaggggaaaaattggatcagttaggggaaatttataaaacttctgtattctgtgctaatagttctcagatgctttggaatcataagacgggatgttggtctggcgacctttgagagctgctcttaaccagccagtggacagctatgcttgctttttcttcctgtcaccatctctgcttttcttgcccaatttgccaggaagagtccaccaattcttcataagcccactttttattctctcttttgaagtcatcttgattcacttcctacacctgcagcccccagtcttgcttgatctagctcctaatcttctgcttccctttgggacagaggagaagctgctctcctcgccatgctttgctgacatctccaaggggaaggagagcacaggccctttcatatcctgccccagaccttcacagggagcagtaataatgcctaaaccttattgagtacttaacatgtgcccagcactgtgacaaacacttcacacagattatctcttaaaatattcaggccagcccagtaaagtttatgtactgtcattgtctgtcttcaatttgcagatgaggaagttgatgctcagggaggttcaataacatgccattatgtacacagctgaaatgagtgatgcaatcaagattcaaactaggcagcccagttccagggctcttgtccaactactcagggaaaggttttcgaggtcactgccaggatagctggacttgtgacggttttcctgtttgagatatctacccttttacatcaacctaagcacttactgtctttatattttcaatgaactaagtggggtgttctgggtggtctttgatgatggcaactgtgtgttttaaagaaccagaaagaaaaatgtttagaggtgggcttctttagctgtagtccctcttgactgtgtggtcaaataatagggctcctgacaaggaaataaggctataagtgctcttgctttgtaaagattagttaattggtagaggttgtgtttctgtggttaatttgtgctcctgtcttagcaatacatgagtatccacaggcagcaagtgtgtcgcccagcagccccataaaacaaggcactcttcagcaccagcatcagttgatgcacctgaataacaatagggaagcttgttgaccatttggcacttcacagcctagtaattagaaactgtaaaacaataatacagacatgaagcaaatcctccagttaatgaaaaaaaaatctacaatcttgcattgtggctgagtgcaaaatcacaaccggccgcttatacagcaaagcaaacacttcaggattttggcagctgttttgtggatataaaaagctctaggctctgtattaatttggggcctgtcatattttttaaaaactgaaaacaattacctgactttctagttttttgttgttgttgttgttgttgtttttaatttactgcagtggttctcaaattatggtccccagtccagaagtgtcagcgtcatctgggaacggttagaattgcagattggtggggcccaccccagacctactgaaccagaaattctggcagtgcggggcacagtaatttgtttttacaagtcctccaggtgattctgatggactttaaagtttgagaaacactgagggtgtgggaagggtaatttgggggaagggaagtggagtcccctcttggccccacccagagatgagcttctctgtctagtggtgggatagttggcttgagatgtgatattgagaatatatgaaggctccctactgggtcaggaagttgggggagtgtctcaggggagggccgtgccttcctggggacctgtttaggagaagggtcctgggcagtagcttgttactagcctttcgggaacaatttcaatgtttcagtcaccctctgggctgttgtactattgcagtcagccctgctaggcccacaagttgtatggggcagaggagaagaggcatggggacagaaaccttatatcccaggcaaagccttagcaatgctgctgatgtcatatgctcatcgttgtcaagaattgaaaattaagatagtgatgaggtggtggcaggacaaatttcttcttttcactgtatgtcccctttctcttctggatctcatttccctgcctccagctatcttggcagatgggattatttaataattttcttggggcctgttggcaaatggcccctctgccccttccccagtgtgtggtgaccacaacagtgacatagcttcatttcacagccattaggaatcttgacgcagctgacccctagatctcctggaaaggcctcttgggaaatataagcttgccaccagagtgaagtgaattctcgagtggtattaccacagaggctcaggttcctgatgctccttggagtgctaggttaacagtctctctgttggggaaaaacttgatacaaatagaagatttgctaattttgctcacatttcaaaattgtttaatttgcttactttttttttctctttcagactattgggttttatctatcattccttttattttacaaaaaagaacatagggcatgttggccagataatgtatcctgttttttgatttaatcacccaacatagcatgggaataaaaagctgaatgagatgtagccttgctcctccctgacattgaagagactggcttctgggagaggaaaatgaccaagaaaagaaccacccagatcttgggttcagtttattctctctgtattttcaagtggcagaacttgcttgaatatgtgaatttgatgttggatcacaagcccaacatgtggcttctgtgggcatatgtagttattttggattttattttattttaaagggtctgtgtcctgttggcttttaggaggtgatagttgctgattctcctttcatgtgacattcagggctcatggagaagtcaaaggctcacactggtgttcaccttcctggacttcaggaaagatagtccttttgccagatgaatgggaggatctaagtctgttagatttccatgagtcgtgcagcctttctggatcgggacaggaagactgacccactgtccttcccaggctgcctgccgttcatcttgctttaattaaatacacagctgatgatgtcagcttggctcccggctccttcagctttcccctcagaacaaaacatccgggcagacagttgtgacaattaagtctcaagacccaagcttagtttgttctgaggtagttaagataaatctgcctaagcatctccaaatgcagataaaacctagtgctgattagaggtgaccctctaataaacctgatttgattaggcagaaccagcgaggtgcaggcaaatatttgagactctggccaagctgatattccattgacctttcacttaggggaaaaaacctgtttgatttttttcctatcccagagtacttgaaaattattacctatggcagctaaagcactagggcgaaataaacaggtgagacctgtggacttgcccttaagagtcgcagtcagctaccacctgggttgtgcttgcttcctggcagatcagtggagaatggattttgccggaggtcctggcctggaatgataattaaaaaggatgtttcagaacacacccaggtgcgttctgataaagcctgagcagatgtgggtggtgaaggattttttttttaaagtcaaactttgtttataaaggtaacttctaacaatttattatagaaaagtcaaactagaattgcattagtttgtttatatcaagacctcattagaaattaaggagaaatttccttaattgctccatctctggctcctgtaacagtgggcatacttctcttcttagcatttatcacattgttctgtaattgttggtttaccttcccttttgtcttaaaaagcagggaaattgtataattattcttgatgttgctcaaatgcttggcacctgggccaggtacagggattggcaaagtttggtccacaggccaaaccaggccactacctgtttttatgcggtcatgagctaagaacagtttttgcctttttaaatgattgaaaacaaatcaaaggatatatatttcatgccacgtgaaaattatgtggaatttgaatttcagtgttcataaataaagttttattggaatacagccatgctcattcatttacgttattgcctttggcatcattttgcactacaacagcagaattgagtagttgcagcagaaaccatatggcctgaatagcctaaaatatttgctatctggcacttcacagaagtagtttgttgatccctttcctattatatagcaggcatatagtgtaaatgcttattgtttgaattatttcaaatataaatctgagtttacaaatagagttattctgatcctaaaagtgttcagtgaaagttagatgaatgactgaccaatctatttctcttgttattcatttgtaaccttaggtttaagttttagaggtagtggttcgtttattagagctagacaattatatactatttctcttctgagaaactttataaagagttaatccttattacttttctaggttctgaacctactatatgggatgcagagacaccaagaggcacagagaggttaaactgactaagacacacagtaaagaaatggcatgactcttcatgtcttcatctctttctttgtttgctaaagccattctttgtgatgaaagagaagtcaaatctggagatattcatgagcaaactactgtctgatactatataatgcattatttcttatagacatcagtatctttgtaggctctttggttcattaccagggaaattcatttaaaaaaataataaatatgtggtttaaaaagtaaatactgcagagaatgatagcaattaccaaatgtaaacaatgtggcctttgagaaccactatgaaattgtttagtgaattaaattattatgcttttgctattcacatatccacttccattgactgttaaggaatatgcttcaaggaggacagatgagatataggtaaagtttatttttaagatacttaggtaaaacaaaataaaccagcaactggcagatgtttggtgaccttgaaatctggcttttgttttgagacagtgtctttaaaatgaccagtgccacaaatgtaaacaggggagttggagggcattggagtattcaggaagaaagtgagaaatcagtaatttgtagaacatgactaactggaactattgtttggtctgctggggtttgagggagtagaggaatttgtgaagaaggaaagaaggttaggagatgcatagagcagagaaacaagggtctaagctttcctaggaatctcaggtcagacccttgttaaattttgtccgtatattcattgtttgctgtggaatcttttaggagagtgtaatttttttttctgtttttctcttattaaataatttaaagggatgacattcagggctttgggaagcaattttttttttttttttcaaaacgccgctatacctactaattggatatccatcaggggatggatacttacaacagctctgcatgatagggataatattcctattttatggatgggaaagctgaggcttagttgtttttttttttttttttttttgagatggcatcttgctgtggctgaggcttagtttaattggctttcccgaagttttacagttagcagccagagccaagtttcaaacccaaatctagctgactccaggggccttctgttgtttctactatcccacttcctcagtggttgcatcccagagatttcatcgtttggtgcataaatccagcctaaagccatacttcaccattttgtgtgaataaatctcttcctcattttatgactcagctacctgctttctctttctaacctgttattttgtacatctgatttgttagcttcccatgttcccttagcttccctgcccttagttgttaacccttttgatcaatatctagttgattttgctacttaataacagactttagagggacttcagaggataaaaactagaacctccaccctactgaaaaattacatttggtttgccgttggtagtatgtgccccatccttctgccctggcactccaggggaatcaaaaaggaagagctgagaaacagcattccaggcttagaggctccacattctttgggtttgttggaagacttcttggcagcattgaaagatgcctgtgttttcatactgattttccatcctgggccacctgctttctcccttcctgctgttttccttttgtacctatgtggttggtgcttctggggctttttatagcagctttcatcatttatactactgagttttgcaggcgcttttcttttcaatttttgatgtttgacagtatagacttttatttatttatttttaatatgttcacttctgaacctttttagacttcatggtgacagcctccaggagaggaaaaacaaaacaagggaaattctaggaagaggcagaaggtagttactattgatttctctggatgcagatcctaactgttggcaaatttaaaacttacttattttgagtggaggtggttctgtgttagtgagaagttgatctggaaaagatgctgatttggacatggctgttgtaaaactaatgatgaagcaaaacaaaagaaggaatagtgcattttggccaggcatggtggcctgtaatcccagcactttgggaggctgaggtgggcagatcacgaggtcaggagatcaagaccttcctggctaacacagtgaaaacccgtctctactaaaaatacaaaaagaagttagctgggtgtggtggcgggcacctatagtcccagctacttgggaggcttaggcagggaatggcatgaacccgggaggcggagcttgcggtgagctgagatcgcgccactgcacttcagcctgggcgacagaggaatagtgcgttttcactttttaaccttagttgcacagggtatgttgaaagctactgttggcttcaccatgtcattgggaagtgggaacgctgacaatcaaagcagctaaacaagaagcaactcaggaattatgacattggcggcaagtcttttgcccctcttcagaggtaacactactagatctggagagagttctgtacattcagggaatcttcctgatctctaaaaaatttgagaggactagagaggagtaaagactggaacctggatagattgatttgtgagggacaaagattcagagaagacattttcttgaaggtgatgaacctgctttaccaaaatgttgtaaaaattctaaagaaaagttaattggatcaagttgacaataaatgttagaagggaaaaatcttaaagggtaaaatttgaaagtagaaagtttgtcctgtccacagtgtttgccatttcatagaccaaggtggttgggggaggtggggcaaaattactgtagtttccagtgatcattgccttctctcggtcctataaatgcaggcactatttagcactgaaaccatctggtgttggtggttgtttcttatgtcgtatgacctgcctctataaatacattgtgtataagcttaactgggacagtaattggtgtgatccttttctttttctgatctctaaggtctgaggcccatgaccaagggaaagagaagtgctttttaaaaaaacggacacttttgttgttttggtctcatggtttcactgaggtagtgttccacagtgtaagacaggttaggattgtatgttccagaattatgaacaagagtatccttgggaatgataaaaaccatgctgcagtgttgcatgtgtatttgtgtgttccatgtggaagaccttctgggctgtgtctgtctttgctatttatttatcacctgaaatggtgctgctcaaccactctgtgacagtgttattttaacttgaaatagcatgagggttaggagaaaatacctcatgaatgtgaagggggattctcctgggcgtatgtaattgcaatgatttgaaatgctttcacaggtttgtaggagagggtaatttttcttctttatttgctccttttatcttgttctaaagccagtattacctcctctcccaccgcccatgtatacttcttattcccttctccttccccctccctttctcccactctccatgtaaagaaactctttcctaataagaatcataggtattcagagctttttttttttttttaattaacagttgatttgactttttagtactgtgtaggagatgggaaaagtcagggccatttgatagtaattgcttcctggaagagccgaccaacttattataagggtgaggagtgtttggaggcattattttctggttccaggtgtgttttgagtattgctggtggtgctcagcactcttgacatttggggctggattactgcatgttgcaggagtatcttgtgtattgtaggatgtttagcagcatccctggactctacacaccagataccagtagcacccctcaagtgtgacaaccaaaaatgtctccataggttgccaagtgagggacaggatcactctggttgagaatttctgccttagaaagaggaaaatggattccctggaagcagaggttagccattaaccttatagggctggagccttcatttaaatgctttggtatattgaaagcaccactcaagtatcagtggtgagggcacatttagcttgttgaaattcctgtgtaattcataaatatcatattagctcttggcttcaatttcctaacactagaaatgtagatttttccccttattttcaaaatgaggaggattgtagtaaaatatagtaatctctgaggtcgctcccaacccttacattttatgattttagttataacagacatcttatggaattacacaatataagagttgaaaatgtatttgtgatcatttagccagccctcttctgttagttctatcccgtgtgatttccacaaatagatcagaccagaagaaaatagttgctttttacaagtggatgttattaaatgctcatatttagaatatttatcagaacagacttatattacagtgtttacttttctaactgattgagattcaggtgacttaactgcctaagcttcaactgtctgttgtttggaattaggcttttaaaagttggtctttatattaatattcctatgcctaagctggtactcttattgtcaaatagctttatgctctgttacattaatgagggaaactttgactttccagagtgccttggctgatatattggtgttaaattggtaagctttctatcccaactgctttatttatgctttaaacataaatgaaagcagagaatttttttttttggcctgagaggtagttaagagggaaatctaataccttttatgggtttatatgcttcatatgtgatgtgcccaaccagaaataataagatacaccccagatgtgaaggtaccagctaatataattatgctggagatcattttcaccttttgagggctgaattacattgaattcatttcttcaactctaacaggatttggtatagttacttaaatttgaattgggagctgagatgaagtcccaacacttgtgcttttactggaaggattgggttgtgtataccttttgtatttctgaagcttgataaactataaagccttgagtattcaggttcatggcaaggtttagatggatggggaggtatactctagtagaatctaacagcttagtatgctttctgtgggctcttgcctggaaacccaatctgaaggtatagtgatcagacacaatgctattcttaagccttcttggaaataacaggtgtcttagcctgtggtaaaaaggtaattttgcatgtattaaatattcaaccaagggcatgatctgtgcttattttggcaaacaaatagatcccaaaatgaatcaaacaaattgtaatgcagaacaaatttaaatacttgaggatttgttttagacatttaaactcatattttatcctctgtgtcttcatagtaccctcagaaagaaaagaatctttggaaatgtcagtgaaagggcagtataatctcacactgcagttgtggttccggactcagtctgtgtgcctgtctttcctttcactcctagccacgtgacaacacaaagagggtacttaaagtgtttatttcaccctggaagatttttatagagagcactttttaatgaagcacagcacatggcatcattatcatttctaacacagagaactcattttcaattttgctatcaaagaaaaatgacaaatagagaatgcaagaaaaaccagatggactaactgtattaggagcttagtatgcatattttgtgtcacatattagcattcattaagtcaaaagggaaaaaaatgagttttgcctacatgcattaaaccaataaggctggcaaagttccaagctagctcttgtgaattaattgttttataactgttttaattaaaattgttcagtatatgattaacctaaaagttttaatttccacaaaactgttgaacaaatgagacattaatattttacgttaaccatggcaatattgctgtggttttcagagctctgcttgttcaagcaaagcatggcaagtggtaggtggaaagtaccctgtgtctcatgccactactaagaaaacctgcaaatcagaagcaaattctatacacaagcatttatgtaggcatcgccccaaaccccctgttcagacagtctagttagagctgggcacctgtcataaattgtcaggttgaagaggttaacgatataacatggcaagaatacatttattgtctttttcttccacctggcttcatagtagtgttggtgtaccgtgtgagatccttagattagaaggggttggccagtagggactatgaaatgattgttgttaaattctaggggtttaatttaggatataggtacaaatgttagttctggaatcaaagggaagaaagagaagatttggatgacgcatcacctttacttgaggttctttaggttggcatcaggctaactttggtaaaaccacatcccattttgcaaatggtaaaacagggttggtaaaatttcactgtgtatagctgtggctcctgaaatacacagatttgcatttctgtcactcctccctctccccactttccacatgtacccccatcctaatgtacttcactttgttaaaagatggggatgtctttcctctctcctcccctaagcctttcactttgctctgtggatttgggtcatggtgctgtataaattcaaggtaatgatggtatttgaaccccatagaaggatattttaagagataagattaatactgctcagcataaatgatgataaaactcaggctgtcctaaatgtctaggtagtgatgcattttttaaggcactagactgagcttaccttttaggttgtatgacacttgatataagctgtccttacaggtttaaagctgtaggagtctggaatgcaaaactgaaccacagaagtatattggccttgcacttacatagtcaggatcatacggcattgtgatctatccagatttccagctgcagtcctgatgtggtctcttcattactttgtccagctgtttcttcccagacggtgctctgtgttagccttcccttctgtataatcattctcttccctaaatttttctgtttaacttgttaagcaccagattctgaataaattattcatataatcagtatttttgaagtagttaataatcagagtataataataaattttatgattgtacaggttgccatatttgccagaaatcagctttacacaagtgatttttgagataaatgctttattgggcatgttgctatctgttcatttcttcaggctctcttgatttctattattgtgtgaagttaggccattagaaatgcgcatacctggaccatattatttaggctcttcagagaactgccatcacggagttagagtgctatgtccttggtaaatggaaagtaagagccctcaatttaataatacagtattttatagtcaaataatacatctggcttttgtaaaaccttaaaagtaatctggtatcttaatgtttcattatacatatgcatatatgtgtgtgtatactcacatgcatatatacagacatacatatgtgtacatatatttacacatatacgtacacacagtcatacacatataaaaagcttctctaagaatttggagcgaggaaaaaatgtctgtcttctgaccaacatgtatacattcttctaactctcatgtgtttgtttagtgaatgaatgaatactatgtaattaggtaagagaactattgccttaccctggaaattcgaatcgtaattcagtaaacaattttaggtacccatcctaagtacttgttgatcaaatactattactcttttgcttggtgagtattatttttcatctacttttaacaggttcttctttggttaaaaactgacttctaaaataaaacaaacagaaaacctacttacttctaagccgtgatatgtctgtattggaaaataggcactggcattgcaccatgttccccatgataaggaaacaataagaggaatcatgcgtatggttcctgtcctgtaaagtctaatgggtggctcacacctgtaatcccaacactttgagaggtgaaggcaggaggattgcttgagctcaggagttccagaccagcctaggcaacatagcaagactcccatcttgacaaaaaataaaaaattacctgggtgtggtggtgtacacctatagtcatagctagtcgggaggctgaggtgggaggatcgcttgagcccagcatattgaggctgcagtgagtcatgatcatgcccctgcactccagcctgggcgagagagtgagactctatccccaaaaacaaaacaaaacaaaatacagtacatgtctggcaagaaggagaagtacctagctcagtccattttctactgaaaatgggtaatatataaagaaaaggaatttatttcttacagttgttggaggctgagaaatccaaggttgaggggccacatctggtgatggccttctcactggtggggactctacaaagtcctgaggtggcacagggcatcatgtgcaagggggctgaacatctagttcagatctctcttctgataaagccgctatccctactcccacaataacccattaatccaccagggcagagcccccatgacccagtcacctcttaaagactgtatctctccatgttgctacattgaggattaagtttcaatgtgagttttggagcagatgaacattcaaaccatagcagtgccaaaatcaagcttttgttttgttgtgtttttttttttttttttttttgagatggagtcttgctctgtcgcccaggctggagtgcagtgagatgttgtcttggctcattgcagcctatgcctcctgggttcaaacgattctcctgcctcagcctcctgcgtagttgggattacaggtgcacgccaccacacctggctcatttttgtatttttagtagagatggggtttcgccatattggccaggctggtctcaaactcctgatctcaggtgatctgcctgccttggcctcccaaagtgctaggattacaggtgtgagccactgcacccagcccaaaatcaagattttgacagtggggctgtaatagtagtttggaatatacttcatttattctagttcttttctctattttattacctttctgaatgtgctctctgctcccctggggcccattcccaatccagtagcggcaattaccattgggataaacctcctacctctgaggcccacagttttcctgaccatctctctacagcctcacttccacctctacctctccataaaacaatgtgtatacttctgttcatcagctaaatcactatacctatcttacttgtttttctgatgcaacaagcagccttccaaaaataccaccaagtctaataatccttttgctgtttagtacatcttttgtttgaggcttactgtcacatgacagatgatgacaggcaacaaatgactgtttaaatggtcaacagatgtgcccatccaggtgactctcctaatagttgacacacagtgggtggagggattgggttgttccagatattccctgttgttgggctagcttgctcttggtgattatagtttgacttattttgcttttattcagtttttgtggttctgttttgctacttggttttgatacatgtaggtagtgtgggttccattttggtatgtgaaatttcatatcatgaagaaagttatgattataatgtagcgttagtaattcccagtggtcattcccaaaaaatattttctgagaatgccaggtgtatataaaagttatttttgaaagtacacatgtagtgtgccacaccctctatcaaaacaggcccacattactgaaagaaggagggaaactacccatccactattactttacagtacttaaaatatgcagacaaatacattttagcacgtggtgatctttgtgaggatatcctgtcaatcaagagagtaaatatcttttctctttcccatgaacctagcaaccaatttgcttatagttccttcaaagctgttgttaagattattttgtggctggttatgtcacttggctagaaaaatggtactggaattaagtcagctttagccctatgctgcccatctttcttaacttatggtcagccatatgtttagaccagatgaggtaggaggtatgattggatacaagtacattcctggaaaagataaccaaaatcatgttctactaaaagtgaattactgtgtttttttccttcacataagaacagcatcttcatacctatggcaagaacctgtcatttttttttctgatcacatatgtaaaaatcatttgttggtagtagcaattaacataaaagtcaggttagtgatgtggttggggtgagggagatttgaccattgagagacacacaagggggcttttgaggtactgtaatgttctctttattaaccatacctgtggttgcaatggtgttcattttataattcttctgaaaaacagacatgttttctacattctgctgtatgtgtaatatattttgctatatacgtatgttttactggagaagaatttcaaaaatacctaaatagcacaaagtagaaaatgttatcagtaatcctaacactaagaaataatcgcaatttttttggacatgtatcttcccagtgttttggggacaaataaaaataataatgtatatctactcccatgagttaagattttaagaatgcatacatgtatgtatgtatgtgtatgtacaatatatatgtgtgtgtatatatatataagtatatacaaacctgactttttgatttattatattgtaatattttgacatgaggtttcaggattctatagagttaattttaatagccatatagagtaccattgtttggctatatcatattatttgcccaatcctgtattctctaacatttgcttgtttctaatatttatgtgttataaataacatgtatttatcttgtaggtatttaaaatttaaataggctaaatgggacccttctttatgtagtatgtagatatttcataaaaggtacattttgttgggaaagataactctggcttcaaatgctttttgaaagatgatttttttcccctcaaagaaaattgaaaacaatttcactttttttttccttttatgaagcatgtgtgtgtcatttgttgtaagaaggatatggccctgacatcttcatactcgattgttctctgtgaagttattttatttattcacttattgaactcatttattgaacaccatttgtatgccaggtgctttgttccagatctgaggatatagagatggagacctggtttctgctttcacagcctggcgacataatggatagcagggtttgggatgttgtctgtccatagactcttgagtttatggatccaaatgtttttgcttagattactttgctgtgatttttattattagacaggtgatttaggagcttatgtaccagagaggctgttgctttcctccctccccagcccttccacccccagactgtatgttcttctttaaggttgagtcttggaattcagaacttggtgagcaagacctgactagaacagaaatggaaatgaccttttcatgcacagcatgagcatgacagagaatgggctgtgtgttaactcctctctgatattgctgaggtcctttccagccctaaaattctgtgatttttctgatacttgggcctttgaagatcctaatacccaatcctttctcaaacattaaatttgtagcagaggggaaaaattaaattcctcctttttgagacaccagctgaactttgcagtataaatagactcaagagtgaaagaaaggagaaaagtgcattcacccatcccaggaaatcagatggggattgagagtgtgtctgttcatcttctgtaaacaaaaccattagtaacatggttgttttttacttgatccctcaaaaaaaaaaaaaaaaaaaaaaaaaaaaaaaaaaaagcagctgggtaccgtggcacgtgctgtgtaatcccagcactttgagaggctgaggctggaggatggcttgaacccaggagttggttaccaatctgggtaacataatcagaccctatctctacaaaaagattaaaaaattagccaagtgtggctttccaactacttgggaagctgaagtgggaggatcgcctgagcctgggaactcaaggctgcagtgagctatgattgtactagcactgtactccagcctgggtgactgatcgagaccctgtctcaaaaaaaaagcatcgttttagggtttctatttgaatagacatttctgtggcttgagtttcgagttaggaatgttttggcatagaaaaacctgttggcccagaaacatctggcatcattcacaatcaggccaaagtaaaggaaaactaattttttaggtagaatgttggcacctggaagaatggaggctgtaagttcttttgctggcaaagtataaaaagaaatgtttagtggacaggtgtgtgagttaaactctagagtataactaagcagtgtggctgcccattttttacttgatttgcttgtgcttctaccaccttcttaatgtgtccctggaatgcctacatgtaaaaggattctgatggagaagaaacttctagaccttaagtgactgtcctggttccagcactcatttagttgcataaccttgggcaaatctctcaagaaatctgttccgtcttctgtagaatggggtaataaacacttactcagcctgtttcacaacattgttggaaagattaagaaagcatatatgaaagtatgtactataaggtgatacttaggtattataaaaaaagtgaacagggatcagcacaaaatgttttggctgctgctgctgctggtgtgtgtgtgtgtgtgtgtgtgtgtgtgtgtgtgtgtctgtgtgtgtgtgttttgtgtctctgtgcctttgtctgtgtttctctaccaccttagatttggcagccctagtatctaagtgtgaaagtttgggatggatctcagggtttttttggtaatgatgactgactggtatggctattgaataaaatattgaagatgctattggtcctttaggacaattagttttgtctctctcctttaaggtcatttggatgaagcagcagtttgtgtagaggatactagtttttaagatatttttgtcctattttattttattttattttattttattttcactgttattccacaaaaatctttgagctggcttacaaaaatgtgtacaatgcaacagaattaaaataagtagaaaaggaattggggcactgggaaatgggtagggaaaatacaataaagccatgttaaggcttctgggcagaaacatgcaaggcagggtctgaggcagtaggttgagggggggtcccatattcagcttcccagagagtagaacaaagaggggaacgtaacttttctttttcttttttttttttggaaatggagtttcattcttgttgcttaggctgaagtgcagtggcacgatctcagctcactgcaacctccgcctcccaggttcaagcaattctcctgcctcagcctcctgagtagctgagatcacaggcatgcaccaccatgcctggctaattttgtatttttagtagagacggggtttctccatgttggtcagtccgatctcgaactcccgacctcaggtgatccacccgcctcagcctcccaaagtgttgggattatagatgtgagccactgtgccctgctggaactaacttttcttgagaaactttgtcaatggagaagatgtgtccatgaactctatcttggatatacttatcaatacacacaacggtgatttgtgaacagttgcttttataccgtcaatgcaaattaataacactgagacaaagcatgatttcaggaaagagtaactataaggggtcaagatcatgtgtctcacctagatagctcaaaggactggcttgagccaaggacaatttttagaacatgtcgaggagaggataagctacctgtcctcaggcagtctaccacaaatactctttatctcagctgggagctgacatctctccctgaaaggtttccagtgatattgtggcacaatttgttggccagaatcctagagacccagggatggagatgccagtgctgtcttgagagttcagtgtcttccctgttggcatcttctctttcttggttctggcatatctggttcaaggattagacacatgaattgatttagttctttgctggagagggcagcaaaatgccagttgtgatttttgggcttggctatgttgggaaccactgggaatttgtggactgccaataactcattttgtactagcttttgggtgaccattcagtggctgttatttcaattcatagttcagagtgactgtatttagacccatcatgtttctagagttttttcctagattcaaatcatggtaaatgctttcattagataatttagcttatgccctttttcctacttttatgtttccctgttgttactagccctagatacttaaaaaaattttttttggaaaggactgtgtgtttttagatatggggattgtattctgtgctttagtggggcacagaaggagactgtctggttaaggcaagagattgtggtgctaaaaaaggaaatttggcaggcctgttcctggtacttttagtaagtaaagaaagagaatgacaggctggctggggattgtattaaagggagccctgatcctcatatgaccttattccctgaacctagaaagatggtctgcctatgtggcagttattctatggcgctaaagacagttttgttctgctttctgccatgtatatttaggggcctaacggagagatagaaacctgttaaggaataatcatggatgttcaggcctattgcttccttcacttatccagaagccagcctcaccaatgtccatgggcaagtttgtgttcacacaagttgcttgtaacaagagggaagattctcattaagaagttggccctaaaatcaggatagaatcaggctatatttgtgtttctgtcaatagtctgaattccttattggtagaaaggtcttataattatggggtaactttgccaactaatagtactggggtttgatgtgggttacttacatcagaagtcacatcaactttttgacattagtttctattccaccatgtgctccagggaaaaggagattgatgtggactattaagccaaaaatgagaatctgttattgaaacccagaagtctgaaataagggtttagtgattgttttgtttagacacaaacttttcttcatagatgctttaacttcctaagtgagtttatatatttttctaaatatgtaatcttttaaaaatattgcaaatatttaatttatgtatttgccatttaacaggtaaaacagcaccaggaagtcttgctcctgttttgcaaaggcacatttagagagtgacagaggtttcccactgtgtctgggacaagcctcccagtgtgtctgggacaagcctgaaaagagtgccattttgtctccctgaccatttcactgattctgtacttgttgtttatgaaacttcattatgtaacagacaaaaaagcaatttcatgagcaattcctggaataggcaagtggacaaaaatttctcaggtaccttctctggaggctgtttgtcttccattctggctgcctctcttgagaactggagtggcatagtggttaagaccaggggctctggagactgcctggatctgggtgctggtctgactcttgagctgtgggaccttaacttctctgtgcttactgtccttacctgtgagatggagatgattggagtctccaccatgtcaatgtatcaacacttctaaattatttagagcagtgcctgagacattgtaaacacttaatatatgttggttgttattgtaattttaataataatagctattaaattattattctatggctgtcatgcctgagagttcatcacaggggcatgggtgggtgggtagggaataagggctgagaatctaatcagttatttttaatttattgggcaaaaatgaatcaaataaccgtggcaggcataatgaaattgaggtattcagtgtgtggtgaggatgaactgttttatcacagttcctctggtgtggcctgtgtgctttgattgcaggtcagatggctagggaaaagagtagtcaagctgaatgctctgtggtgaggctgtgagagggacaagaaacgtgggtcaggacagaaggcgtactgcaggaacagattccgaagtgtgtgcacagcatcctataatttgggctcctgtgtattttctttagttggttgcatttgttaatatgttagtctggtgtctttaaccctgtgactgacagttgacaatggtgtagctctttaaaagaggtgaaactggtctgaccacagtttacccttgatagtgctttcactttggcaacaagacagagggagaaagtccctgcttctctgctctgggaatcttaccaaatcaataaggagtctctggtagcactaacctcttttaaatagcctaagtgtgagatcctgacctttttttctgtatgtggcctacttccttgatgagaagctggcttttatattagaacttttttagacgtacatgaaacttgaatcttgctatttgtttccattgttgcttttaaaaaataattttacaaatttattctaataatatactaacgtattttgtctccaggactagtgaaactttttaagatttttaacagattcatctagacacctaaatctctctaggacttgatccttctccacccagcagaatactgtactgtgctgtgatcatttctcagggtggttttggctgagggtttttttttttttttttttttgagatggagtcttgctctgtatcccaggctggagtgcagtggtgtggtctcatctctgcaacctctgcctcccgggttcaagacattcacctgccttagcctcccaagaaactgggattacaggtgtgcgccaccacacctggctaatttttgtatttttagtggagacggggtttctctatgctggccaggttggtctcgaactcctgacctcaggtggtcctcctgtcttggcctcccacagtgctgggattacaggtgtgagccactgtgtccggccttggctgaggtttgactctttgcacccacagtcccatgatgtgtgtacttgtatgtatatatattcacatctgaggactgacatcatttcgcagaccgggaaactaagtgtgaggagtacattttaaaataatttttacattatatattggcagatcatccatgtgcttgtagaaggtattatattggtaagctgcaggtagacaggaagactgaaagagaaggtagaacctgcttggatcccagtctgtgcatacctaaggagttgagttggcaattcctgaaccaaaggttctggtgttcagaaatatctccagttattcagaaggatggcatgacattctaaaaataagaaattatttgtagtcacatcagtgtgtaatataccttacagaatattagaagggagatgaagcatttggggattcaaaggaactagttgtagacccttaggtatggccctgagactacctagggtggcttttgtagcaatctaaacctgtatcctgggatgttagcatctctgaacaaaccttttctctcccctccattgagatcactttctttaaagtctttatgcatttagagagttgctgaggcaaggccatgtcctggtttgctctttttaaaatgcagatgtttctagaaatgactataaactgagtcctgagccacctcttgtaacttttcaggtcttggtctgggggaagataaagaaatggaggtcttatgcttcacaatttggtttaagtcaactatggcaaggtatcttgacttaaataagtgtgacttaagtaagtctgacaatttaaatattagaatggtaagacatttttgtgcctctatagccatatgtccatcttggggaggaaaaactgaaaataaacgatgattacttttcagtattctgtggaaatcttacttctctttttagttaatttttcagtggataggctccctacctgccagccctaaattcttatttattcctgaaactctggtttttttcttttttcttttttttttttaaagtattctgaaactgttttctgaccatgcttcatatattgaagtagatttttttcacagaagggtaaaggaagtgcattatgtttcatatgtagatgcttttcaagaacacacagcttctcatcattcattttaacagtggacaattttggtgcctgtttatggagattccttgggaattatcagctgatagaaaatttctgaagagagatagaaaatctaatctatttggatgtcttgttaaatggagctttttgagtataagggtttctgaagaaatataggctgtcagagctgatagagtttagagagtctctgtgtaccattctttataaataaagacagccaaaagcccagagaagtgaggtgcttgatgttaagatttagttagtggccccctactggtctctgagctgcccatcactctaccttgactaatagtgataactgatgtttctggcaacaaatccaaggtacaagttttccagggtcttcaaaggaaagctacattatattaaagttcatgctgaatatcttttattgtgttctgatagtttgaaaattggttatttttgtactgttgtaaaactatagtgcttaactggaaaccccagcattaacccagcctttgccagcgtttcccttctataggatgagaaagttgttgaagagtgaggaaaaaagatggtatcttgtccttaacaaaaggtctacgtggatgaaaggagaaactgacacttattgttagggaaatggtaatgcttacatgatgatctaatctgggtttgagtttcgtttttgaagtcaccagtttttattttggtgtttttcagatattcttatagccttcctggggagatttattttttggagacatcgctcacattgtttactcctctaggttaaatgtactaggccatctgttgttaattttgtagttgtattaaattccatcctttggctggattttaagcaccaaaagcaaacttagacagaagcaggagcatttgcaaattacatagctttgagcctaaatggtggtttttataagtgcagttttcaaatgggctgagattctattttgagttttgggatcagtaatttaaacacagggacctctacgagttctctggaaaagcccattttgagaccctgaacagttgttatgccaaagcaagctcttggggtaaggttggcagtgatgctgctgataaattacttttaagatgcttggggctgaaggacaatgattttgtaatagtgttttaagttctcaggctgacctatgaaatctggaagtgctcatctgaaaggccagtattctttctgacaggcacaggaaaaactcgtcccctgcttgatcctcatgcaagcatttcttggaggaagccaggcctgtgggtcttgggggccagaacagagacactgagagcaacactactggcattttgaatttctgctgaggctgcaaaaacatttcaagggaaatctgaagttatcccttcactgtctacagcctcttgaattgacttctgggtgttacagatgggaccagcgtgtgtaaaagcagaatttatattctatttggatatcagaatcaagtttctctttttaaaataattttatggtaagtcgtggtttctctgatatgatttctgttgtgagcggaacaaaaatcatggcgaaatggtgttattacttaaccaaattgcctcgtgtacagacaggctgaactggtgctttgcctagagttggcctggagttttcagaaactcaattgtggcctttataaggctgtgcctggggttgtatttccaatctctctcaacttttgttcttgtggaagggaggaagtagagctgtgacagatatattgccagatagcacacaatagcacacaaaacgagaaagacacggcgtgagccattcatggagacagatttacgctctgtgctgccctcaaaccatagatccatctatttcagagaaacaacttgcccactgtattatatttcagacagggacatggcttagaagagagatgctgactccttctgtttagcttttgccgataatgctgcacgttttgctgtagaattacttttgtggggatgggaaagtatgtttggcaaaggaaggcctgtctctagattggaagtggaagaagggagatatcaggagagtaattggccatgctgtcgccatagtgaagtatatgtgtatatttttgctgggttttgtttccagccaactatattatcaggtgttggattttttaaacttacttcacaataagaaaaacaaagctagagagattgtgactggccaaggccagaatgtttggcattcgtagtttctctttagttctctctgtaggaccatttcctggagttacagaagaattgaccagtgtgtcagtgtctttcatgtacattaatgggcgatagtattggtagtggttaatataatagcatgggttctggaaccagtctgccaggatttacattcaggctcaacaatgccttagctacatgcctcagttatcttacctataaaatggggattccaggtcttaccttataaggcagctctgagaattgtttagttaatattgaggcagttataactaagtgttcagtaaacttagctattgcattttaaaatttgtgttgattttatggaaataaatgatgatgtgtgatacctggtagattgttcggcagacatttcaaatgtaaaaaaataactctgtctgcattgaaatctttctagattgatagttttaaataatgaaaaaaatacttctgggaatgatctacatttggaagaaatcaggaaagagaagactgtgtgtacttttgcatttctatgttttgggcttgtaagatatgtgattgtatatttcatgtcagtaataatttattttggggagtagaagcaaatgtcagttacatacatcatctatggaatagatttttagttttatttattttaactggatgaaatggttgagtgttgccttacttggttgaatttagacatttgagaaaatttttttttaacttttgtgacacacaaggacctttgaatgaaatcagtccccttttcttcctttaaaaaaacttataagaattaccatttcttgactaaacagttgttttcttttaacattatatacttgtctctacatagatactacattttttagttagatgtgttttggaagagcattgactttttttcctgttacattggaaaaatttaatggcacgtgtatgttattcttatcatgaagtgggtttaggcatgctgccttatactaaatagaaatcctatagtagttgtttttcagaagtaatccattgattcaagtcattcattgattcatttatgaatacttaagtatggttacataggtagggattgtcagaattggcttttgagcattttgtttagcagttataatccaggtggcaaatatactgtctgattcaattacttgcatgaaatcactttaaacagctacttaagatgagttgtccctaggcctgtctttatctacttattgtgcatgtgtgctagcatacacgcattatcattgttgttttttattgtgttaaaaaaatattacaaagtgtaccatcttaaccattttaaagtgtagatacttcagtagtgttaagtatagtcatttcattgtgaaacagagctccagaaatttttcatcttgtgaatatgaaactctataccccttaaacaacaactcccctcccttgttccctccagcccctggtaagcaccattctcatttctctttctatgaatctgagtattttattttattttttattttttgagacgggctctctgtgttgctcaggctggagtgcagtggtatggtttcggctcactgcagcatccatcccccaggttcaagtgattctcctgcctcaccctcctgagtagctgggattacgggctcgcgccaccatacccagctaatttttgtatttttagtagagacagggtttcaccatattggccaggctggccttgaactcctgacctcaagtaatccgccagcctcagcctcccaaagtgctgggattacaggcatgaaccaccacacccagctgaatttgagtattttagatacctcatctaaatggaattacatagtatttgtctttttgtgactgacttatttcacttagcacaatgtcttcaaagttcatgtaccatatgacagaattttctttcttaagactgaatactgttccattgaatgtatataccacatttgtttatctccttatcctgtgatggacatttgagttgttttcacctcttggctattgtgaattagtgcttctatgaacacgagtgtgcaaatttctcttcaagatcctgctatcacttcttctgcatatgtacctggaagtgtgggattgctggatcatatggcagttttatttttaatttttgaggaacctctgtactgctttctataggagtcataccattttgcagtgtcaccaacagtgcacatgttccccagtcttttaaacagccccttccagactgacagagtggctacatacagaacagggcagctttgaagattagggtggcctgttccaagcttcttcagactcctcgggactggctaattatttttgttaaggtcatactgctggaccagggcctataggttggcactgacttacgcatagaatgttggcctgggtgttgatagacttaggctgcaattgctatgagtgatcttaggcaagttacctccactctgttccctgccattgtcatctgtagatgaggtggttatgcttctctctatttcttaatttgttccaaaatcttattgtttgttgtagaatccaggcatctaaaaaatatactgtgtgtagcttcgtgtaattatttgatagactggatttctttttgcaccagatagttcggtttttttgttaaatgtctcctttttcttttcttactctttaactgccccaaatactaagtgacgaggatggagaccttggcaattgagtgctatcagtgagtctgaatgcctgggttcaaatcctccatttactagatgtgtgaccttggagaatgtaacaaactgttgtttcacagtttctccatctgtgaaatggaaataataatacgtttgtgagacttaggtgagttaatgcctgtaaagtgctttgcatgtgtctagcccatagtaagcactcattaaactcttaattatcatataatatgctaattatgatggtggtaaatgagtgaggtcatcttccattttggtcatactccacatttgggtagctttagactttctgaagatactatttcctgtaatgtttctttgtaggtggggaggatatacctattacacagttagaaaaactgaacagtagagattatgctttatatggctgggattaaaacttcagtgtcgtgtttagagcctagtacttcctggcctggcatgttgtcctacacttaatgactgtggggcctgagtgggttctaatgttagaatctggtaagaactcttcctgacctctttgcccatttataaacagccttccagggtgacctgagtaagatcattttctagctgtgtaatcctggtggtatgaaaacactggatgtctatagttttttagaactgtgacttagtactaatactagcctcttcaatactcatactcttaaggcttaatatttgtctctttattgatttacatatttgaaacctagacagtcttttcaaaggtgagtagatattttatatgtctgccttctggtcggtagcagcagttgtgcagttactcagctgttggcagttctgttacttaatacagaggcagagagcgaaagacttattcagaaacaaaacctctgcttgaaaagttctcaaggccagccatggtggttcggcctgcagtcccaagctggtgtggcctgcagtcccagcactttgggaggctgaggtgggaggatcacttgatcccaagagtttgaggctgtagtgagccattgatatggctccgttgtctggagaaacacccagggtctctggtctcgtgctgagaaaatcagcaacatagatacacatggagtggtttaaggagcggaaagtttaataggcaagaaagaagaaaacagctccaccgtacagagggaagagggctcagaacggaaaacccccattgctggggggaatgccgtaggttatattgggaggctggatgaggcggtatctgatttgtatagggcccaggggattggtttgaccaggcttgtcattcacatagcccatgaaaaactggccctcctatcctagtcttttaatatgcaaacgcagctacctggctggttgccatgatgtcctgcccacatagtctctacctggctggtcgccatgatgtcctgcacacgtggcaacaaaaagtggcaggaaccgccatactgggtggacctggcttttagttgcctgcatttgcatatcaatgcttgcaggtctggtttttcagtctgctttctgttagaaaagaaatgttttgggggctgctttttcagtaaaagaaaaagcctcaccgaggactcttttaccctctctatctgcttaaaataattcttaataactcctgtaataccatgattgtgccactgcactccagcctgtgtgacagagcaaaaactatgaccctgtgtctaaaaaacccccaaaaacccaaaaccaaaaaacgagactgggcgcaatggctcacacctgtaatcccagcactttgggaggctgaggcgggtggatcacttgaggccaggagttcaagatcagcctggcctgttacatagtgaaaccctgtctctactaaaaaaaaaaccaaaaaacaaaaattggtctggcatggtagtacacgcctataatcccagccacttgggaggctgaggtaggagaatcacttgaacctgggaggtggaggttgcagtgagccgagattgtgccactgcacttcagcctgggcagtagagttaatgagactccgtgtcaaaaaacaaaaaacaaaacaaatgttctcaagtcatgttcaagagataatggcggacataatggaacctccctaaatctgattttctccagctataaaatgaagggcccagatcaggggatgcttaagggctttgcaagttctaagactcagccatcttgagattggaaacagccctgtaggttcttagggcatgatgaagacctttgaggagaagtattttaacagctttgtgtcttggggaggaagagtcatggggaggtgattaggtgggcattaaaggagcaactggagaaaggagagactaggaggctgttttgataatccacatgtgaggtagactgccccttcctgagtgcctgaggggcacttgcaccttgggacagggtcaaggttttctctgagatagcagctcccacaggcctaggagccttctttcatgagcttgctgccctggttcatgagggagggattgatggatctctgccccgttctgtttttttgctagcactgtcttcacaccctgttgccgtttatgttttttgatgaatgattaattagaaaaataatcatttgtaaattgtgagtgaaccagacatttggccctgactgtagggaaatggcgcctctgagccgggtgtagcttgcagccagtacatcagagctccagtattcccagaccagtgatgaatttacatgaagttccttttcagcatgttaatgactgttacagctgagtaactagcgaaaaataatagcaaatgggaagagtaaatatttaatgcttttatatcttttagcttactgtggaatatgtattttgatttaggaaggacatgagagtcttagagacattagagacaatgttagtgtgtctgagcctcattccttgtttccttttctttctttgcacttaattaaattaaaaggataaagtgagttgttgtgagatggattttactaggggagtggtttttctgtaagttttaggtcacaagatgcgtctttcctggcagttaaaatctgtatgttcagactacctcattgattacgtgcctggtgtgtacagggactcatattgtttctaaaattcagctttcatcattttactctcctgcttaaaaactttagtgactccacaccgcttctgggctgaaagatatactcagtagcctggcttttaagggagggcctctgtgctgtgagtccagcctcttttcaggctctctccctaaggcagctccatgtggctacattgctcaagccacagtggttgactccctgttcctgtaacttgctggaggcttcctcacctttgcacctctgctcagatcattttggggcatgaaatgatcttgtctttttctctatctaaagcctgcttttcctccaaggctcagttctagacgtttctgtgactactctgactggataggagcctgttcattttggaatatagagaaaattgaaagtaggtcacagttctctattccttccagtttgccacctctctaccacagacaattaataatgaaccctacttttccccacttcctgtttggccaccatctagtcttagacaaactaagctatttgtccaggtaaacaagtagttgtggactacagaaatttctgaagattagaattgaagttagtagggaaacaggcctcaaggatagtgccatattttctgagagcagatgattttcagacaaaaggttttaccaacagcattcatataaagtactgctttagtctgagtttgcaatggtagaagtagagtatctaaagaaaggatccatgccctttttttttttttttttaaatagagacaatgtctcactatgttgctcaggctggtctggaattcctgagctcaagtgatcctcctaaagtgctagaattacaggcatgagccaccacacatggccaatccatgcctttttactctgttgtagagactgtcttggagtgttgagttcagacccagataaaacaataatctttagaggaaatgaccaagatgaccagaggtaggtctgaaaacatgaaggccgtgtgggtaagagagaacaagggagtccatgccttctgttttcaaatatttaggaggctactgtcaggaaggagggatattagacttcatgtatggaaccatggagtgagaacaaagattgctgggtgtaggttataccaaagataaattttatgccaatataagaaataattttctcatagtgctgtgataaaatgaatttccccaggagatagtttcccaagtaggaagggatatgaacaacaggagctgatatttgaatcgtgaatatacgtggccttatagtaaaaggaccacagatactcgaatgtcagacctttaggaacaagtcattttctactgtaggattttggagggttcataatagaaagtaacacatctccttgtgtctaaaaataggaataaatcctaatatgaaccaaaaaatatattaggtacagttttctgagttgatattgaaatgatgaaaaagaaagagatctgggactgggggttcttaacacactgggtttagggacctcaagaatattgtttaagaatgacgagagatttgcaatttccaaggagtcataagcagtttcaaaaagttgaatgtttttgaggaacttaaaattctgttgttttcaaaatactatagaaaagtaatattacaaaattgtcttgacataagtaatttgggtatgctgtataaaggcttctaagaattaagaaacatggcccgggttgcaaattttaatgcatgactacctttttttctatagaatatagcttttgtcagattctcagcagtggctctgatccagaaaacattaagaaccactggtcatgagtggtgattttcagcttttttggtcttaacccacttaggtgggacagaagctccttatctcacctataccatccagcatcaagataagcacacgttaatatgaaccatatacatattttgttttataaaagtatcccataagctttaaaaatgtaattttgtcatacttaccttggtatagtagattgtaagttatttagagactataaagtcacagatgaatgtttacaagtactctttttggagttgggcttattctatctatgtcttctttagcagtggggatttggattattcttaaccataacacatacaagtctcattattggaaaattacaggacagaaacaaatgctgtaaatatgcaccactgcgcatcatgagattaaacagacaattttcaaaaagtcaaatttctaatgataaaattaaagtaagtaatttatatttaaaaagcaggaatagcagcaatgcaaactgtgattgacttaagaccacagtgaggttacagtgataataaatcattcttctggagaattgtgagaattttctaactgttggtgtgtgtaagtgcaaggtaggcactttgcataattgtatagtagctgacattcttgatatgccagtttcaagtcctttatatactttgctaacttgctgatattaatttattaatacaggtttttaggactcccctctcttatctaaggtaactagcttattaaagctcatattaaagaaaacaagtatctgtggaaatgttcttgtgggtaccagtgattctagagccttacgttaagaaacactagtctaatggatcaatgtataggtaaatgatattagacattttgagtaggattaagatccaggagactatctgaataatgacctttctctctctttctttttaaaatatggtcatcctaacgcgtatgataacccagatactctttctttttaaatacccttttatttaccaaccctcttaaacctggccctgaagttaagatcaacagctatgtgtgaataatttttttccttctcctttgctttgcttttcctatcaaattgaaataccctgccactttcttccctctctgaaaacacaaaagaggattaagccatataatggactatttatgtgtcaaattaaacgttttactctgaggctgtttctgagttatgcgagcagtaaaaatatgtattaagctgccaagccttttaaaaaatgcatgttatttagctgatagcctgtaacagtctgatggacccataatggtgttttgagtaaatacgcatttgaacaatttatgaaacttatgtttacatgtgtattaaacagcctgggtagggagtgaccaaaagttattaccagttgacagctgttgtctggtgaccaatttgaaatgaattggtggattcccttcagtgcggagtaaacaggtttcccagtcaggggagcatgctgaataattatcagtgtgtggggcctcagccctggaggcctgtgtgttggttgaatgaggtgctggaataaaatgtctcaactctacagtgaagttgcaccttagattcacatttatgatctagtttattttgtacttggaaatttataattatgttcacagagtacaggctgtgcataacaatatattctgcccttgggaagagggttcatgtttgtttatttcctttttttcttttttaactgacatataatcgtacatatttatggggtacatagtgatgttcaatacatacaatgtatagtgatcagatcagggtaattagcattccatcatctcaaacatttatcatttctttttgttgggtgcatttagtattttccttctagctatttgacaatacgtaatatattattgttaactatagtcatcttccagtgctatagaacactataatagaacttactcctatttagctgtagttttgtatcctttaacagagctctccctatcttccccacacccccttgtttatttctttgacattatccatctagggaaatgatcttgaaatttttatgatgtgtccatatcaacaatacatattttatatttgttcacttcaaaattatatgcatatttacatgtgtaaattttattccaaaattaggagtttaaaggattgagataaaaattaattacatatagataatttgattttctttttgtacctgaatgaatcctctttggcactgtctgggatgtgcagattttgccttggagattaaggcgagtgtcttgaaacctttgtgtaatgaaaagggcattgtggattatagtcattcataaacctgggcaaatcattcagctaccttgaggtctagtttcctcatttgtagaatatggatccctgcctggggggtttcataaagactactgatagtaaatgtcaggtgtctaccttgaccacaaaatcacttcctcagagaggctttccctgacctcttttctccatgatagctcctcttttcttcctgatcactctctaactccttaccttttaattaattaattaattaatttttttttttttttttttttttttgagacggagtctctctctgtcgcctaggctggagtgcagtggcgcgatcttggcttaatgcaacttccacctcctgggttcaagcgattcttctgcctcagctttccgagtagctgggactacaggtgcgtgccaccatgcccagctaatttttgtagagacagggtttcaccgtattggccaggctggtcttgaactcctgacctcgtgatctgcctgccttggcctcctgaagtgctgggattacaggcgtgagccaccgcacccggccttttatttatttatttatttatttatttatttatttatttatttatttatttatttgagacagagtctctctctgtcggccaggctggagtgtagtggcatgatcttgactcactgcaacctctatctcccaggctcaagtaattctcctgcctcagcctcccgagtagctaggattacaggcatgtgccaccatgcccggcttaattttgtatttttttttttttttcagtagagatggggtttcaccatgtcggtcggccaggctggtcttgaactcctgacctcaggtaatctgcctgccttggcctcccaaagtgctgggattataggcgtgagccactgcgcccggccaactccttacttctatttaaaacaactttttaccatctgaatgaatattatttaagtttctactggattgtaagctttgtaaggggagatatttttaaaattttacttttttggtctgttactgctgtatccataactcctagaatagcatgtgcatggcacatagtaggtactcagtaaatattagtcatgatttgaatatttcataacttagtagttgactaataaatagaggctgttactgttttcatggagtatcctacatataatatagttggtgttctaggatagaagacataattctctatgtatgaattgctctcactgtcacaggatccttagggtgtcacttttccagctggaaacctctgtggcctatggtgcctttgcccaagttttgctccggcctgctgggcttgttccacccactcagctgggcaggctgtgctcaggttttgctgccggcctgaatcccatgcctgccaagtgtgagcaggcgcagagcggcaaggggtgtgtgagcaagtgcagggtccggccactggcacagccaggcatgctggctgtggggtgggcagctccatatgaggctgtggctggaccaggtgtactgcaagcagcttccactgtgggcactggggaatgcggtggcacctggaagcttggagactccaggaaccacagaaccccaaacagggtgtcacagtcctggcttgtagagccactaggtttgggcttcctgaagggctgcaactcttctctctttctcgtcacctgcaatgtggctattgggggttgtgttacacccctttcagtcccgcaattcagcgggtgctgagttttgtcctgcatccaggaagaatgagatacgtggacaaccagagggtgagcaaggcggagaggggcttcatttaagtgacagaagagctcttaggagatcagaagtgggtagctcccttccacagcaggtcatcctgacgagtttccagctgtcagcagagaggagacccatagtgggtaagtgctttccatagtcaggttgtcctgacaagttgaggagacccaaagtgggtatctccttcctgcagctggtagtcctgacatctgcctgagtctacctgagtccgagggtttttatgggctcggaagggaggaagtatgtgctgattggtccatgggtggccatgagtgggcctggagaaagcaccgtaagttcttattccaagccacggactccagctggaactggcagcctggcccctaggcttcaggccatccctggcttgaagttggggtttcacaggggacctacccctttccgcccaggaacctgtctgcctcccaccgtcaacaagctgtccattgtgtctaggctgtttgtgcagagaggggtgtctgcagacccatgccaagctaccctcagcacccacccccatcctccacttccctcctgcacctgtttgcagccaaagtccagagggggccgaggtggcagagggctggtgtgtcaacatcacctgagctactgtacacctgactgggtcgcggcagtgcccagtctcagccacaactttgctctgcaccagagcaggtgccgggagtggggagaggccagggagtgggagcatgtacttccaagcctatgggagttgggcccccgagaacacagggatgcctgggtccagagccacagctgggcagctgcagctgtgcccaggagtgcagggctcccaccctgctaactcggtatggggtggggctcctgtcttttcctggctgtgcctcccctgctgcagcatgggccgctgctgccatcatcagtgggacccaaggcaggaagtgttttttcctgtagggaggatagatttttttttgtctcttacaggtagcatctggcaggcatgtagaagttagacatgaagcctccacccatggatctgagccaagtagactgacctgtgtaagcttcagatgcctcagtcttggtctccttagctccctgtttttgtcaactgtgccatccagctgagcaccttagagcttgaagctgagagcttcagcggggccagtgcctacaagggctgtgtgtatatgctttagaggtgggagaattgtgctgccagtgggcgtttggcccactaaggagaacacctgtgacctctgcaatcttccctacccctggcattccaagtgccattccaagtctgtagagataatagaacaaacgtaattttttgtgtggttggcaacgaagactggaggagaataaccacacctttggaagacttcggtggtcctttgaaatgaggagtttttatagaaacacttatcattttaaagacctaccatttttaaggtcactcttctgctagggctgtgaaatacagacatatgaaatgttttccagtgttgctctggtacttacgtgtgtgatgattttattggagaaatggatgaatatgaggttggagagtctttacatgtatgaactatcaaatatacagttcagtagcctgaaaacattaacaaatagcttttatttattgtatccttatgtctttcaatttggttcttatctgttgtctcttcagttgatgcaaatttgtgctcaacttttcctgaggggaaatggagagatactttcttggattagcttatgatcttgaacttgactattttaaagagtcatggtatataccaatctggattgtgtttaggatggggcttgggggatggtttctttgttctcttttggcccacgtcttctaacaacccatttgtttagggggttttatgctgcttagagtgagctgagaatgtgctcaagcacataattttagcctgtttttcaggtttacatgaaaaatgtaacaggcttctgaaacccctctaggttccagctttcaagaggctggtcaggaatgcactgaccgagagacttccctcaaaattaatttataaacacgctagaactttcctcaccttaattttgagaaaaagatctctctcatggcattttcaagtgttatggtagatggaaataatgaggaaactgtggcaccttgaacagagtgagaggtttagagttgtatagaccttagtacaaattttgactctgtcattaattacctgttctgtcatgagtgagttacttaacattccctgagcctcagtttcagcatctgtacagtgaggattctatttatttcatactgttgtggagacttgagcaacagagtgtgaaaacatctgtcagcgcctggtgtattttggacattctgtaaatcttagcagcccatttccccattctgggggtaaagccacaggacttttttggcaaatagttgagatacttggtgccaaaaggaaatttaactcatgccatgacaagtttttttgtataaggatgggattctggaaacatgataattttttctcttggccatatggattagcaaaggctttagaaaactacaaaaaagactaatttgttgcctctggatgtgtgtgttattttgggctgttaatatacttgactgcttgtttcaaggactggaaccttttcttttacctttaagattcctgcattttcatgtgctcattcagctgggatttgtgtttcatagaactggtagtattggaggtagaggagatactgtgatatcatatctctctctctgtctgtctctctctctctctcccactgaagaagagaagacaaaatttagagaatttgagacttgctcaaagttgtgtagctagttagcgataaagctggaattgcaccagatttgatttccatgacattgctttagcctggtggttctcaaagcatggttattggaccagcagcatcccttgggaatttgttagatatgcaaattcatgagatccccattcccttatcagaaattttaatacgctgtgtagggtgattctaatgcctgctaaaacttgggaaccactactgtggtctttacactattgggcagggagatgggagactacaggtagatttgctgaatttcatgggcaacactaggttttcattttaccttattgttctgccatttagatgtctcctcttaaaacatttttacttgcagtgatggcttccttagactcgtgtgtgattgttgctggggcagttaggtggaactaataggtgttgcttgttgattccctgctaccaagtactagttttgaaatttgagtattcattaaaaacaaatagggatttctgtgtctcactcctggaaattctgactcagtgggggtaaggattaggaatgtttaatttttgaaagccctgcaggtaattttttttctactttttaaaaattataatttttattttctttactgttcttttaagacatcctgttatagcatctgcaggtgattttgatgcccagccatgtttggggaaaaaagtttgggttctgagtgaaaatagaaaacgtaatgacatggaaaggaagtcaggggataagaaaagctctatggccagccatggtggctcacacctgtaatcccagcactttgggaggctgagatgggcagatggcttgggctcacgagtttgagaccagcctaggcaacatggcaaaaccatgttcctattcaggaacaaagaatagatcacaaattaaactctgtgggttttcataagtggaaagttggctttcgttgttctgtatttgggtgcttagtggacaggagttatctaaaagaagtaattatagttgtaatgcggaccctcaaagttgaaagtagattgaaatccattattttacaaggtggccttactatttatagtttgactgtaggtatggcagtgagagataaaattactttttctagctttgcaaaacgccaaacgtctttgaaattaagagtaaaaggggtttaaaatatgtactgctttataaagcaggaaaaccccactggaacattttgggtgtttacagaaatgggtattccatgggagagaacgtggtaacctatgttttgtcatcatttgtttaatcactgaaaatatattaacaggccaggcatggtagctcatgcctgtaatcccagcgctttggcaggctgaggtgggaggattgcttgagcccaggagtttgagatcagcttgggaaacacagtgagactccatttctacaaaaaaagaaaaaagaaaaaaaagtcacatgtggtggcacacccctgtggtcccagctactttggaggctaaggtgggaggatagctcgagccccagagatcaaggccgccgtgaactgtgatcgcaccactgcactccaggctgagcaacagatcaagactcttgtataaaaaagaaaaaaaatttttttaaaaatataaatatagattaacaaagtaacagggaatataatattttcaggttggtcatatagaggaaatactatattgtgttattcagcttaataaaatataaaacaaaaaaattattaactgtttgaaaaattgtagtcagatatttgattaggggtaggtcctgatttggatgaatttgaatcacattcgactaaatattgtgctttttaatactcactttaaaaacaaaattaattgggcaaatgttcatatccattttaaaaaactatcctcttaaaactagattgatagtagacattaataggcttgatgttgtttataatattttgctatattttaagagcatgcttttgtatattttctgttttagtgaagcattttaaaaatgcccccctcccacaactgcaggaataaatctaacagattttgaccaaaattactctaattttgaatttcttgaaactgggtatggaaactagacattaaaaaaaatctttatttttaagcacggtttcttggtcagtagcttctgtattacgggagaacacaagaaggggccttcttgacactcaagaaatgctctttttccatctacaaataggaagacaccctttgtggtatttttgttttgtgggccctgaatgaaaacgtattatgatcagttttaaaaattgctgcccctttaatatctgaatatattcgtggctagtgaagcacatgcatctgtcagatcatgggtgagaattcacttttctttttgcgatttctccagccacaaggacaaatttagttttgcagagcagtttgacacctctagaagcctgcggttagcctcggtgcacctctagcagctgcataggctcaagaggacctctgttcttccctttttggtttggttaccttacccctcctcagggaaaggccaagagactcagcacttcctccccaagtgagtttccttagtaacgtcagccttctctaatgctggccaagggtgtctttgctgggctgttttccctccaaaatagactcactggggtatagaattttttttttacgtgaagggtatagaattattttcagaatagcagcagggtaattaggctcattgttgacatgtcattgaagtctccatgtgacaaaattgctcctccctctttgagcactctgaatactcttaccctcttatctcgatctgctctttagaaataccagcagataatctgggagaaggccaccatagccatgcacagagtggggagaatgaggagatctttgctgaatgtcttttagttgtttgagttggagataaatgcagaatgacctccattttgccctaagaacctgaccttcttgtcactttgtgtaacattaattttctaatgtgttctggtcaatttgtaaaaagattttttttctagtgtctcagctgttggtttgacttttgtattttcattggtaaaatatgtatgtctttgctgtgagcagagagaaacagattaataaaaaccactgaaccagcattgcatatgtaattaattaacaccaccaggaaagctggttcatggttgtgtgtaaacttatttccaaacatctaaaaaacgtttagagttatcttattcagttgtctcacttctaagggataggttaggaagctgtaacgtatgtgtatgcacagaaactgttggacaatgattctcaaactttacttttcattaaaatcgtctggagggcttattaaaatgtagattgctagacctcatccatagtttctgattcagtatgcctgggtggggccttaaaatttgcatttctcatgtggccccaggcattgctgatgctactagtccaaggaccttactctgagaatcagttttaggatgtagatcttatgttcctctttgccaagggcaaatgaactgaattgtataggcttccttttcttttacaagaagcattgcctcttctaagtagacatccaccaaatatttatgtactgtatccatggtgccatgcactgagctaggtgcactggggataaataaaatgatctctgccttggggaactcacagttgagagaggattaaattaagaaacccaccaatcgtgattcaatatgagaagtgctgtggtgatgtcaggggtaggctttctagatttgctatgaggtgcagtctgagctttttctcagactgtcttagctttatacctacagaaataagtgaaagaaaatgaatcttctgcagcttaggattttgttagtgctcagatcagtttcctctcgtccttgactttgggcatcccaagctctgtattcagacactcctgaactggcattgtgagctctccaccccagcttttgtggaagagtccttcctccatttttaaattacaatttcagacactgtccactgtggcagcaggatttgtaacaagaccaagttaagtgatcttggctgaactgatttatgagacagcttcaaaaattcatgaggtaccatgggaactttctgtagtggatcagcatgccgcttttccttcacttcttcaagtagatcagacattttgtgataacacggcagtttatagtggagccttctagattatggctctgctgattaagacactaagacagacctgaagacaaagagaagggagaacaggatgttacttttagaaactcctgttatcctaagcttgagcagggactttgggtaaaatacatctatgtataactcaatttatacatagaactctctagggcaagtttttctccagtggtgatctgatatggagtgtcttggccattaataatggtcccataattttaagcacaataaaatgttaggtgtgtatatgcgaaaaattgagtgacatagtagttgtctctcctctctttgtgaaaaccggtagacaggaacgaaggatgtggccaaaaccagtgacaggttatggtgctttccctattttattgattgctcatttctagtctctaaccttatttgctacttattgatctagtagaaaagcaaataattttccctagatagtattttgttgagctgggctttgatgacttgtctaccaaagggtttttaaaaagtacttacctgctgagtggcagcctgtctaccatttaatgttattatctgtgagcctgggggttccttcttagtaggatcactgatgtcataggctgcctctttattctgcctactttcctgcaagataccacacatgcccgtggtctgctttaatggcctcacagtgcacacagccttagacttaacacaagaaacatatgagtgatcccattggagataatgtgttgccgagtcaatttgggtcagcatctgccaacatgtcaaattttcacactaggttgtattttgagatttttattcatgcttttgggttcaaatttactcacaaataagttttgaacttttaagtgctaaaactgctgagttcttgactatctgcacttggggaggggaaggttaaagataaggggtgggtatgtatgggaaggaaacagtagcacagatcatctaacataggaggtaagatagatttcccaatgtcatatataactttgactatatattttttcctatgtttacattctcctgtttatgattatactcttttggttcatattaaattggtgtttatctcctaggaatatatatggcgaggtgtgtcataggaagcaatagaaaaagaatttggagactggtcacttataattcttgaataatataactatgtagagttaaaagcaaagattgatcctgtcattcatgggattgatgggcatttttgctggtatcttattattgttcatttctgagtaggtaatatattaatatgatcccaaaagcaaaattgtattaagaagtatatagaggaatgtctcactctcatccctggacctatgtgccccattcttcaggcttttataactactttattagtctctattacatcttttgtaatttcttaaatagtgtgtgtactctcctatttgtgtatgctctcgctttttctgccctttgttataccatatttagcatactataagcactgttctgcatcttgctgttttgtagttaccaatatatcttggagatcattccatctcactacagagagagcttccgtattcctttttatagctgcttaatatttcattgtatagctgtaccataatttacttaacctgtctgacactttggttatttacaatcttttgctcttacaagtgatgctgcagtgataatgttttttttttttttttttttttcccgagacagaatctcactcttgcccaggctggggtgcagtggcacaatctcggctcactgcaacctctgcctctcaggttcaagcaattcttctgcctcagcctcctgaatagctggaattacaggtgcccgccgccacacctggctaatttttgtatatttagtaaagacggggtttcgccatgttgtccaggcttgtctcagactcctgacctcaagtgatctgcccgcctcggcctcccaaagtgctgggattacaggcatacagtgaataatcttgatcatatggcatttcatcctgggtgtgtgttcagttgtaggataaattcccagaagtgaaattgttacagtgaatgtgcatttgtaattttgatagtcactgctaaatccctctgtagaggtcgtactaatttatattcccatctgtttaagagtagagatttccccgcagtcttgtcaacagggtggtggtgttaaacttttgaatttttgccaatctgataggagaaaattggtatctcaaagtggtttcaatttgcatttcttattatgagtaatgttgagcattatttactatgtccaagatctgatagtatttccttttgtgtcatcaacagtctggttatatttctttcctgttttttctatttgattattgctatttttttttaatttttaaaataagctattttggaatacttatagacttaccaaaaagttgcaaagattacggggattttttttttcttttcttatgccctcattagctcgttaattgggttagatggtttgaggaaggacaggtctcctggaattctgtggcttgtcataggtttgtcagcccaaataaggatgcacatccaattcacgactcctggctgcctctggggattttccatatggagtgacagacttgggaaattctgctgagcttctgactagcctccattatgaggcatataattcagagcccatcttccattattcttcttttactagtatcaattattaactagaaaggttattgaagtgaaaaccttgcctcaagtttgtatttcttgagatttacttccaataataaatgtggttttcaagtgactgaatctttcatagaccaagtttcgagcacattaaatatttggtggttttgcgtcctctctgcctcacatgctaattgagaggatgagtagctataatttttctggagcttcaggctgtcattctgtcctgttaattggttcttggagtaaggagctaaaatgtggaggcagaaatgctttcccagatagaaacatgccttgaagctttgtgtcctgtaagggtccacatagcctggaagttaagaatactggctctggaataaaaccttgtggattcagattcctgctttgccactgctagatgtatcacctcggacaagttacctaacctctttgtacctcactctctccctgtttataaaatagggattagaacagtacctgcctcatctagtagttgtgaagattaaatgtgatgagacatgtaaagtgcttggtacaggcctagaacattgtaagtgctcaataaatactggccgaaaagtcgtacagggcagtggtttcagaggccatgcaataaaatagtgggttatgttgcatttgacttttgttgattaacctttcttcttcctctattctttaccttgtgaggcacttaacctactaactgaaatgccattcattcagccagtatttgagtgctcagcaagtgccagactctaaacaagatgatgtgtaagatgctgcaaggagccctcgtgccttgcagcctgagcacaagtgcctataaacgcaaggctggttgtcgtcattgccatccccagtatactttgagaatacaaaagaatgtgaggtcactctcctttgactggggtgacgaggacatgcattgtgaaagggggaactgttagaactgggagccattcgtaagtgaaataaggataagagggatattatcagcattgatgctaattagcatttctgtagcattttgcagtttgggaaacattttatgtattttattttatctcagtctcataaaagagcttgaggtattattatctccagtttacgactgaagagatggggagtcaaataggttatctgattctcccaatgccatacagctccttggtggtggagttggggtttgagtccaggtctcctgactctgaatctccacgtgcttccctctggtctcttgagtgaaataacccgtactagcaagaaagagaagagtatgtcggcaaaagagaaacctggaatagttgccaattgtccctaggttcagatcacatacttctagggcatcagagctagaaggaacatgagatcagtgcatcctctttatttgactaatgaaaacattgatgtgcttgtgagggacttcgagaggtcaatgtggtgctggaagcagctcaatggagagggtagacagttccccttggatgctcatgtgtggtcttctggggattgattagttgctggtaaggaaggagctcattttggggaaagtaggtacatagattcatagagggaaaacctttattcagaagcaggcagtttttctgcaatatcttcctgggaaacacaaataaaagggctgtagtttagtattcagatgtggttctggttgtgcaaggataaggagaaaaggcagaggcagggtgagaaggaaggaaaatgaatgactgatttgaaaggtcagtgagaagtctgtgaaaggtacatacttagggtctgtagggcagtcatttgaaatccaggatacttagtatatatataggaggacttcgtagtagttctctgactggaagaggactgggctgccttgtgtgtgtgagctttcatcatgggggcagtggttactacatgctatttctaagaattgcacttgtggggtgatttctactttgggtaggaggttattctaggtagagctagtgtggatcagcaacatcagcaccacctgggatcttgttagaaatgcagatttggggactcctaccctagacttactgaatcagaatctccagtgggtgcagttcaagaatgtgtattttaacaagatctccaagtcattggtctgcatgttcaatgtttggaagcattgctctagtgcagaggctctccaagatcctcctttgggttctcggcttatgtgattaatgtgccattcaccaaacatttattgaatttcacttatgtaggcacagcacaaagccaactctcacatggatcctgcttgcattctagttgaggagacaggattgtttacaagtaactattaggttggtgcaaaataattgaagtttttgccattactttcaatggcaatttcagtggcaaaaaccatggttacttttgtaccaacagtataaaaacagtgttaaaggctagtacaggaggcacagagaatgcctgtgaaagtggagggtggacgttttcataggtgtgtgcgggagcaggtggcatgcatggtagggggaatcattacttctgtgcaggactcctgagtaattttaatctgtggtttgctgctgtgcaaacccagaggcctgtctacaacttgtttaacctcccccagcccttgactgggtttactttattggcctgataagtagtataaaaattggcagagctattaagatgactcatggaaggatatcctcagcatctccttttggatctcctcacacctgcactgcttcttcttaaatgcctgaatatccaccactttgtaaaagaaaaaaattgatttgtcactgaatttccatgcctcagcctgagagaaatgtaaatgttgtactggcctttagtactctgccttcaagcctagatttagagctgatcattatacttttagagtaggctaggtatgaaaatagcagcaggttgaagagtcagaggaagctgtttgctctcatctgctggtttggtcagggtggaagtacgaatattaatacagtccacttaaacaataaaatagctcccagggaagaggaactataaacttcagtaaatatcagagatgttaaatgctaaaaataaaagctctctgcagttgtttggctctttaaagagattgtttattggtcaagagtgctagtctgtttggtcatgttttgctagctttttaaaatgcatgtatgtaaatgaattagaatataagttaattaagcagggcagtgtttctagaatgtgaaaatagtaacctggctagttaatttaattaagtccttggtaattttcttttagaaacaagtttcatcttgggaggtcacaacgtcctggctgctgtgcttctgagctttaccttgactccatcctctcctctctgtcatccttttctctggctctgtcacttgcatttgccccctgacttgtcaccctgacttcatttcctctctcccagctgtttacagtgctatcacagtggtctttcagaaatcccaaactctgctgttgaactgggttctaaaaaccttcagagacttcatgttgtccataggatacactgttttctgaactccttagtgtgccatattaggctctctacagtctggctctaaaatacaattttttttttttttgagacggagtctcactctgtcgcccaggctggagtgcggtggtgcgatctctgctcactgcaagctccgcctcccaagttcacaccattctcctgcctcagcctcccgagtagctgggattacaggcgcctgccaccacgcccggctaatttttttgtatttttagtagagacgggatttcatcgtgctaaccaggatggtcttgatcttctgacctcgtgatctgcccatctcggcctcccaaagtacaggcatgagccacggcacccggcctctaaaataccattatagcctaattttcaggcttactttttcttgtggtccaggccacaggactatctgctattctcaatacaaataaaatataaccagtagccaccctgcagtagtagggacaattcaggtgcctcgacaagcattgtctgattacactattcaatacaggatcaaagagttttgtcatttgcccaaggtcatgtaccttgtgttagagctgagattcatattcagtattttgatattctgactcagtttcctgctttcatgtctctgtgctttccttgtatgttttctttctttttttctttttgaggcagggtcttgttctgtcacccaggctagagtgcagtggcacaatcacaactcactgcagcctcaacctcccaggctcaagtgatcctctcacctcagcctccccagtagctgggactacaggtgcacaccaccatgcccggctaatttttgtactttttgtagagacggggtttcaccgtgttgcccatgctagtctcaaactcgtcagctcaagctctctgcctgcctcggcctcccacagtgttgggattacaggcgtgagccattgtgcctggcctccttatgtcttctatgcctagactgtctcctaccctttttctttgcagacttggaaatgtataggtgttaggtattcctaacaatgtgcgtgcataggtcatcgggcctatctcaatttagcctgatagtgtaaatactagtactactactacctagtgctagtactaagagctgatcccagatcttaatttttcttcatttctcctccaaataataggcggtttataagtattatggaatgaatgcatggatggatgaaaggatgactggatagatggatggtcagtcccagtggttgggtccgtttgtgatttgaccaagttcaaggctgtagaattgctatgtggaaagaatgcatattatttcagctatatcaaatagcacctagggacggcctgactgacagggaacaaattgtcagccctcatttggatccaagtggaaattaatctgaagaatttggaatgggcctattcgtgggaaattgcttatttttataagagtttattttctgatttgtggctatattcgttggctagggccactgtaacaaagaccaggtgacttaaacaatagaaatgtattttctctcagctctggaggctagaaggctgagatcaaggtgttgagaggtttggtttcttctgaggccaatctctttgtcttgcagatggctaccttgctgtgtccttacatggtcttccctctaggtgcacatatccgtgttcagatttcctcttcctttaaagacagccgccatactggattagagcccaccataaagacctcattttaattaattacctctttaaagaccttctctccaaatacggtttcattctgaggtactgggggttaggacttcaacctacaaattttgaggatacctcattcacctctacccaacccatcccctctgccttttcctcttgttgtctttcttctggcagttttgtttcactcaagggcagtcaggaagagaagtaaagatagaggaaaaggaaatttattttgggtgcagttcaggaggtgtagctggggttggggatgggcagtggctgaagctattggtggaaatgagattttgatattgcctatagattagtattgtcctggaacattctgtgctggtttcctggacagccgatagctggctgtgtgtgttggagggcccagggaatatctgttctgttagtaagtgagggggaaattgataatcctgcagccggcctggagaagtaaggactctatctttgtctgtcagctcttcctcccagaagtagctcagagacttgctgagcacacctagggtagaggccaggatagttgagttttggacgctctgccttggctaacaccttgcctggcatctagcagatgcttatgaaatgtttgtcaaattgaattacttaatttacttgactcaaatattttgttcttctccaaaccttttatgaggagttttttctccacctttgtttgttaattcccaaacttctctccagttctcagttgtggcttatgtcttttctttcctttctctttgtaattatcaggtaatttattaaatggagacaagcttaactagacattaaataattgcaggtgtgcagctgaactgagccgctgtcctttaactaggaaatcacagctgcttgtgttgtattgtgtgatgagattacacttcacctcatttggttacacgatatcttgcttattgtaaggtaaaagaatgttgaagcttctgctctaagcagtacacaaaggctggtatgttcccaggaaaccaacgtaaaaagtacttggaggtcaggtctggagcctttgcaacctctgatgcttctcttttcttggaatttttcatttcctttgcctttttctgtatagagaacacctgaattactccttaacttgagacctgtttcacattttaaaattttcttttggtcaccttaactgtaaaagcaagatttttctgtttccttctaagagattagcagtgggtccattggttagctctttttttgctttcattatcagacctcatctgcatactttttatacaaatttgccccattggtaagaattgtagcttttatgaatgttaattttagtcataggttaaattgtgatgtcaccagtctgttttctttggctagtttcatagtttgtgactattgctagaggtagacactagttatatagcaagtacctagcttattacagaactcagagtatgctgctaataaaggattgcttgattgcttgaagggtatgcaggtgtaagaaatattcatctttcaattggtgtcaaaatttttatttaaaaaaaaagtcatgctgccacttcccagctttgtaactttgggcatgccactgaaatatcttaatcattagatttatcatctaggtagttgtgagggttaaagaaattcaacaaatatttgaatgaactatcttttgtgcctttctggatgctagggatatatttgtgaacaaagcagaataaattcctatccttgcgggattaacatatatgaatctggttttgactgtcaactggatggagtccaattggtgggagaacatgatacctaccatttatgaaaaactctttaaactgaaatatgtgcctaataacactaactttctttattagggacattttaaccccatttgggctttgcagagtaggtcttagagaaagcccttctccatacttgttcgttcagtcgtgtatcatgtacagccatccattttatggttttggctgttgtaaataaaatggctagagcctgtgcatctggagttgtggtgactcttagtcttgggatgcgtgcctcttcctctcggtcgttgctttataggctgtctctgaggttccagaaggggctcagagaatgagctccaactgacatgtttgagcctttgagtctcttcatgaaagctcagtttgttcaagtaaaatctgaatggctcagagaggacactgtggtgtttagcttaccaagcccagtgtgatatcactggtttgttaatatctacagaaacacacacaggaaaaatattctagagcatcatattgctcacctcctctaaattcttttttcatggatgatcgaaagaaaaacctttttgagtctctctcttcttttttgtgaatgactaatagaaagaagacgacactggtaactttcagaagcattgtgatagcattctgatggtgggattatgatgttcagacatgggagggtattagcaaccaaacatcatttcctttaggggactggaggtagtggtcatctgtgagtctagagctgtcttcgagggaagtgagcagtggctcttccaaggacacagagatgtcaggcacctctctcatgcatgcaagtgctacatattatgtccacagtatctggagtatttaaaccaggaataacacgtagtctttattattggaagaaataaattaggtcagagttagtatgccatcgtgtgatgccagtttgtattctttattttctgtacttgcttctagagagggagtaaatactatgagataatgaagaaagacatgtttttgtgacttttctgatttaggacactttatgttgtggaggttttttgaaggatttggaatttggttgcttattgagaacctcttgagaaaatcagattatctctgatacacaaccagtcctacattgagttttttccatttattgctgtagagacatgaacatttatttttattgaagctgagagaggggtgttacatggttgtttatcagctctgccaaaagtagctcagacatccctgatgactcagctgatgcccttgctgcctgattgggtgcttgtgtactaagtacttgtttccttgttgagggctaggaatatgtcacaaagccccattgctgtggggattgttgcagtgagcagacttagcggaactgcacaaggctggctagaggccaggtttagactaccttggaagaattggcttaagggcagaggagaggtttagaaaactcctttcttcctctttggtggcattaatctttgcgaaaccaggctcagactccttttgcacctttcccaggaatggggtagcatagatcttcttcctatgtgaatcacagaaagggactttgtgtgggtgctgtgtgttcattgtaaaccactggtgctgctatctaggtggagttaaagttgataccagcagagtaagttagcctgagcaggaggatggagttctgcagtacagccggaaattttcacttcatagtgtttctactgtaacttctcaccctgtgttgaaaaaggcacacctggccattcgcatagtttggatacgttttaacccataagagtgctgtccttaaagatgatgaaaagagacattttagctccttggaaataagcacatttctgaaaccacccgtctgagtgcacacttgtgcagataaacaggtacttttgtttatgctctgactcaagtggaaagggcaaaataagagattttccttctcctgagtcttttcactgtgaggattttgtcctttaaataaaataaaccggaactgtaacctttattatgggaggagtgtggaggagttaggaatgaggcaaaatgccctccctgtttctcagataactcttgctaccgtctgagcagtgtttatttaacagatttaatgcattgcctcaatagcatcacacgaaacatgtcaccccccctttttagtttcttcccttcaaaaattttcttaaaaatgccagaaccttaccaagtcacttaaataaatcagtccaagtatgaaatgatctctgaagtgacttaacacaaatgattctgactttactacttgggagactcttttttgatggccagccctctaaattgtaggaagatcattttctagctccctattgtcaaaaaacaaagcaaaatcaaattaaataagtcccttaattcccataagtaattttaaaattatctcttgtatatactttacttgtgtgcagcttgcaactgaatatcattgtgagagctatagtttgtcagggtttagatcttaattagctcatgagattgcatccttttgaagctgtataccacaggttgttggctagttttccaaaagcaattaaaatgcccactgttataattaagcctgttactagttgtatgttctagttataaaatatatttggcaattaaggaaactgagattgaggcttttggcttggctctttgagatgcagtagactggcttccaccttgatctgttaggatgactggtgcggatgcctggatgatgggacatgtcttagtccttgagtacctatctttatgagtaagagcaaccacaggtttttacaagaaagctaaagttagagaatgtgactcgtgtcctcacatatgccgattatgtcctacttggtatacaggagtcaaaacctaaacttctaagttgcagtctcttagctgagaagtcctttttaaagaagcattcccttatctttaagaagatggctcgactctgactgtgaacatttaatctgttaaactaacacctccattgcgctgtttaaatttctgtctggttgttgaaaagaaggtgtgggagaaatgttgcaggtacatgtggttaatgtctgtttctgaactgtatttcatttaggagttgttaagctgtgtgcccaccatctcagagacagatttgtctgaactggcctgtggaggaagatctcattgtcagggctggtctcaatggcagatacagttctcagtggtgtgctttgcgtgtcgtgtcttttattcttcctttcctcctgctcacccttaggaatgtttcctttttgtgccttaacaccagaacggtatggtggctgagaccatgggacaaatgcgtcacttagtgggcagatagaaatcagtatttaaagtatgattgaggtttttgtgtttattttgaaattcatttagtacacagggaagaaaacagcacttggcttatgtggttctatcccattgctttgcctgtttgtgcccccgtgcaattaacatgaaaatgatagtttaagaatgagctcattaacatttagaactgggtaggaacagggcttcataggatgttaaaatcagagaaaaagagaaaagagcaggtgctttgtaaatactatgtggttttgagaaatagtagaaagttgggtcttattttaaatttccttttttccagagtccctttaaagttgtgattaatgatatacattattttctttattgggcaaaatattagaattattagagatacatttttcttgggaaaaccactgtggttctctggacatttctatgttaactgtgtcatatattagtatagaataaattcacaggcttgtgggtctgaggacatttgcttgtttcctttaaatcaatttatacaagcacttcctatgcttccttcctaacaaattttccataatttatttctggcctcgtaaaaatagagggaaaataaccaatcaaattattagctcgattccttacatgagttcttcaatttttcctaggtaccaaacaaaataaaaccagtctttgtaacaaagattattggttctgaggaaatgactatccacaaagtgtacatttgtgtgtaatatgtggtatgcattatgtgtggtattttacagttaaaatacaacataattaccataaaataatgtatatgaaatgagttgtaacaataagataagattgacttttaaaaataaacaaccaagaataaacacagcagaattcctaatcagccttactcataggtcaaatttagctttgatgtcctttcctccataagccatatttaggcatcaattcagtataatactccttctttgtgctcccatatcgcacttcatccttccctcatcatggcacttactgtgctgtgttgcttgtttggctaattccttcatttggctataaactattaggatatgagcagacatggtgcctttttcactttgtcctctgaattctttttttaaaaattgaagtaaaattgacatgtaataaaccttggatatttagtatacaatgtgttaagttttagcttagtgttgtccatgaaaccatctcacagtgaggatcatgaacacatttcccaaagtttcttcacgctcctttggaatacttacttctacttctcttctttccttgtcttgagacaaccattgacctggtttctatcattgtagattaattgacacttccaacaattacgtgtaaatgaatctcatatagtatgtactgttttcttttccttggcttctttcacttagcataattaagattcatctatgttgtagtgtatattgataatttcctttttattgctgagtagtattccattgtatggatacaccaaagtttgtttatctatttttaaattgctgagcatttgagtaataccagctttttgcagttataaataaagctgctatgaatactagaatacaagtcttcgtatgggtatctacttttgtttctcttgggtgattatgtagggtggaatggctgggtaaatgggcaggtgtatgtttaactttacatgaaactgccacagttttctcaagtgttagtaccattttacattcccactagcagtgtatgacagttctagttccttcacatttgtgccaacacttgatatagttgatattggtaagattttagccattctaataggcatgtagtaaaatctcgttgtggtttacattttcctttccctactgactagatgttgagcatcttttcatgcttttgctgtccatatatcttcttttgaaaaccatctgttcaaatcttttgcccatgaaaaaaaccttagttgtttgttttcttattgagtttcaagagcttttgtttgtttttattgacacatgattatatgtatttacaggggacagtgtgatgtttcaatatatgtgtacattatgtaaaaattaaatcagggtatttagcatatctaccacctcatacatttatcgtttctttgtgacaacattgaaaattctctgattttgaatactacaatatacaacccatctttggtatcaaattttgaaatatacaatccaatatcattaactatagttaccctatagtgcaagagaacaccagaaattattcctcctatctgtaatcttgtacctgttgaccaatctctcttatgttcccctgctttcccttcccagcctcagtaactactattctgctttcaagagtttttttttttttttttgagagggagtgtcgctcttcttgcccaggctggagtgcagtggtgcaatctcagttcactgaaatctctgcctcccaggttaaagagatcctcctgtctcagcctcctgactagctgggattacaggtatgtgccaccatgcctggctcattattgtatttttagtagagatggggtttcatcacgttgtgtaagctggtctcgaactcctgacctcaggtgatccacatgcctcgccctccgaaagtgctgggattacaagtgtgaaccactgtgcccggccttaagagttctttacgtgttcttaattgaggtgttttattaaatgtatgatttgcagataatattcttccagcctgtggtttgtattttcattgacttaacggtgtcttttgaataatagaggttttaaattttgatgaagtcccaataccagtttgttcttttatggagtatgcttttggtctcataactaagaaatctttgccaatttagggttacaaagtttcttctagaagttttgtcatgttaagttttacatttaggtctatgattcattttgaattaatttttgtatatggattgaattttttttttttgagatggggttttgctctgttaccaagtctggagtgtgcagtggtatgatcacagctcactgcagccttgacctcctgggttcaagtgatcctcccacatcatcccctcaagctgtagctgggactacaggcatgcaccaacacacccagctaattgtgcatgtgtgtgtatatgtgtgtgtgtgtgtgtgtgtgtgtgtgtgtgtgtgtgtgtagagaccaagtctccctatgttgcctgggctggtctcaaactcctaggctcaatcgatcctcctgcctcagcctcccgaagtattgagattacaggtatgagccactacacccagtgtaaattttttttccatataggtatctaattatgtcagcatcatttgttgaaaagactgtccttttccattgaattgcctttctgcctttgtcaaaaattagttgtctatatatgtgtgatctatgtaaaaattccttattctgttccattggtcagtgtgtctgtcccttcccaaataccccacagttttgattactgaagctttatattaaatcctaaaattgaacagtgtgagactttcaactttgctgtttttcatccttcttttaactcttctactggttcctttacctttccatagaaattttagaatcagcttttctgtatccacaaaaatgtccttctgggatcctgattgaaattaaattaaatttgtataccagtttggggagaattgtttattgtgttgagtcttctaattcacagtcattctccatttattttggtctttctgtaaattttttagcagtattcttgtagtcagtattcagcatactttatatatatatatattatgtttactctttttatgtaactttaattcaaaaggtacagagactctcccttagtgctgttcttaagacatgtttatatgacatctttccattagtatctttggtcgtgttcctgcagtatcctcagttgtgctcaccactgcttaactcacctttgcagccaagtttcattttgagtcaaatctaccagaggaggtcatttaccacctgagaaatccctcacttagttttaacagaaataaataactttaaaacaattgatacagctccttctttggcttgtataattttcttcaggcataagtaaaaaaaaaaaaaaaaaaaggaaaaagtgatttcaaacatgttcagagtaactgtaatccagctgtggttgaaagaagaattttgagtggttaaagagctgactgaccatgttggtggctcttgaaacactatcagcttttcttaaccagaaggcaatcaaggacatacttgaggtcgggaacagatatttcataggccactggagtgctgcagtggaaggattccctccagatccttggttcacagacagggaaggtgaagcctgaggagacttggttacttggtttccttggaggatcatatgctcagtgagctcttcctgaaaaccagccctgttcccatcagaaactgcagagacatagtacttcccattcagcaggttacatggagtcagcgtaggcagtcaaaatggagagatgaaggattggtgttgggtaatgagagcaagggatggtcatagaactcagagatgataatgtgaccaacaggatcattattcaaatttcccaagaggcacaaatgtagatgatgattgctttcataagctagtggagttaatttctgtcagacactattctaagtgattttgtatatgaactcatttaattttctcaacaaccttgtaaggtataggtaccgtaattatttcattttgtgaatgagcagaaattaagcacagaggtgccagagatcttttctcataggtgatgaaggtaggagaggaacccaggcagtctggctatagagcacagagtcttaaccactacactgtctggctgatggcaaagagcatgtctattaagaaagcctatggggaaatggtcgccaaatccttctctaattcttggggaccctgagtttcagggttttttttggttttagaaataagggaaactcctgtcaaatgataagattgacatttttcatttttgaagttctaaatgtaaagctctttgaaatgtataggttttcagatactctgtgtgtctgtgtgtgtgtgtttgtgtgtgtgtgtctgtgtgtgtgtgtgtgtataagttcagctcctttaaaagccccatctctgtcacaatcacatttttttttcacaccgcattccaccctactaatactcagagcttagattagggaggtgactaggatactgttaattaaaactatatgacctgattagacaaattaagagaaattttcgatagggaaaagaagcaggacaaggactgaacttctgagagatagtgaaaaatcaaggtgtttttcttattctcagtcacttcacattttacttctgacactagatgtgtggtggattttccccacacaccaagcagttctccagaagacatcaattaattagctgaacttattcaatttaattttgaccctatataccaggcattctgatactgtctacctggagatagtatcagatctcacaatctcagggctcagtcccacacaactgcccccgacttcagacaccaattgcaagttccaggtgatgtgtacttctgaccaaccagctattaatcggggttctcatgaccccctcctcaggtttgattaatttgctggagtgactcagagaacccgggggggaaaaatttgcttatgtttgcccacttattattaagaatattacaaaggatacagatatgaacagccaaatggaagagatgcgtagggcaagataggagagaaggggagtgagtggacttctatgccttccgtggacttgtcacccttctggaaactgcacgtgtttagctcttgcgaagctcatttaaaccctgtccttttgggtttttatggaaaatttattacataggcaggatcgattacatccttagccattagtgactgattcaacttttagcctcctctcttatttgttttaaacgtttgtttccaaagtttttttctcccctttgaggaggacagattcaggcttacatcaaaatggaattaaatgtgcctttgatttggaatggggcaacaagagccgcctgcatggctgtgtatatttatttatatggggtcaggtaaaagcacttttaaaataagcaagtattagagatcagaggttatggagcagctgctggctctggctgacaaagcattcctggtggcatttgccactagctctctgggtgtgggcattagagagtgtgagagttggcctgatggcctttgtgtttgtggccctgtgtggaaactttatagcatttcagccgttctaatctgtgcaggcacagagccacagctgaccataactcttaggggaaatgaggacagaaaagttgaacagcactgtgtgctgtgtagagtatggagaccagaatgaagggtgcagaatgaaaggaaaaaaaattttttttgaagtatcctgcttcagggtttctattgtttgggaaactattcctatagaaatgacatttgtgctttgtgaagggggtggaggtagattttctggagtgtaattttctggagtgtttccttattgaagggggaaaacaaatgattggaaaggctcttcctctgtttctctcatgcatccctacacccccaatatatgcagtgtccttgtttttgttaaatacagaagctatacagagggcagttagagttcatccaccgttttactcattggatgggattattaagagataagaccatttattgcttagcatgagaatcttactgtcccggccagcaaaggaggccaaagatttcatctgaactttacctcttcaattcaagccaccaaagatttattgggagtctactatgtaccaggcataacatatggcatataaaggctaattttaacaattatattgccgtttatgttgttggtttggatagaaaccctgtcttccactaatccttacttttcctataatacaaagattatcattgatgaaacatattacagattattattttaagctatttagcaaatattagacattttcttagagaatgtttgagcatatcagaaattgtggtggatatgttagtttcctatttgctgcaataataaattaccacaaacatagtgacttaaaaacaacacaaacttttatcttacatttttgtaggctagaagtccaacatggatctcattgggctaaaatcgaggtgtcagggggctgtgttcctcgtggaggctctgggacaaattctatgacctcatctttttccagcatctagaggcttccctgaactcctaggtgtatggctcttcccttcatcttcaaagccagcaacagcagattgagcccttcttaaaatgccatctctttgtttctcttttccatagttacatcttcctcttccacttttaagaacccttgattacattgggcccaccctgacaatccaggataatccccttattttaagatctgctggttagcatccttaattccatctccaaccttaattcccctttgctatgtgtagtaacatattcacaggttccaggaattaaatggacatggacatctttggggagccattatttctacctgttacagtagggtggactttccccaaactttgctctttccccactcaaatgaaattgtatagtgccctctattaattctttgcaaaataaattgttacctatgaatgtgtcttgtgcgagtggtgggtggtttatcactgcttaaagcctcactcttcttcattgtgacaaaaccccagccacttagttttgtacaatcccagtgttcaaggaagctagagatcctcttagccagcccgcccgcaggggttttgcacacacattgttacatctcttcaaaatggctgtcccacctttgcttacatgaaatggcctgccttggcaaataaacctctttgaacagttctgtttttgttagatagttcctgctttaatttaggggaaaatatttctctttgtgggtttgtagaacctattggttcttgttttactctctggggtcatattgaataaatctaatttcttctttcacacttgaagcccttgagattttttttaaagacagttctcatatcccccaagtatcagacttaaaaatctcaatttcttcaactgggtctcacataaaactgtcttgagacttctctccatcctgttccttctcctgagtatgatacaacatgaagaaggggaggctgaaggaagatttaataggaggctttaaatgctggggggaattgtcatacagaaaaagctggtaaggtctttacatttaccatggaaacaagaaatcacaggctcatattgtggctaaggagatttaattagcaggaaacctgtcttaaccttatggatttggtgtcaggaaacctgtcttaaccttgtggatcatgcaatggactgcctgctatgggaagttgagggatcttttgccttagtgtaagacaagtcttcaagctcagaattcgtatattttgtgtaagagacgttgcttttagttaaatgttttgcttaaagtattcttgtcattgcttgtcatctatgcctgatgcctgaatttccctcttgtgttggttcattggatgtaaggcatcatcatgactgctgttaatcatagggggaaggaatatggttcagggctttatgaaggaagggaaacagtggcatagcacaggataattaatagcaagtggagtgacagtttgattccctggtagggaccctggcattgttgaaggaaaaaaaaatcactttattctttcatagagagaggcagctgtaattctggttggatggaatccaattaaaaggaactgacatgcaaattgatgatgagacagtgtgagcatagaagtagtccaagaagagttttgtaagaaatggcagagaagagtgtaagtaatttggcatggtaatgtgtgtaagaaaatggaaagctgatgggttggctacctgaacaattatgtctggaatctcagccagcagagaacaggagactggttggtttggtagagttgttaacaaaactttctggtgttttgagttttggtctacattttaggaattatagcctttcataatagaatgaatataaatcaacccttgagggttataggctttcaaattggtggtggttaaatataatattctcaagattctatgatgggagtcccagcctggctcttggaaagaagatctcattgtacaggtgtacttcacctgacctaatgatgtgttctcaaagatttgtgtgagaattggctcctaaatttaggatgaaataggagagcttgccatttctagtaatgctattatgaatcattttctaatgtaaaaaatccttttataaccacagtcatgcccaatttatcttttaagtaaattcataagtccacatattagatttgtttaaaccaaaggtatttttctttgaaatgaaataattgtaggggcacataacagttaagctttagagtaacagaggaaaaattgggtaagattttataagtcagtatattgctttttagggaggaaattctgcctaagaagtcagacagcttctgctgttattacgggaaaaggagaaggctgcccaacgtatttcagggagatttactaggatctcttgggaactgcagtagaaatcactacgaaatattttgaggatagaggaaacaggacaacagcgtttactaggttttattctgaagaaagccaaagaaggtggaatggagttcatcttgagaaagcggtagaagattgagaagctaagaaaagacttacacagcagcaaaaagaagaagagactggagtagtgggcagagttttcagttagcaagagagcaccatccaattgttatgctggtcagcagcaaggaacattaatgaaggagatgaagaatgaccagggtcagtttttgttcatccaggtttgagcagggtgttgcttatgatgctccatgcagttttgcctcccacaatctctctctgatctttgcctcctgatctgctcaagtactgcagcagcaatgcattctctactgaaggctgtcacgtttacttttcactgtgcctagaatgctcttaccctcaagcctccctccttcacttgattcaggttgctgctagaagctcccttatcagagagacctttagtgaccattctgtctgaaggaggcagacactcttcccttattccgcttttcttcatagcactcattatcacctcacacatggttgtttaatgtttccccaattttctctgctagaagtaagttctttgagagttcagcttcagtttcttttgcccatcagtgtattcccagtacctaatttatataaaaatttgtggaatggatttttagggtatctcttgcctatcacagtgagaagagctgagaatgaagaatacaggactcagtccttgtcctgtgttatgcaatgtattacatagttatagtaagtataacagcctgagcacagagtgctgtgagctttgagaaataagctagagatggtcatcacagaactggatcttgaatgataaagaggagttttgttctgtggtggagacaaggaatgatcttctaggctatcaaagcagggtgagtgaagttggagagatgtagaaatgagttttgtgtttggatgtcattgagtgattttgatttggctgctagagcacaggtacatgggaaagcatgacaaaggggcctgagaggtagggttggggaggacatgtgaaacatatgttgagatctgattggtaaagttattgataggcgtttggaccttgtcttttgggaagcagggaagtagcaatatccaaaagagagtgcttaaggatggattggaagagggaagattatagaggggatagagagcaaagcaggatgtgactttcccagccttgaaatgcatgagaaagtttgggatcctcacaatgaagggcaaaaaaaaaaaaaataaaaagcaattctgtttatggatgtatagcaatatattgtgtataggtggtggctattagaagactagtagttcttggaactgttcctttttttctcacaatagtagttaagctgtgtcattgggatacaaagggaaggagaaggctatttccattcttagaatagaaaaattggaaaatgccttggcaaatggaggtattcttattctacattttttttttttttttgagaccaagtctcgctttgtcacccaggctggagtgtagtggagccatgtgagctcactgcaacctccgccttctgggctcaaacgctaccacacccagctaatttttttatttttgttttttaagagctggaaatttgctatgttgcccaggctggtcttgaactcctgggctcgagtgatccgcctgccttgtccccgcaaagtgctgggattacaggtgtgcaccactgtgcctggccataccttacaggttaagcagctatgtggccttgtgcatttcatttaactgtgtttcatttgtcctttcatggagatagactttgttgatatcctttcatcgttgatgtgcagaacaaagtatgctgcttgggaaattataaacatactttcatttgaaatattgggtaatatcaggagtcctttgctttaatagaagtagatctggaattgcttttttttttttcttggaatatggtaacaccaaagcatctgagctactcacacccatttccagaggaaaacatgatcatttccaggagatggcctgcagttttaaagctttttgctgcttgttttctacatgtcaaaacacatcccatttcagcagttggtgagcgctaccatagaactgttcagaagcaagagggaggattgagtcatgttgtacgtgcagctgcatattaacctgcaggtcatagcagtccctgatccaaaggactgtctgacactttatccccgttcttactgccttcatcattcacagcagccagtgtaggactctcccactttagccttgatcatttggagtagcagaatcgtggtcttgtgtatatatagagtgttatataggccatgtgattctcggagacctttttaggaagtttgagcaaccttacatattggaattctttcctctttttgagaaggaggaaagaaatgtatgttttataaggattgctttgaaatagatccattttgcagggtttaactcaagcaaagaacagactagcttaatggttaatattaagttactggagtttgaatgcctaggtcccaattcaagcttcaccattattagctatatgaccattagccagttttctcatttgttagatgatgataattacaggaagatactgtatcttcccacagagtggtccagaggaatgaatgagtaaatacatgtaaatcacttagactaaggactggtattatggattctctgactgttagctgttttattcctgattttctcatagccactggcatttctaagaccttgcaagaaccactggtcaacttttctgcctgctatgtttaactagtagaagtcagaaagtgacttggtggcagagtgctagaaatgattcattgggtggactattgagcttcacaccccagtccactggcatcatgtaagaaacaactcattacactctaacggtagtttagtgaaatggatgagtagtcttagtctgcctcctcaggctgcaacagaaagtcaagccaagcagccaggaatgtctgggaatcacctggagagaggacagacatctgcagcacagtggaaggtgatagatgagtgggacccaggaataaactacagaagcagtgtggattgtgttgattctagcaagcaggagggggtctccatggtatttctgagtataagccaaggaaatgtgttaatgtggggggaaaaaaatcaccgaactgggagagagtcagactacctcgggtgtgacctttgccctgtcaccaacatattgtatgtcacatccccatggggcgagtcacattttctttctaactctgtttctttgtctgtaaaatgattaaatgatttcttgactctttcttttctagattctttttaacgatttcattagcttttaataactatgtgaggaaaggagagcaacctgctatagaccttggcctgtgtgagtctttaattttgttttttgttatttcaaagaagttcttgttcaaaagaccatgagacatttcatcattggactttttagggagttgtctctttaatctctcatatttccttttttccctacaaatgatatccacagtactgctgttgtcttgtgctctctggatcagcacttttccagagaaatgaaaacactgcacttttaacggcacagaaagcaaaattactgtagcatcaggattcaaggttacagaattggttaactttctggtttgttttgctgagctgaatgaaaaagatttgatcgaatgttactgcttagggataaatattaataaccacaaactctcttagtgatcattgtccccccttttgcagaaaatttcaaattatggtctaggacttagattgtgattgtcagctgaatatgggcgtgaaaaatgtggaataaccagataaaggacccttaattggttgtagaggaacaactttttggggatccatgtccagagagggaattggttctggattattgatttgtatcattactttgattaagtgtctagcagttgctgtagacctttataacattatataatagaaatggtattagaaaaaagtcatcaaaggtaggatttttttaaagatataagaaccgaagtttttaatcttcagtccttcatagagaagaatttattaggtttgagagttctcagtaccaagtaaattctaactgcagacttaaaacatatgaatacactcacatatagtcaccccatcctctggcctggttttgttctctattatagttgactttgctttaggggaaaggagggagagtattggtattaatttatttgaaaaattagcaggagtatatcaaacacttactgtatgccaggacttaccatgataaataagaggtggacccctgtccttatggagcccacttgaatcaaaaagtaaacatatgagcatgcaaatagatggctgtaagaatgtgatgggcatgccattttttctagcaggttgcctaccacatagtctatatgtgttagagatacacattaggtacacagaagagggtccatttgtggcatagagagagattagaggaatcttcatgaaggaagtgacatgatgatgatgttttgaatgacaggaaggagtatgcaaaaaaaggcagggttgacattccagacagaaagactagtatggaccaagacatgtggacatggaaatggtttgctccttttggggtcctgaaggtaataagtgcaatgaggctggagaactgggtttgtcttaaggggctatgggaaatgagggtcagagtgtaggctcttatgaaggctgtctggtcagacttgaggggaaggtatgctggtaaattgcactgagaatagttcctagctgtcccatatttcagcatctcctgaaatagatgtgtactgtgatgtacaagttccaggatacaatcagttcatgagtatccagttaatgtacctgcaggatttgggcagcaatatatgtagggtgttgtgtgaaaatattggatatgaacaattacaatcttggcttgcacaagaaatcattgtgatgcaggagggaagggtagaaaagttagattattttttttcccctctaatgcagtgcctctcaactttgttacaaattagaattacctggggatcttttttttaggatattgtttacatgcagtgaaatgcacagatcttaagtgtacacatcaatgaattttggcaaatatacatacccatgtagcacacttacccatcaagttatagaccatagtcagaacctgaaaaagttttttagtttccggtttgaatcaattcctgcccacccctcccatatgtaaccactgttctgattcgtgttaacatagtttagttttgcctgttcttgaatttcatgtgaatggaattatacaagtatgtgctctattgtgtttgccttcttctgttaacataatgtttttgagattgttctatattgttacatgtcagttttttttaattgctgaatagtaccctgttgtacagatataccacaatttgtttaatcattttcctgttggtagacatttaaattgtttcagatttttggctattatgaataaagctgtaatgatcagtcttgtacaagttttttttttttttggcagacataggtcatgatttttttttaacgtaagtgcctaattgtggaattttgttataggtatgtcagtgtatgtttaactttataagaaactgccaaacagttttccaaagtggttgtaccattttacattccctcctgcattgtatgagagttcttgttgttccatactgtcaaacatttggtatgataagtctttttaattctagccattctaatgggcataatatggtatttcagtatggttttaatttacatttctctgatgatttatgatgttgagcactgttttcttttgtgaagtgtgtggtcaagttttttttgaccattttcaatttggttatctttatgttattgatttatagggctctttatatactttggatacaagtcccttgccagatatacataatgtgagtacttctttcagtctgttacttgcctttttagttcctaatgacatctttggataagcagaattttttaattttgatgaagtatagtttatcttatttttccattatatattttgtgtcttttgtatcctcactaagaaatcttttcttaccctaggttatagaaatattcatctttgttttcttctagaagctttatttatcttttggtgtatgttccatcacaaatttttgagtgtgatatgaggtaagggtagaggttcattttctccatatgtttatctagtcgttccagcactatttgttgaaagaccttactttctccattgaatgtccctggcacctccgttgaaaatcagttgcttgagggccaggtgcagtagctcacacctgtaatcccagcactttggggggatgaggcgggtggatcacgaggtcaggagttcaagaccagcctggccaatatggtgaaaccccgtctctactaaaaatacaaaaagtagccaggtatggtggtgggcacctgtaatcccagctacatgggaggccgaggcaggagaatagcttgaacctgggaggcggaggttgcagtgagctgagatcgcgccactgcactccagcctgggagacagagtgagactccacctcaaaaataaaaataaaaaaaataaaaaatcagttgcttgtttatgtctatttctgtttaggtctatttctggactctgtgttctgcttcactgatttatttgtctgtcatcccagtatcacactgtcttgtttatctagctttatagtaagtcttgaaatgcagtagtgtgaatcctcccactttgttttcttttcaaggttgtttttactattgtaggcccttttcttttttatataaggtttagaatcaaattgtccagttcttaaaaagaaaggtagctagggtactttaccttacaaaatcccttgatacccagaccatacttcatcccagttaaatcagaatcatttagaaatgaacagaatctcgttcattccctagattcttctgagtgcagccaaaattgagaacctatgtactaatgggattttagtgtggtacactaaagaagatactgtcatggattgctgggatggaagccattccagtggaatgtatgcataggagctgatgtgggcccctacacgaaagaaattgttgatgtttatggaaccaggagagctgaatgaggaagagaaggagcaggagtgagaagccctgtggtcaaggtagtagagttccctctccctggggcacatggagccccattgctgaggcgctgccttgtgtggctcctattcctgattattcagggtattcccaccctaaacctgctgcagtgcagccaacaaaccaccaacttgaaatctagggaatactcttagtagagcgtgtaaatgtactattttaaagaatagctttcccctggattagggaaatgcttgtgaaatctgcatagtgatgaacagggtaggcacattctagaagtgcctgtgtgggttttttgctttttgagttttttctgtctttttaatgtaatgtctttagacaaacattgagtcatccattcttcccaagggtaggtagttcagtcagaagtgatgttttcccaaaaggctttaaagaaaaacgggacaaaaagttacgctcaagtaatatgttctttgggagcactcaaagtatgcaggctggtaggttgcttgcttgtggcttttttttttttttttttaatttaaacacacattttcctctttgaaaagagaggttggaactagtcagctgagtccctctttctgaaatacacgttccctaaacagctgtagagaattaatttcagtcaaagatagcagagctttaatctcagctttctgctcagtgttatggaaaatcctttctagaaaatagccagtgtctacctgctatgggatgttaaaaaattcaaacgaacattggattttttagtgttttcctagtagaaacagcatggaaaatcctttagtgagctagattttacagtgcacacagaaagcaagtatctatgatacatttataattttgtgtgtgtcacatgttggttgtactattttcttattcctaatagaattgaaatataccatgtccaattccaaaccttattttttttgtgtgtgaagggttgaagcattttagacaagaaagagctttgatactagcaactttaaactcatttataggatatatatacatatataatacatacatatgtatgctctttcaaggcagaggaagaaggtaggcagagtatgagaggagagttgcttttctttctcaacttatgattgtatttaacacatactcgcatgcacacacacattcttttaatagcattttttttttgtagtgagagaaaacttatctttaagaagtctctaatctattatgggattaagagttttaaatgtcccccaacacccccccccccatttttatacttttatttctacgatttatatgtcacgtgaacatcactttttggtggtgtgattatatcggaatacttttgtattttgcttaacattaaaaaagccatttcttacattgctatatcatgatagtaatttaatggcagcataatagtacctcaaattgtgccatactttatattcttctgttgtaagttttctattttgtgctgttaaacctcaaagaacttatttgtgcatagaatccctcttaatttcttcagtacatcctctgtgtagaatagtcacaaggtgcattttgttttttccttatctgtgtacagtttacactgtatatgatcctcagtgatatagggtgtatttaccttaagaatgatcattatttacatttctagggataaaaagctactggatttctttcataactgtattatttaaaaagttgttcttcccctttatttttgtgcacaaatttgagccacatttatgtttgtcttttaatgggttatgggttcaaatttttttcttaactggtatgtttttttttgttgttgttgttttaatttttttttttttttttttttttttagaaactaggtcttcctaagtaagttgtctggtttggtctcgaactcctaggctcaaagtgatactcccacctcagccgcctgtgtagctgggagtccaggtgtgtgccactgcacttggcaatatgtaactctttgtgatatttgtcatgagtattttttccaagttttttctttttttattttagtgccattgtgcctggcaatatgtaaccctttgtaatatttgtcgtaccttttccaagtttgttcttttttattttagtttttcattacaaagcagtttatgaagttttttatattttcttctgttgccttaagatgaacaaacttgtcatcccttctgagatctaacatcaattctgtccccacctgccccccaatatttcctgtggtttaattaaaagcaatttttaaaatccatctgagtttctgtcgatacatatgccctctccttacctgctgtgctatgaggaaaggtgggctaaatcaggagctcgtgttattcatatcttgggagaggaatagaaacagccagtactccaatctcagcttcctgtaatgtctacaagtcagtgtttgctcatctataaagctgggatgagaataacaaatgtacagagaatttttttaatgcacttaagccttctcttaagcactgttaagaacttcagttgaaagtgtttaaaataccaaatagctgtaacctttgattgttaatatgtgtgcaccatcatttcttggatttttctcaatagctagagaccacatgggatctttggtgttttccaaaatgaaccaccatgctattacctgcagacattaagggtctgattatacaaagaaactgagagttgaggatgtccatcagaaatacactgtttcaaagtcagatctgagtacttggtgaagactttggggactacttaatagtaatgattactagaaaaataaacactggcaatatagatagtggttaaaaaacatgggctttgggctgggcatagttgctcatgcctgtaatcctggcactttgggaggccaaggtgggaggatcacttgaacccgtttgagaccagcctgggcaacatgccgaaaccctgtctgtataaaaaatacaaaaattagccaggtgtggtggtatgcaccttaagttctagctatctggggaactgaggtagaaggatcgcttgagcctgggaggtcgaggctgcagtgagccatgatcatgacactgcactctagcctggaagacatagcccaaccctgtctcaaaaacaaaacaaaacaaataaacaaaaaacgtgggctttgacagagagacttgtttaacttaattaaacaagtgccacttaagtgatttggggtgagtaattttagctctctaaactcagtttcctccactgtaaaatggggataatattgatgagtggtttaattaagaaaatgtatgtgaaatattgagcatggtgcctgacccatagcaaatgctaagtaagtagtagctgttattacttttattaacaagtaacatttgtataacatttatgacctacagagccctttcacatgctgtttcttatttgtgaactgagtgttttatacagaatgggtttttaaatgttccataggctttttattcatggcttcaagaggttgttccctttttgggacctgtacagcttgtgtatactcagttggcatttgtcacgtatcttcatgccagtgtctttgtatctgaattctaaaactgcgtgaacacaaaggttatgtcttttgtcttattcatctgggttgtcactggaacagagtcaggagacattcctatttattatgtgcgtaatcgtaggcaagtcaatctctggcttgccaaagctgtcctttcctcatctgtaaaatgggtaacaagtttcttgtgaagattacgttaaataatgcattaggaagcactttgtatagaaaattacaaatagttttttgttttttgttttttttttccgccatgcctcactagcctagtatcacagtagatgctgtaaggttggaggttgttaggaaggctatagagccaagtcttaactttagtgtcacaatacctttgttaaacaatgaaattcagtctttgggggctagttgtcatgctgggtgctgtgccaggctaattaatactttggtaccttgcctttaaagtacttactgctgctgtctccctccctcccctttggtattcattatttatagtataaaacatttgctgcttgctgttgtaaaggtgggggatggggtgtagttacacataggtgctcagagcaggttcaatgatttaaccctacatgaggaagtaaacttaatctacataaaatatggatttgggggtgtgtgatctctgtggtcagtctggaggagtgtgcgtgaggtgtgtcagccactaagcaaacaatggagtgctggctctgtggactcttggctgagtcagcattgtttcccatggaatttctttttctcttagcccacaggtgtatttatgtgtcctggtatttcttcgtttttattttcccccaatttgatttcataaatgatagtgcaaagtgttggctatggttaatttcagtaaataaggcccaaatatgaggtatctgtttctctcttgagtaaaaaataaagtcatgttatggggaataaaagcaaaagcatttaataaaaaaatccctttgttcattttagaaaatggtacctttgttaattccttaagagacaatttattatattctgacactatctttgaatagtcaaagaaggcatgatgtctcaatttaaatttcttcttcctggcacagcttttattctgcaaggtttgtgcttttaggaagagggtattgtttctcataggagagtagagtgcctagtggacagaaaaaggtaaagattgtcatttccttgaacatagattggtgtttaatttctacttaagggtgtcttttgagaagaacagagcccactctgtttagcagcttgctttttgctaatcatgtggtgcatggtgtgttttcatctagtccgttccattaagtcttatttatgctttggggatatggataattggctacggctcaggtgaggtgcataggtgatgtgtcatttctctcctgaggggatagagatgacaggcttcttttagataatcactgtcagtggctgggacccaggaacctttggtattcacctgtttagtcagtggggggcaaatttgatgcaagagcagagagggaactgtttttaaactatgtatatagtcactatgtgattaactctttggtggccctttaagtacaggataaatttgcattagaacttagtgtctcagagtcttcgattacatgaagtctgaaaaagtgatgaccaattgtcaatattttggacatattccatgagtgccccctcagaccattggtagagataggtttgcaggtggtgaccctggtgaaatcctcctctgagaagggagtgttcaagggcatacgttggcatcatttaagtagcagaagagagcaccccattgagatggtttaaaaatgagatgctaactttcaaagttttttaaattttattttttacaatgcctgtgatgctactacattgtataaacagtatgtagtgttaaggatgtgcctcgcatgtaagccaccactagcatccttagtgtgggggtactgttccttttctacccaaatccctgcaagatgttctgagattttggtgccaaggagtctcccaacattcaacattgttaaaacacacttccttatcttctttgaggttttttaatagcaaatcccaagccactcacctttttctcatagtattaatgttctaagagtggctatacattatgttaaagtcagcgtagttctccacgggaaggctgttttttaaatgagacttattcaacctctttttagctggtgtttcattaccaccgaggatttataatgcaatagctctgaggcaaagctggtaagaatgccagcttcgctaatatttagagtcataaaattctggatattggacaagctcttaattactctgaatccgtctttgtcttaataaaagttggattgtacccactaaaacaagatggctgtgtttgcattaatctccaaatgtaggttaatacctttttaaaagctgtctcctagacaagagacttgaaaattaatttcccattttcagcttaaaacgaagagctcttccacgtgtggagattgaagggctgccatttttctgatgctgtagattcaagtgccaataataactctttgttcctctttagtttttttttttttttttaatgtcttaggtaaagaagtctttcttttctggtgcttggggacttgtattttttaaaaatctgcttcaaagtaaatagatgaaatttcattttctcagtggagtttggatcactgggattgagggggatgaggaagggctagatagatagtatgaaacctattggattcatactatggctgcagaagtctgggctttacacattaggttgctaccaagctggatattttgaaatatatatatgtatatgcctgtaatgttttagcatttgcttgttgggttttttttttccccataatggtaggttcttaactgactttttcaaatgcaaggtaaaactttcttttccttttcttgtctccagagtactgatgtgtaaccacttagtaccactaatgccaggattcatttctgtgctacagatggtcagtgagattataaaagctctgaaaaggtttttatataatttgaggtcttctcagttgagagtttgtgtctgacatattaattccttcccatccaccccctgccccattctcaatgtaaaccatatgggacatgtattaaaaaacaaatttcagacattttctggagattttaattcagtagttctggaataggttgcaggaatctgactcttaacgatcaagcacatttgatattcagacaactctattgcatcctccagaagctccaggattctgtatataatttgtaggatatacttgcctcttctatgtcaagtctcttacccagtctgattatgtgagatgtcttaaacagagcgttttttcataaacctttatgtaggataatactactcctaaaacactttattacatagtttttggattggtaatggcaaaagaatgagaaagcacctgaggaggcaccattgtgagtgatgaaactggggtatcagacctggttatgaaaggagatgataacccttgtactgttttcagacagttgcagagttatcctatgaaggaggaaccataattctggtggccctgcagagcagaccggggactgatgaatggatgctgtgggggctgaacataaagagaacaggtttaacagaagggaccaacatcctttgagagatactactttttaccttctaattatttaacccatgaaactattattttctcccaaagacacctgtttttagactatcagttaataaaaagaatggggctacttaggtggaagctggctgaggggcacaaacagattaagccccttttctccccagagctagcaagcagtacccttagccagaagccttgggctccatagaagtggccacaaacacaactagagtatggtgagttctgttcagtggaggtggccgcacagccccctgacaaggagtcttgtgagctccgtaagggctggcccttatctgatttgctgctgtagacagccagtgcaggggactagcacagagggcagagcttagtgaaatgtctgtcaatgaaagctgtggaggacatttgtatctcacattcagtgctgaatgagatttaaaagtcctttctaacataaaaagtctgtgatctctgcttccaagattaattcttaggtctcagtatggatggcccaaggatataagctttgtgtctgcagggactttgtttcctatagtgctggatttccagtacgtagactagcacctgacattagtgggcactcagtgaatatttgttgaatacatgcatttgttgaaaaaagtgaaaattgtttaaagtggtactttgtgaacctttttttctcttttttctgtcatcctggagacttctcatttaacccccagtctgtctcgtgatccatgccccatccttccttcatgcctcacaccacctccttctcaatctatacttggcaaagaggaataaagacgctaaggatattgtggtaaaccaaagtcatctcagaaacacagtgaaattccctaggcatctgaattgggaaacctattggctgatttgctttgacttgggtatttcctgtgattttcagccgggatgtgctcctgtgctcagaagtgaggatctgttgtaggtttatggcctagattaattgggatattttgtgaagtctctgaagtgttatcacttcatctttatccttgcctgctattcctcatgaaaagcatttgaattattttagagaagatataaatttgcttgtgttatccagtgtcagcttaaagctgattagcattttgcatcacctttgcaactcataaatcatccacttaccctctcagtaagcaggctgtaagtcagcatggaagcacctgctgcagcttcttgtcctgtgatttagaggacactccagattctctgcagacccttctgtggtgttattctctggtaaggcttcacctatatgggaaatgagtaaagacttttggtgacttttttttccctagggagttcttaagggttaccctggacgagagacttctcagaaatatagtctttaataaacctggtccaggcacaggtttggttcatttggcatatttgttgttttaaaaattttggaggtacttttcaacatttaaagtccaggacatttcacatttaaaaaaatccagatttagggttattccgggaaaatcagaacacctggcagtgtcaggccatgctgcatgcctggcttcatttgttattgagagcaggagtgctctaggaaaggggtacagattttccattttgctgtagactctacccctctcagtttttccatgggagtcaactttactcaaagtcctgcactgtagatgcttgaattggtgacatccttctatgttgtgcgagtgtatagattgttttttttgtttcttttttgagtaatatcaaccatttaactcaattgaataataacaagaggctaacatttatcaaatgctattaatgtaccaagtactgtgctaagtgcttgtaatatgtttgtttatatattctttacaattatcctaattgtatagatgaggaagaaattgaggcaaagagaggttagataacttgctcaaggccacctagctagtaaaagtcgggcagagtcactgtggtgtcctcagaagcaagtccctgcttgggctagcatttttgcctagtccgggttatctccagaacctggtctgctcctcattcccatatcccattaggaacagtgggcatcagttgcaaaagtagatgacagtaacacactccctaagtccccagtctgctcctgggaggagcagcctgccttgttcatggcagtcatagccacagggggatgtttgaaagacagccccttatacagtgtctattgattttcttcaccctcttgttttgctcatccatcctgttgttctaggatgcttatttgtcatgcataaaagccttgttacagtgaacccaaacaagtcattgacatttaaaattaaattgcaacaggtattgtcaatagctaaactgctcattgacagtgcattgctaattgcattgagagaacatcctaactgggtatattctgccaaatcaaatcggaaacattggctgtctaccagcaaattcattttgacttgcacagagtttggggatccacagatccctcaccaatctcaaaatactgtgtttatggaaacgctaattattatttttttttttgctgaggttctttgcagagaaggggaattctgatcatcttcactgactgctaagccaggagtcagaaactgtgcctttggaagggagagaactacagatttggggtggagtaaagttcaatgcaagggggtcatttggggaggtgggccatcaggttctttatctgtaaatctaagccatatccttggatccattttttttttccttctctcctttttcatccccttctctctcttctataggtacatgggagggggacaagggtggagacacttaatttttattaagcactgttcgtggtattttatgtgaattaatttgtttacttcccacaatgaccctggggagcagatatgctatcaggtaaaaaaactaaggcacagagagggtaaaactcttcgaaagagtcttgtggttagtcagcttctgtgagagtgagagtgggctgccctgaggccatctgttccctctccccagctgatatttttgtgctctcagggtaaacatttaagcctgtgagttaaactcagccttggactagctgagttcctctggaggccttgcaagtagcagtttggttggcagggcaattaagtatgctaggtgcactgtgctgaaccccaggagggagggaaggaatggaatctagtctttgcttgcgttatacatgcttattggtttgtggcaggcgtgattgatgccagaatcaaaatgacttaaagcagcttcccttgagaagcactactctaacggttttttttcctctttgttgccctaggtcccttgtgaataggatttagctctgattcagctgctgctgttcttttggtaatcagtgtggaggaaggagatgagggctgctattaatggcttcttattttgcattctcctaatcagatatcctgcagttattagtgtgaatgcaagatgttcggtggtgtccctgggtggttttcttaggtgtactggactgttagctttctaagatggaatgttttattaggttctggcctagggggttggttagatgggtggaggttgttaaaaagcactaaagaaaaggaataggatataaaaccaatcttcagggggtgggaataacaacccaccaccttcacttccctcccctcctgccctgaaaaccttatcttgctaatacccttcagatattaaaagtgaaataacagagctatttactaggcagctaaatgcaaattctctcccccattagttttaattaggatgaaatcatacatttaaataaccacttctattactaataactgaacttctgattcactctgaacccaggcaaatgcctcttctggtatgaatggcccacctctgagtcattccgcacctgcatattgacacagccaggctcctgatgtgggtacacacatctgggatttaagggcatgactggcatgttgaatcttgggtataaagctttctgcactataccctggggacaaacaggatagctcaactggagaataaagagcttgcaagctcaaaagaaaacaacaaccaaaaatacctcaaccaaattctgctcttgcttctatcctactgtttctttaggtgtttaaagggctgtagttttaaaaatctcccacccacctcatctttttaagtaaatgtcacaacagtactatgtcaatacagttgaaaataagtatttgagttgaaagaattggctctttgaggctttaactatcagatttgtgctaattctttactgtttccttgacatagtatatgcagtctgtgctaagagagtatggatgttgtcgtcggtgtatagaatggtggctgttgtaaacttctgtatgttggggaaggattgaacctgctgtctggagaattagaaaccagcagcttgacttaaatccctcagtgtcacaaccagctaatgaaggagaggactgctaaactcccagtggtctttgtggctacgaggacttactcaagtttgagactatctttagtgggccaatgacgtaggaacacaatcagcagaggacatgtagtttacagcagcctgtaatgtgccagagacatgactagctgcctctttggccctggggaagtgtgtctggccctgcttgcatcctctgtgagtgggaattgtgccagacaccagctagacatgaccagctgcttcttcgatgttctgtggacatgattggctgtagcttttgatcaggacagtgttcctaatgaagtgtgaccagcgtcatttagacaggaaagaatgacagctgatgtgcaagaatttttcttgattggcagcatttggaactagtaaccagagaaggtaggtggggggaggagaagccagctctgattgacaagagcttatctttatttaatctacttctgaggcactgaagttgaaatcttaggcaagtgaaagaaaggaagacacaattgtgaaacataattaaagattcttgacaaaaacatacttaaatcagaaatgtcttttttttttcttttttgagatggaggtttgctcttgttgcccaggctggagtgcaatggtgtgatcttggctcactgcaacctccacctcccgggttcaaggaattctcctgcctcagcctcccaaggagctgggattacaggcgcctgccaccatgcctggctaatttttttgtatttttaatagagacggactttcaccatgttaggctggtctcaaacccctgaccttaggtaatctgcccgcctcggcctcccaaggtgctgggattataggcatgagccactgcgcccggccagaaatgtctttcaataggagagcaatgcagagtttaggtgtgaggttatcactgctccttcggctatgagaaagagcttttgcccagggattgttaatttttaggcaaaatttaaagtggcgatgggcttggatagttctagcaataaaaaaagttctgcttctagttaccatcttgttgactttccaacctacttggaaagatttcctttggagaggccaaaaacaagtgctgtgtatggagtgtggcctgtggtggtaatttctcatcaactcttgatccactgaggatttaaatcttaagtcttcatgtgctttgagaaaagatgacaagcggaaatagtatgtttgtttcctaaggacacacatgtgatttctgagagctgattgtatgcaatgtggtggtattcttttgcaaataggcttgggaacttggcatcctggattcgaatctgggcaccaccattttccagctcattccttcttattcaactccaccccacctcgaaccccgatttggttttaaagattcacatactattgttttagtaattacccttgaaataaagtcacatatacttttaagtctaaagttaatccaggacaggtgcggtggctcacacccataatcccagtactttgggaggccaagttgggcggattgcttgagcccaggagttcgagaccagcctgggcaatgtggcgaaaccctgcctctactaaaaataaaaaaattagctgggtgtggtggcatgcacctgtattcctagctacttgggaggctgaggcaggaggatggattgagcctggaaggcagaggttgcagtgagccatgatggcaccactgtactccagcctgagcagcagagcaaaaccctgtcttaaaaaaaaaaaaaaatccatagcctaaccaccttggataatacaagtgactaccctatatctgatcatactgccaccccaacctaaatccagtatttgttttgccttttttttttttgagacagggcctccctctgtcactcaggttgaagttcagtggtgcgatattggctcactgcagcctcaacttcacaggcttaagtgatcctccccacttagcctcctaagtattaggcatgaagcaccacgcttggctaatttaaaaaatttctatttttgtagagacagggtctccctatgttgcccaggctggtgttgaattcctgggctaaagtgatcctttccacctcagcctctgaaagtgctgggattataggcataagccactggtgcccagcctattttacctttttttttttttttttttgaggggggagggcagatggtcttttagatttacctatgtatttgacaatttgtttgttcatatttctttcttgtgtctcagaccttccttcaggtttgacttttctttagaatttccttgagcgagtgcctattggtagtaaatgctcttttttgtttatcatagatgtctttcttttgcccttcatctcaaaaggtagttagctggatacacagttctagggggaaagattttcttctctttgagtcttgtaggtttgttgtgaagattacctgggttcatatctaaagcccttagcactatgcttggcatgtttgctctgtaaataacagtggctgttacattctcagaaaaatactggaacagttggaggcaatgcaggcttggttgggatgtccatactttgactaactttttacattattttcttaaaactttgatttcattgagattggggtgggagtacatttaagcatcaaaactaactttgaagatagatttgattgaactgtgagttctatcactcgctagttgtatatacctttggtagattatcttacctgtcctaagaatcagtttcttcatctatacagtgatcattgtaatacttcctatttctctgagttgctgggaaggttgcatgagaacacatttaaagctcttctccaagcctcacatagtaggtggctagttgtggtaattatttgttgcctgtaaaccacttttatgacttttatgtagagatgttaccaacttgtcttttttattgttgttgttctagctattctgtttttatttgctcttccccagatccacagaaaagatggggtatctcctgcacaattaactttctactctactgatggggaaggccttctgcagagttggtggctcttgcttggaggcaacactttgatgcttgtctttaggtgggaaagtagctttccaggcccagtactttgctacttgtaagactctcacttacctgaaaattgtttgctctggtttttcttgtgactttgggcaagttacctaacctctcagtgcctcagtttcctcatctgtaatatgggaataataatagttccttcctcacagggttgttgtaaagactagatgggttgacacacatgaagacctgagagcatgcatgacacagaggatgtgcttagtactttagcgttcatcagtgttgtcagtagccagggcttccttctgtaccatattgttgactttcagaataaaaaatacattgtttgctatgactttgtcccagggcgtgtgtattaagcttccacatataatttatatcacttattccttaataacattgtcatgggttagatgggacatgtatttttttcaactttattttttacatacaataaagtgcatcgatttttaagtgtacagttttatgactttgagctacagtcaccactgctatcaagatataggatatttctgtcaccgtaaaaattcccttatctctttcccagtcagtctgtcattcttacatttggccccaggcaaccactgatctgcttcctgtcattatagagttttcttatttagagttttatataaatggaattacattttacacactctcttatgtctggcctattcactcagcataattattttaaattttatctacctacctgcatagtacctatattttgagataggatcttgctctgtcacccaagctggagtacagtagaacgatcatagctcactataacttggaactcctgggctcaagcaacttctcccatctcagcctcctgagtagctgggactgtaggcatgtgccaccttgctaggctaattaacatttttttttttggtagagactgggtgtagctgtgtttctcaggctggttttgaactcctagtgttaattgaggcctcagcctctcaaagtactgggattataggcatgaaccaccacgcctggccagcgtaattattctgaggttcattcatgttggcatgtatcaggaggctggtcatttttcttgctctgtggtattccactgttgaatgtactacagtgtgtttagccgttctgctggcgatggcttttgggttgtttccaatttggggctgctataagtgagctgctatgaacatttatgtacaaatctttgtgcagctatgttttcatctattttgagtaaatatctaggagtagaacttctgcatcttaaggaatatgtatttttaacccccttttactgatcaggaggaacttagagggttggaactgaccaaggtctcacagccagaaaggtgtcaagcatggaccaacatttgatactccttttctgtttcctcttcaggagtcattctattagaccagtgatttcacacttttagagcaccaagactctttttaaaataaaatactgtaggtccaggtgtgatggctcatgcctgtaatcttagcactttgggaggctgaggtaggagtattgcttgagctcaggacttggataccagtctggactacaaatcaagactccccacactacaaaaaaaaaaaaaaaaattagccgatgtggtggcatatgcctgtagtccctgttatctggggatgctgaggatcacttgagcccaggaggtgaaggctgcagtgagctataatcacaccgctgcactccagcctaggtgacagagtgagaccttatctctaaaaaataaaagataaaatattgcttagaatttctataaacaagctacacaaaagcactgtaaacaggctccttagaaagttcagtcacttttttgctgttatcctgttgtgcacccaagtgcttctcaaggaatgtcttttttgcaaagtgctgcagtccatttggctgcttcttgagaggagagtcgtggaccccctgaggcctagttcttaaacatctcttcttagtccccattgcattagttgtttcagaacaggtcattgagcatttcgcctttgcattttggtggttcagagagtaagaaactctttctccggctgaccaaaaaaccacctctccctacgcctcgtgtatagattgggctgtacaactggtgagaatagtaacatcaccatccctgttgctataaatcactgctggtgatatagctccttgatccaaagggtacttcgggggatgtagggccagataggtacattcaaactcagactatttacctttgtcacctggtaatatttacagatggagcagatgccagtatgttccattgccctattctggagtagtgattctcattttatgttatcagagcctagcttatgaaatttgaaatgcacttttgcctcctttgcactgttaccactgcatcagagcattttaatcagcttgctttcgttgaagtgtacaatttttcttctcattacgtctgcaagctctcaagtttacagacatgatctccttggctagactaatattacttggccattcttgcatgcaaatttaaaatttaatatcttgctgcaggtctgttgagttttatgcaaattccaatatagattatattttggagctgtaaattagaaattacatttgggggaagtaatatttgtgtgggtttaaaaaaagtaatcttgcagtttgtatggtacatggcatttcttctgaagaaacgggattttgagtattctgtgtgggtttagtagatgtcttgccaattgtgttactgataatgaaaatacaaaaacaatgccagtatgtacattaaatttttttccttaggagacaaagtctcactcttttgcccaggctgaaatgcaggagcacgatcatagctcactgcagccttgagctcctgggctcaagtgatcctcctgcctcaacttcttgagtggctgaaactacaggcgtgcctcgctaattaaaagaatttttttttttttaatttagagacacggtctccctatgttaccaaggctgatcttgaaatcctggcctcaagcaatcctcctgccctagcctcccaaagtactgggattatagggcatgaatcactgtgcctggcctacatcaacattttttatgacatttggctgctttttctaagttatttgggattaactgtgttctctcatttattaattcattgagtatatggttatggatgcttgataggctctcctcttggctttgatgatacagcaacaaacaaaacaggctctgtgctcatgaaacttaccttctacttgggagaaacagacttcaagcaaataaacaccaagtaaatatttggtatctctgatggtgatacattctgtggagggaaataattcagggtgtaggaataaaggtgtgctgagatggaggtgctagtcatcaggaaagacctctctaaggttacctttatgcaaagacttgaagagggaatggaatgagctgcgcaactcttcttaggagaacattagtctgggtggagacactgcaaggtacaagtgtcctaagtgggtgctcttgccgtgtttgaggagtagcaaggacgtcagcctgactagagcagagagggaggtagaaatagggcagaggaggggtagcagatgatggagaggtgtcacaggtcatataggaccttgtaggtactataaggactttggcctgtgctctgaatgaggtggggcactgtgggcgagggctgtattaggtaagaagactctgaccattgtgttgagaatggagtttgtggggggaaactcagatctttggatgatgggcatgggacaccatcatcagccattgcaggtgtggaccttggatgctgcctgcctaaggctggtgaccaaaaagaaggtagagttggatacaagagcctggcattgttggcatttttgtgtttgagtgtcggaaagatcgtggcagaagcctaagtatctgtgttgcttgggcctagcatctgtgttttcacaaatcccccaggtgatttgatgcctctttaaaacacagaatgttgggccctacccaaagggtttctgattcaggaggtttagggcagggcccaagaatttgcattatttacaaatgtcaaggcgatgccagccagtgctgctggtcagggaccacgctttgagaaccactgctctggtgaatgggtattgctgtgttgttatctgcaaagttacctttgtgtacttctgctttacaaaataggatgtagcttgaactctgagtcaaactgccatttactgtggtatgaccttggatatggcatatacagtgattcctcacacatggtgttaataagttcttagtaaatgctggctatttgaatatggtatgtaggtataaaatgatgtggtggaggtaaaatatgaataatttgctgaatataagctctggactgtggacattataaacaagatcttgttttgttttcagcatgacatgaaaggttcattagctttgttttacacatagggaagtggcttattcatgatcacgcaactagaagtagcaacggtagatttcaaattcagttctttctggcttcaaagcctgagatttgccaccaccgcatgagctgcttggagtactggattggctctcccacagtttttgtcattgtgtgtgtgtatgtgtgtgtgtgtatatgtatgtgtgtgacagacagagagaaggagaggggtgtgtgtgtgtgtgtgtgtgtgtgtgtgtgtatgagagagagagagaaagtgtgccagaaattatttgcgtacgttttaaaatctctgttaggccattttttaaatctgtaaaatgggcatgaagcatgcagagttcatagggtttctttgctgagtagaatatgggatggcttagcattgtattttttttccttttctaattaaaaaaatttcaaagccaaatcgaatctagatagaataaatttatggattttttctttagggttccttattagaatggattcttcctaatatgaaacttgagttattgaattttgtgtggagaggatgcttctcattagggtctcagtttgggaagaagagattatgttccctttaaaaacagcttactgtgtttgcaattttagatttcttatctcaggaagttcacatactgttaggataaaactttcctagataaggcatctgtacaaaggaatgaagtatatgggaaactgcgtgtgtggggagaccatatctttaatttttgaaagggctagggtagcctggtggtttggaaaaattaaaagtattgcataaaagtcaaatgtaatagcaattattgttagtgttgtaaacttccacttatccacaaatcagatgggtggcagtctctttatcttaagttctggttataaaattgaaaaagccattgattaacaaatagctgtcacaaagctggaactttcatagtaacagtttctggtgaagcttcccttgatccctgactcaatcagctaggtagagataaaagagaaattttgtattctgaagatgtacagacaattataaggaactctggttgactgcagggggaagagacacaatagctattaaaataaaagtatgacagttgggctaaacaggcagcctcaaacatcctaggagtccctgagggcaacactgtatgtagtgactcaggttcttagaggaaagtgggtcatcaacaagaagcatacaggcttgtttttggtatctttataagaatagagggaaataatgagtgtgtcagagagctcttgtcaagtttagtttcaataaaacaatttgcttaggggtaagtttatttgggaaaataaatcactgataacagcataaatactgtgttcctcagtgatgagattagatgagtagggaggtagtggggtgaggtagaaggagcatggacttggacacagatacttgattagaagcagaatcaccttagatatctctgcgccccagcttctctgtctataaattgggaataatacctgaagaggtcattgtcaggattgaatgagatgatgtaagcagtgcaccttgcccagggcttaataaatagtgatgagactggtagatttctctgtgagggggcttcaggatatacctcccttatacagacttctattcctttgagtccaccgccccccacaacatctttatgaactgtaatgtatctcatactgtacaagtcacccatttaaagtgtacacttcagtggcttttagatttacagagttgtgcaaccactaccacagtcagttttagaaaatgttcatctcctcgaaaagaaatctgtaccctttagttatcattactttattccctcatcctcttcctcatcagatgttgtaggcaccacctttcttcccttccttcccttatcttcttttcagctgtggactgtgctgatttgcctgttgctggatcatgtgattgaaattctttgaatttttctgtaaatagccaatttagctttttcccttccagagtatttgtttctttgggtgtggaagcagctgctgcagccagtgcaagggctcaccattttgcgctttgcggctgttcatatggcaactttattcaaaaccgctcctgcactgcttaagttatttgttttatacaaaaacagttctcgctggcttgcggcttctctgctgccatgttgacaaatgttgcttctagtgaaatacacaaaaataaataacagcaagggagaggggagcacagagctaagtgaattcattttgcctcttgagtgccattctcatttgttttaaaaaccaccctggcacagacagaaaaggagaaggcagagaaccgcaggaaaagaaaaggccacatttgattctttgaattgggctgtaggggctggctgaacagacaacttgagaagtatctggaatgtaggccctggggatgaggaaaagtttacaaggaatctgaataacctgcagatattcatattgcaacagcccccatttacatagtcttcagagttcatttggtatgttctcttgttttctcgttctgttgatgacgagactcaaatttaagcactgctggtgtagtagtacatgaccatggttggtttctgtcagtgtggtaggttgtgtattaggaactggaaaaaggcaaaagcgtaagggtgtgtgggttctcaagtttcgatttgaaggtctgacccacatgagaaggtggagggaatgctgacaaatattgattgcctttctgagccaagtatttccacaaatactatgttattagtattattattatattaagatatattagtattatactattatattagtatatattagtattattagtagtattatattagtatattagtattattatttgtatataacaaatactatgttagtagtagtagtagtagtagtagtagtagcagtagtagtagtagttttcagagagagggtctcccaggctggagtgcagtggtgagatcataactcactgtagcctcaaactcttgggcttaagtgatcctcctcacttagcctcccaagtagctagacccacaggcatgagccaccatactcagctaatttttagattttttgtaaagatctgggccttacaaagtgctgggtttataggcatgagccaccaggcctgacttcagaaacattgtttcattggttagcatgacaaaggttggtggtcttagcttcatttcacagactagggaggacagagttttgaggaattgtggtacttacttgccaaaggtcttactgaaattaggggagtggaatgaaatggaaaccccgtgcttccagacctagaacttgttccttttctatattagtagtaagccatcagaggtatggaagaagaaaaggagaagggcattggaaaataaggagggataacagcaagcagtagaggccaaaaacattttgtttagaaaaattgtacatcttctttgaaggtttttgttcattaaaaatcaccaggaaaacgaaagtgacttgcaagtccacaagaaactttgttttgggtgtgtgagttaagaatgatcacctgaccaattattattgactagaaaaacatttccctgagcctttcataaattatcttaatgtgcatattgttgaggcagtgtctgataaataacagcctaattggccacccagggtctgagaggtttgcttagccacaactagcctttcattctgggtctggcagattgatttctttccatttgttgcatgattttcaatgctatttatgacctaaatattctgttcaaaatattttttttttggtctattgctaatagtagatgcctctagggagaagaggagagaagcaagagtgaggtgacagggacttacttttccttatattctccttggtactttttgaattttgttccgtgtactattccatatgatggaaaggaggtaagtgtatttaggcaggtggaaggtaagaagggtagatgaaaggatgaattattgacctgaacttcaggcctttattcatcagtggtttagcctgtgggattgtttctcagcatataaacttcttcagttatgtagacatataatagttacttgttcgatttattgcatctgcaaaggtatggccaggtgtcatcatgaggaagtatagtagtatagtgtttaggcttaaaagattctgaaacctagacttcctgggttgtaatcctttctctaccacttagtggctgaacgtgaccttggatcttactttatctagcatttttgtgtctcggatagcttgtagttaaaatagtagttataacaaaacttgtggaattggaaggattacatatattacttaatccacatgaagttcttataatagtgcccaatacacagtactcactaaaagttaaatttttttttgatgactattatcacagatggtgatttgcctcatccatctctctgtcccttaatgtggtccaaaatccaccccccgccccacacccggccttaatgcccagacagtgcccctgtactgactaaggagcctttcttttgagttcactggtctggcactggctcctagaagtgctgttttccagtgacagcaggatatttggaccactgggagagtcagtgggctggggtgggcccttgctctctgcagaggtgttctttctcccagtgggaggaaacaccacttgtcagaacacagctttggcttgcccaggttcctgttgtgcagatggggcctagagtctctctgggccccttgtcatggatccaagccaaggctgtcgcttgctgagccaggaataatataggaattagtctttttcttctttatactaagcactaatcaatctacagttaactctgtatctaatttctgaaccagatgccgtgaataactgcccctgaatgtgtttttgccaataaaaggataagtttaaggcttttaatcaatgccgcttgcactcagtatttaaggtcagaatcttgtgtgcgacttattttgatcaggataattgttgggttaaaaaatgaacggtttttgaaattgtgacactcgcggttgactcgtgggtgaattaatctttgagaggatggaaaattgtcgagttcataagagttctcttgctctctagttgtctttcaggtcacttatggaaaaatatgacttttaggaggaaggcattctttttcaatgggaaaggagataagagactaatagaaatttctaaggagtcagtgatggaggctcaggggaaattggaaatgaagctgggtgttttggatctgcggtgagctgagggactggaacagcagctgtgtatgttctaggtaatattaacttgttgtaattttatgtctccagcatacctttttcaaaggaactcatgtttcctgaccaacgactgtgtactgtctagaatgaagcatagtgtttagaaacatctggggtttagatattggcttcactgaatggcctagggcaagtcactgagcctctgtgccctcagtttttataattataaaatgggatggtaatagctacctcgcagttggaaaacttaaatgtgatcatgtatgtgagaatgtgaagtgcagtgcctggcacacaagaggtgctgaaaggagcatctccttttacttctttgtggagtttgtttggctggtctgctggtctgtcatacatttgtctggtgtgcctctagatacacgtaatgtggaaatttccctaccttgtaacagtgagttggaaattgttcctgttgatctgtttttttttttcttttgtgcttagggaaaggcatgagaaaaatgagtcaggatgccctccatttctggagaagcttggtggtaattctgttccccagtggctcacaagcctgggcagttcagagaatatgagaattggtagatcatggagaactaggctctgcccctttggctatgcgggagttacttagtcttcctgaagtttcctgtccatgaaaaggggatgtgtgagggtgcaatatgggtaatgtttgtgaacaacctttgttagtgtcaggaaagtccaaaactatgtggtgtggtattttcatcatcttgagttgacaacagtgcttatccaaaagtcaattttggtattttgtcaaatgttaaaggctcaggaaataacttccaactcaaggaagatttgtatccactctggagctggaggagcttatattaagaatgtaagatacttgggctcccaggatttctggaagagctggcagtctccctgaggttcaggttctcagaccagcaggccatgcatgggggcttgtgattaagctggtgccgaacattgctgaattatataggtctttctgtgctacaggttggttttctgctgttcacatgtagtctaacagtggcctgttttcctttgcctcaactgtgacatcccctcgaagtgacctttatgaaggcagagcttggatctgccttgcttcttgctgcctactgtgtggttttgtgcagagtgctcctttccctcctctggtgtcttcacaggtgactcaactggaagaggaggttaaagaaggtcgggttaccaagcacctctcttcatgcctcagccaatccaggccccaacactgtgtgggaagaggtgttcatctgttgagaaggggtggggacaacatatgttacatacagaggctccaaggtggttttgatgagcatagagtatagtgggagaaggagcaaaggatggtttgggaggtaggaagtaaaagtttcagctagagctgactgtcaaaggccttttctgtctttagacttttactctgtaagatacagggatttgtatgtgaggcttttgactttaactctgttggaatagggatttgttgcaggctgttaagtagggaggatggtatgagagatgcattttcaggggtttcatttgctcatggcatggtagaagatgaagggtggatggtgagtagagtagaaataggaacacagaagactgctgcagtatttcagatggggattgtgtggggcctatttaggtcatctccagtgcaggtgcccaggagaagttacagtagatactgttgtacttgtaaaggaaaatgacattcgagttcctgttttgtgccaggaactttaagtaatctgcatatcttagctcatctcattctcaaaacagcaacaagcggaaggtgttatttctcaccgtttttcaaataaagaaacttaggtttagagcataagtaatttgtttgccatccctggacagctcctaaattgcagggttgaggttaatacctgattacatccaactccaagtcctttctgttcgcattacaccacactgtggccctcaggacacagcctcatgtagtgattttgcattagcaaataactttgtaaggactagtctgttaatagtgatctctttcaacattcccatgagatgagggagcacaattaattgttcagctgagggattagagatataaggaggttaagtgacttgacgaggtcacccatcaagtggtttggggcggacaggcagaggtgagtgaggcttggagctggccattttgagacagtggccttatcgagaacaagaattttccagcctcattttataaatccaggcttctagttctatagactagggaaactatcatggaaatggtatgcaaggcaagtgcctgaggctgagatggcacaaagcaccgtggtatcttggggttactttataatcaaactctctcttctagcatagtctttaattaaaacaacaatcatctccaccaaaaactaatcatctttattaagcatacagattggaggaagagtggggagtcttgtgtctgagaaagatctcaccaataaattgtttcctttgccataataattgtgttgctgagtttaataattagaattctcactctacgcttcctttttctgtttgattttacgggtctgacatcgctgttgtttttcctgggaatacttgaggtgtcacaaagagcaacattatgatgagagccatgggaaacacttgctaattacagtatattgtgcccctgttccttatctatcagtctctattggttattattactcatttaatttttatttttgagagatgaatgcacagggcagaataggtcctgagaatgaatctagagctttgcctttgacttggatggacactttgggcatgtacgggtcaagaaatagatgattgggtatcttgtggtaggagctagaggaactattaatacatttgggagtggggagtgaaggccatggactgaaaagatgccgaactacaaacctgaatgattttatagtttgctaatggttatccctggatgccatgcaccatcatgatttaactgagccttgcaaacagggacgatacttttcctaaccccctgccatctactgctttctcaccagaggtcacagggcaaagacaagtaacactggcattgtgcatgtgtgacaggtaactgtaggtagtaaagtggccacctgtaccattgcaaccctgtgtaatagtctagtgaagtgatctgctttctgcagtcaggatgccaaatacggtggagaaggaagtgacagtcatttacagtgtcatgtttagtcttttgcagatgtgcttacagttttaacaaaggcggagaagaaattatagggtgggaaagaaatgcctacagacaggctgctaaagcctaagaaggaggaaactagtatttgtgtgttttaggaatgctaagcccttgcttacatatcagcaagcaaaatattggcattcacttctgacttgaggaaggcatctctgaagtcaatagaaggaaatgcctaaacacaggcctcactcagaaagaaaggagagctgtggaaatactcaggattatctcataaaagctctttgtgtatttgaagcctctaatgaaatcagccttgttctccaggccagacaactccagttgttcttacctttctttattgtatcttttttttttcatttcttttatgcttttgtcatctcttgaaatttcttttctttgaataataccaataaaaattgaactttttgcctgaatgcagggatgacttgctagtaactaccagtttttatcagaaagcagagtgggatgctcagtgatgttgttgatggtgaggatgtccaaatcttctttttatatgctagctccattgtctgctgcatttacctgtttgtagcgttggtgcgtggaacattggggcatataaatgtttattgaattagtgaatgaagatatactgaattttttccttaaaaagtcagtatttgctttgggtcaataaagaaaccctttattttgctttttcttcataaacaccaaaatcctaggaaatattggttttactttgccacagcactctgcagcttgtacagacttttccagagatgaaaaattctttctcacttctgtattagtccttcgctttatcctctgattcctccttccttccttcccttttctgccttcctctcacccattcatgtattcattaattcagtaaatgcttcttcaacctctgctataagcactattttaagttctagggatattgttataagccaaataatgtctctgctttcatgaagcttatatttgggtggtgggtcaaggaacatgattgatcagaagaagttagatttccctgttgggacaaggctttcagagaagtaagtggttgtataggtagtagagataaaaggattgctccctgtgagggacttgctggcaggataggctgtgatttcactttattttctatttacataacaatctgaatcccaatatagtgtttaacctgatatgtaagattctgtttgggcagggttttgtcagttatcatttatatctcctttcttgaaattagatcagattcctttgatttatttggagagaaaaatgggcaatacacaatgtgtttctgctgaatattttgctatgatgttgacacagtaatgtacactttattttgattttagtgtgttttatttaaacattccattattcagaaattgttaccccctccttgttattactgtttgcctgcagttatttagaaagcagtttaattaatgttcttttaccgccccctgcttcagtatgagtttcaacacttttaatacaaagtgttcatatcactgtatgaacttactaaaacccaggacagtgatattcattcattcattgctttatccagcaaatgtgcaatacaaaaaaagatacatgcttcctctctacacatttcagtctaatatgaactgtttggttgaaatacagaaacataacatgcaattctctgggataaacgtttcactaaataaacagcagtgagaattctgaagatacacttaactaggtcagcctaggcttatcagagaaggcttcacagcataggcgatctttgatctggttcttgaagggtaaggatgtgttttccccccagggaccagttgagaaatagctagaattaattagttctgctgtaatcattgaggtgctgatcctagagtgtggcttccactgcagtactggatgtggggatgatgatctcattgcaaacacagcctgggtgggtgtttttggttttgttttaaggattctgaagcagcatatacacaaggttgacctcaggacctctttagttggttgctgctgctgttcacaatagatttagattggatagggcttcagttttcttactgttgcattccagcattttggatcagtcactttattacatcatttactttctggcttaggcttagttgttattaagtgaatcagggataaaccttaggctactctcctgcttcctttttcaaatgatccggagtaaataaaacaactacatctctttcgtcactgtgtttcgttcccatctcagaacgggtaaaatggccaatattttcagtgaaaatgtattgaaatgcatttcactgaaagaaatgttcacattcagtgaaatgtatctaaactctaaaaagagtctagaaaagctcattgacacatttgttacttgctgaaagccccagtgaattttccaacctccgtattgtccttaaaaattgccttttagttcttaaggtggtggaggtgtgtttttttcttcccccttaaaccctcttctgagcaatctttgcagagacacctggtgagagagtaggcccttctgctttgtgtgccctctagtaagagatgatcatcagcagctttatatcctaatgtagaaaatgtgctgtgctagatcatttcaacccagcaactcacctcttcatgcctaatgcctggagctagggccttgtttctctctacattagacaaaaaataaataaataaatgtgggtgaggataataataattatgatggcaggaacacttattgagtaagcaagtgtttgcttatttaatctacctgacaaccctaccagatgtaggtactgttattttctccatttggtggataagaaaactgagtcacagagagactcggtaatttgcccaaggtcagacagctgtctgcccggggaacctatacacttaattgctctgctgtactgtggttgagtatctcttatccgaattgcttgggaccagaagtggttcaggtttttgattttttttttccgagtttgaaacatctgtatctacataatgggatatcttggtggtgggacttaagtctaaacacaaaattcatttatgcctcatacacgtagctggaaggtaattttataaaatacctttaatgattttgtgtgtgaaacaaagttttgactgtgttttgactgcagctgctcatgtgagtccagtgtagaatttttcacttgtggtatcataaaagtttcagattttggagcatttcagacttcagattttcggattagggttgtgcaacctgtacttcatgagccaattgagaaaaatgccttcataatttctttctagggcctcaaacgcctggacgtcacccctgactattgcatgttgtgcattggacagttagatctcctcagtgcctgtgaacaagtgttcttttgagtgatactcttctttttgtgactgtattatataatatagctttcatagcccccactttatttgctgttattttattcccctctcatccccgcccccccccccccccccccatataaaggactcatttcaaagatgggcgaacctggaagctgaacctgactctactcttcatgtcttcaatttactggccataaaggttcagttttgtatgggatcttctgtcctctagaagatcccgtacaaatagaggctttaatttatgcttgcattcttgcattttgtgtgatttattgcctaataaatgaaagaaaaaagtttatttagatagtaaactgaaaatgaaaaaccatttttttccacgaacttgctaattttcttccattgtatagtatgaactcaatctacaaagatctggcaaaaaaaacaagtatcatgttctgtaacaaactcagttacactaacaccagaacttactgagtttaattggagataattaaaaaaaaaaagttctttttttctttttttttttttttttaaatagagatagggttttccatgttgacctggccgatctcaaactcctggcctcaagcgatcctcccatctcagcctcccaatgtgctaggattgcaggtgtgagtcatcgcacctggcctcttaatgtagatgattttttaaaatgaagatttttttcatagtaagaaaagggaaaccataattccagaccacagagaaggacttctttaatatatttaacctctttatttacagatcacttctttctagagagactaaaattagggcagagaaacctaaatcctacatacaaagagctgctgcccattcaaaataattacaagtgtgtcgggcgcggtggctcacgcctgtaatcctagcactttgggaggccaaggcagtggatcatgaggtcaggagtttgagaccagcctgaccaacatggtgaaaccccgtctctactaaaaatacaaaaattagctgggcgtggtggcacaagtctgtaatcccagctactcaggaggctgaggcaggagaatgcttgaacttgggaggtggaggttgcagtgagccgagatcgtgccactgcactccagcctgggcaagagagcaagactccgtctcaaaaaataataataataattataagtgacagtaaagcatctccccacataatcctgtatatcagtaagaaaatatgttttgagattcacaaaactcaatttacgaatctctggttgtagttatttgacttaatatataagacacttaccagaggagatggttgcaaacagatttgatgacaggtaaatttttctaaaggtctgctaacttcttattcagtcatggccaaccactgatacaatgctgagagttgctttctcctttcccctctactagcttggggtccacagaccaaaaaaatctataacttgcaaggctaataaatgcatgcttcagctgcctggaaatgctgttggactggcaatttgctgccccgctctaatagagactgcctcagatctggtctttaacctggattagctggataaagagaatcctctgggatcctgtgtgccatcacctgttagtgtgtttgctgtataaatgtaacatccactaactttgtcagatgatgtctggcctggctgctgtggctgtgattggaattgaaacatacagcttgttattaaggtagtgactggctgtgggggacaccgacgtctgttgtttttcattgttgatctagtgagttagaatgcctttcctgggctgttaatgttaaatagttcagtcctgttagtcgttttgtgagatcatctttctgtgtgatttgtgtgtatttccttgatctagtggggtgcagggtcagggactgaggggaaggtataattgtttacagaaaatgtgacaggacatggatttgaaatcagataggaagttaaggaatgccgggctcctctgaatattaaggaaaatctttaagcccctaattaacttcagaaaatccccttgctctcacagatgggaatttggctgggtaagctaataactggaatgaaggctaggagttgtgggttaagtttctccctggcaaataccaatatttcaggattacttcgactcttgtcctgctgcctcccactggatctttacaaactctgtgcagtagagattatcttgataaagattttggatgcatgttgggcctttattgaatgatgaatgctgttttttattcatttgcacatttattgggtacctactatatgtcagcctctgttcttggtcttgtatggtggtatacaagagaaacaaaattcttagccttatggaatttatatcctagtggactataaattacaatgttcactatttgagaggacccaagcttcagatgttgtggctgtttggcacactggtccgggttgaaagaagagactgggattcaagttgtagttcctgtcctgatttctctgggcctgagtttaactaccggtaacataatgacattgggctgtatctaattatttatagggttctttccagttctttcacttatgatcctgattttcccaaacattttagccaagttgtctttttttttttttttttttttttttttttttgagatggggtatcacccagtcacccaggttggagtgcaatggcactatctcggttcactgcagcctctgcctccctggctccagtgatccttccacctcagcctcccaggtagctgggaccacaggtatgtgccaccacgcctggctaatttttttgtgtttttgatagagatggggttttgccatgttgcccaagctggtctcaaacttctaagctcaagccatctgcccgcttcggcctcccaaagtgctgggatttcaggtgcgagccattatgcctaaacagcccagttgtctttaatctagttgggcttctggctaattcgtgttggtgaccaatgtttgcatattaaatcaaacaatcagttattgtactggagaagaaaataattgtttctaaaaagttcatatttcgactacatggtcatgccatttaaaaaaaagtagtaaagcaacaataaggaaatactcttttattctggaatgacatacctacctgaaatctttgagtttcccttgtgtcatgtgagctggttgattacaggtgaggagaattgcatgttcttacatgctcctcagaaacactcatcactgtgtaaaaaatgcttttttgtttgtgtgaaatcataatatagagcccattccaccatacaccttcatcatcaagctcggggatacaagcctgttaatcaagtgggaatacaggaagtgagacatgaaacactggttttattttcacacctctaaatgagtgactgcagaggatgaacttaaaaataataatgccacctcatacttgcatcacaccttttaataaggcggtttaaaaatatttagggtgaaccttcatcaggatgctttaattgcctcagcatagttgaatagtacattagggtaatgcctctgctgtgctgaaaagcctggagggagatactgtcactcaatgatgcgttgaggatgattaggtagaaccccttcagatcttgggatctcagtttcctctcaaatgcatgctgtgggtagagaagcctgggctggtgtgtgtataatttacatctgttataagtgactaaacttgtaagaacgggtacacaaggcatctttagtaagaagtaataatatctgccttagtaataatatcttctcattcttgtaggtccatttgaaatggctccatctctagtacatctttcctgactactcccacctggccatcatatcatctttctccattagatttcaggcagactagaccgagactgtgggtttttatcctgttagccacttagaggctgtttgatcttgggaagattacttgcttttctgtacaaagtatctttatttctgcatctgtaaagtgaagataagaatccctacttcatagggtgttagtgatatgagttagtaaacatgatgcccttagaacagtgcttggcatgtgctgctgtggttttgtcatcattattactccacttcttccttggtacatagctcatgttctccttaactatacggatgtatttagcgatctgccttaaattgtgatgtgttccttctggtctgagagcccttgtcacacataacatgataactttgacttggtaggtacctagtgagcatcttggattgagctcctacaggatttagttaagaattcaaagcagggtgtattctcattctgacttttaaagcctttgaggtcagttgggggcaggtcttatttgtttcttaactggtgaagctgccataccaaggccacttgcccatgatcgtctactgggtagcctgataagaaggtcagttactcaaggctgtggactcgattccattcttgctgatattactagcgtaaatgagatgcttttggataattctctgagcaatttaggccaggtgaatactggacagtaatttcctgaagtgccatgaagtggcaggaacatgatttatgtaacatgggctcttgctagctgggatgaacactggagcccctgccgtgctctggaattatgagtgcctgccagagtgcctgcctgcttttgttctagagagtttttttttttttctttttcctttaagttaaattctcaagttgcgggcaggggcgcaggtctctatggtgatgaatggagagatgttgaactggctggttgcaaaccttaccctagcagttcttagagacaactgggataaggacattttagctggttgacacttgggttgaaagtactgatgtaaaaaaaaaaagtgatgtgtgtatggggagggacatatacaaagaagtagtaccttggcattctagccagataaaggagatctgtgttttttaaggtaggagctttgagaaaaatgcaaaacttgtatatttcagcatgcagaaaattgcacttcactatcaggcaaacctcattcatattagcaagagaagtatatgagaagcatgtggttgtgggatgccattatcaggaagttgctgtgttcttgaccttgggctctggaagaacaattagccccttgcatgcaaacttgctcagtaaagaaaaagttttggccctaaggcctgtggaaccaggcttaggatggatgatgggtttattgtccttcacagccaaaacacaacagtctttctccctttctttccaggctacccacgtgagtacgttgataatatttctgagagttttaaagaattttccagcagaatgagagaagatagaaggaccatcttgataatttaaggacatgctcttatctcttgatctgctgcattttgtttttgcttctgtttaggccagtgttggtagttatattgtcttctctccactgggcggattacatgtagcaatccaaaattgtcaacataattattccacttcttctttggcacatagctcatgttctacttaactgtactaaattgtgatgggttccttctggtcaagagcccttatcacacctaacaggacacattggacatggtaggtacctagtgagcatcttggattgagttcctccagaatgttgttaagaattcaaagcgggtgtattctcattctgacttttaaagcctttgaggtcagatgggggcaggtctcatttgttttggattacatgtatgcaatccaaaagagttaggttttttaaaaaaattaattacccccaccccttttgttaaagagtcagggtctcactgtgttgcccaggttggtcttaaactcctggcctcaagtggtcctcctgccttgacctcccaaaatgttgggatcacaggcgtgagccactgcgttcagtctaatttttatttaaaatttaaaatttaaaatttgtggtatagtccgggcacggtggctcatgcctgtaatcctagcattttgggagtccgaagcgggaggattgcttgagctcaggagtttgagaccagcctgggcaacatggcaaaaccccatgtctacaaaaaatacaaagaaaaaaaattatctgggcatggtggcacgtgcctgtagtcccaggtactttcggggctgaggcaggaggatcgcttgagcccaggaggacaaggctgcagtgaggtgagatcatgccactgcattccagcctggctggcaaagtgagaccctgtctcaaaaaaagaattaaaatttgtggtacaatataaataacataaaatttaccatgtacagttcaacagtgttaactatatttacatcattgtgcaaccaatctccagaactctccgtcttgcaaaactgaaactgtctaccattaaataacaaccgcccattctctgttcttcttagcttcctggaaaccaccattctggtttttatctctatgaatttgattactctaagtatctcatataactggaatcatatagtgtttgtctttttgtgactagtttattttacttaacataccctcaaggttcattcatgttgtagtatgtatgtatcagtatgttcttcctttttaaggctaatattccattgtatgtgtataccacattttgcttattcattcattcctcagtctacatttgggttgcttccactcttggctgttacaaataatgctgccataaacatgggtgtgcaaatatgttcttgagaaccccctttaaattattttgaatatatacccaaagtggaattactggatcatatggtaattctatttttatttttttgagaaactaccgtactgttttccataagcagctagatttttaagaagtacatttaaattcatcgttttgggccttggtctccacgctgccttgagttgtccctaggtaagtgaagttctcagtcagtcacctgctctggcatacctctgagctttgacacacctcagccactttccatggctcactttggccctttgtaggttggtgcctctcattagattcaacgaacaatttctcaggatctgggcctaaccagtggtgttgaatcttagaaagactgagctgaaatgctcatcagctggtgccatgcttctcactttaggttatacctccagttgtgtttggataagagttggagtggcatgacagtctcccacagaatctgaaaatatagttccagatgtgcttctcccaaacttcttctctgccattggggttgcaccactggaaaagtgtgtgaagcaatacttcactctgacaccctgctactatatgcttgaggaagaactgaagactgtatcatggaatgagctgcccataggtcgcgcatgtgcgcacgtttgtacgtgtgtgtgttgagatgggagagggaatctagggatccttctatactccattgattatgctaacatggatcttatttaatattacaaggacatttctttgtcatcgtctttttttttttttgagacagagtcttgctctgtcacccaggctggagtgcagtggcgtgatcatggctcactgcagcctcgacctgctaggctcaagtgatcctcccacctcagcctctcaagtagggactataggcacacacaaccatgcctggctaatttttctattttttgtagggacaaggtttcaccatgttgcccaggctggactcaaactactgagctcaagtgatccacctgccttggccccatcaaagtgctaagattatagagacgtgagccaccagcctaaaaagacatttctaattagaaagtgtagtgtgaacttttgccgtagttggacttctctccatgtgggcccttaaacactgatatctcagtcatatgaagctatcaaggaccaaaataagggggcatttgccttttctgtcagtgcagaaccaataggggccaggccaggtatgaccaacccattgtatgtgcagtggcttgctccatctttctgtctctggtttatgtatgtgatcatttgcggattccagcaggtacatcctctccaataccttacctggtaagctgtctagtaaggtttatatttcagaccattgggggatccccctcttcatggcacacactgtgcctgttgcctaatattcctttattgtctgcagcatccaggaccaatttaaatgtcactttgtgaaacttcctcagaccctcctctagagcaagttagtcactgcctcttctgtgccttgctttgaggttattgtcatcactgaacctgacccagtgtattgtaattacttcagacggtctctcccaccagagtttatcctcctctgtgcaagtgctattttttagtcctatctgtctaccttagaaccttctgcagtatttggtgtattgttctgtctgtggcaattgtctggtaaatgttttatcagacaagtctctgatgcaatgggatggagtggaattaatagttttaatcatgaccatggcccgaaatagccgtttgacaacatccaagccactcactctctcagactctcacgctgggttgtgtaaattgaattctttcaaatgagcataagttaaaaaatacttagcacttaccatgtgctaggtactttgtaattaagcattttacttacataaactcatttaattttacaataacctagtggagtacatttcagtttcatagatagtgaaaaagacacacagaacggaggttacctgctcagttcaaaccctggagtgtagcctgtgagtgtatatttctttttgcatgtggttaataaattaatgttgtatttacagctttgcagagctgggatgcccttaacacatgcagctctggacctatataagctgtcaggtgtagaagagtgagcaggaaaaccttgtgggggtaactgattccttgtacaaaagaaccagatttcagttagtgatgaaaatggaggaagtgaagaatccaagtcgaatgatagaaaaggttatgtgtcgttgggcaagggttcaaaagacctagttgtcttgattagagaggaggggagctgagggaaaatgagtcacagaggaggaaataatgaagatgaagtggccagagaagacgggctcctgcaaggaggggcctgggttttagatagcctccaagaaggacaggaagtgtggcctgatgggattagctagtctcaagacaccaggtagaatgcaggccatctttgtagactgggccttggggtgtccaaaccatgaaatgcatggcagagtgtggacacacttgtttgtttatactctttctcccatcctgtacaatgaggcagaacatgaaggaaaaattaacaaacaccccaagtctcctgacacagggatcaaaacatattgatgatgtcttgcaaatctgataatttcattgaaccatgtgaagcttaaaattgatacataggcatacccttaacattaagtgctgctgtcagtctgacatagctggataaaccaatgttgaataatctattaaatatgtcagacttgaacaaagaacgtaaatcatattatattatttcagctgtaattaggtgggagataaaatcacaaatagatgagtttagtgaatatttcttagtgtgtacacagtgtcactggaatttctttccttgctctatgggaagaaagaaattgactgccttccaagtattgactgctgtccaggaagtgggaggttgaagggtgacttatgtaatgttcacagagtgggtttcatttataaattcaatgagattagctacaatcttcctgaagttaatggtgatggaaatgcaccattctgcatttagctggaaatagctagctatccaacttggagacttaattgttcctcagattatgatatgtttgcatttatatctccctcccctcctttcctgggagctggctgctgcctttattgtctagaaattaataatgcagaccagagcttgtgggtgaacagggcgatgtattgccagtcttttgatgttcctgtttcccaacccacggagtaaacttgattattgagaataaacaagggacataaactaaggtggaaaagataaagaaattgcattaggagggtccagtgaactgagctgtagctaagaaatggagataattctagtcattacttcacggggttgttgtgaagggtgaaatatatgttaaaccttcagaacagtgcctgccatgtagcaagtgtttcagtatatatcaggttgctttcattgttataagaaaactaattggcatttgtggtggatggtcagggtggtgtgaatgtgaaattcaagagcataaacatggttgtttcctcccagatggttggtatagtgaaacagacagttaagggtaaggaagtgtaggccctcattggggctacacatcacagcatgctattaatataagcagtgtatactggtcatcttttattgagaggctatggcttttttgtgtgtgtgctggtggtttttaaaatattagtttgattcatttcaggtgattttgttaatctagcaaaacatcttcttgcactttttacattataaatgaggaccatagaactttgtgtggacattgcagtcattcagcagacatttagcaaatgcgtataatgtgtgtgaatatttttttgtatgaaaggttttcgacacctgagactcactaccctcagccctgagttcacatgatgggtcggtggatttccagagaggcaggtggaggcgccgcagtgggagcatcctggctacctgagatgtgttttgaggtgccagcctcttggctccagctggagccaattggcctgttgggcatgagctacatggcatgtagagtgagctacatgacatgtagagtgagctacatggagttagaggtggttatcctacttcttctacatcacaactttgcagagcgcttcatataagacttttgtaaatttcggagatagtgtgctttatatagcaaggatttccagggacctactagaggacaacagaaggctgacatttccccctccaggccagtagcttgtctttcattactttgcataataactacttccgcttgctttttttcccccctcacctcagctgcacttaggaggacttaatgacatcatttaacgttaaggataaatataaaaccgatctgttcatgaacaccagtaaattgcacttaaaaaaaaatggtttcacataaggcagaacaggttgctacttaaaagagttaatggccagttggttttagagtagatcacaaaaagaaatgtgacttcacccgccaactccttagttaaagaaactgtgtgtttgcagtgttggagaaccatggaggaggattcagaactttaggcaggaagaactgtgaatgagtagccctgttattcccctggccactgtgcactcatggcttctgcacattactgtgtaaactcctttctcaccacctaaaacctaccaaagcacccagcgatcttcctgtatgtgaactcacaggtttttcttggataatttgcctttccattgacctactttcaagagcaattttccctatagctttagcaggtaactaaaaaggggagtggtgagaaagtaaatttggagttccaaagggaaattacttggctttgagctacttagtcaaaaacatgtattgcatgcaggtaggtcccaggcacagtgttgaacacgggggtacagaagtgaataaacattgcttctgctgtcaaggagttcacagtctagtgtggaagatctgtgtgcaagtagatggtttcagtgcagcgtggaaacctgcagcagtagaagtgacaaaaggtatgttggtagcacggaagatgcagtgctagttccgtgtggcaaagggtgaaggtgtcttagaggactccttggtcaagaagagtttggaggacaacagggagtttgcctagtagacaataaggcagattactggggcagaggaacagtggtctcttggggagattaggagctgggaatcaaatttcaagatcaggtttttttatttcggttcagtctcatacctgctgcctgtcatgtgaccttttttttttttttgagatagagtttttggtcttgttgcacaggctggagtgcaatggcgcgatctcggctcactgcaacctccacctcctgggttcaagcaattctcctgtctcagcctcccgagtagctgggattacaggcatgcaccaccacgcccaggtaatttttgtgtttttagtagagatggagtttctccatgttgatcaggctggtctcgaactcttgacctcaggtgatctgcctgcctcgccctcccaaagtgctgggagtataggcatgagccaccccacccggcccgtgacctgactttttttactgagaagaaacagaaatggggatccttatgtcttcattccttttgtttggcataggaagctggactgcatccaaaattgttaccttgtgcaatttctggataactgaagcttacacagcctgaagtgtacacaactggttaatgacagatccggttcaactcagaaattcacatttgtccagattcattcagttgccctataatcttaagtgttttttctgatgttggattcattccttctcttacttgttcaataaatgtttgccaagtatgttataaacaactgtgcagtctgatagaggtataaggtcctttctgtcagggaacttaaagtctttttgtttgtttgttttggagatagggtctcgctgtattgcccagactggagtgcagtggcacgaacattgcaaccttcatctctcagacttaagccatcctcccacttcagcctcctgagtgacttggactacaggcacataccaccatgcccagctaatttttaagtcttttttggagatggggcttccctgtgttgcccaggctggtctcaaactcttggtttcaagtgatcctcatgccttggcctcccaaagtgctgagattataggcatgagtcactgtacctggctggaatttaaggtcttaaagtggaaataactttgaaagtatagacttgtatcagattatgaggagccagactaagaagttaagacttaatgatttatacctctcagcccagagaggatgccagtgagtttctgaatttacagcctaaggcaaattctttttgatttctgtgttccttgactttatttattactgtaggataatgccttagtgtatttgaataagtttaaaaaatttatgcctaaaggtaggtttatgagctttgcattgtataaaagagtacggtatgtaagaatgaggactccaagagccaaacagccagcttttgaatcccagacctactatttatttatttgaattttttggaaggttagtgcgcagccgacctagtatttatgagctatgtgaccttgggaagttcatgtaaatgcagtgtctcttgccttacatggaaaatgtccatgaaaatcatacccacgtgaaagttattacaaggattaagtgaggctgggtgcggtagctcacacctataatcccagcactgtgggaggccaaggcaggcagatcactcaaggccgttcattcaagaccagcctggccaacgtggcgaaacacaatacatgtatctgcaaagctcaataaggcaaagcatagtaaaacagcttgcctgtgtctcatacacggtgctacaaaacctttaaactggaaatgccaagaggcacagaccaaaaaaaaaaaaaaaaaagctttaagaaaaacctttttccccaagcctttggcttggggaaagggtgggctacaacagaaaggctttttgacagtatcctccctattgctgccaaacacccagggaaaaaccacaccccatatcaccaacccctgccagtgcagctgggctgtgcagagttgatcttccacactggtccttggaagcaggcggtgcttcagttcctctgccaggtggtgtcaggagaacggagaagggtgctgatctttcattccccttgctgggcagaactagttagtactccatggcagagccaggagtatcagcggggtccagccttatgctgagcttccgtctctaccgtgtagcaaaaaaataatgtgagtcagctctcctccctggtggcagtggggctaaggggaatcccgtcgaacaccctaacttggaggaaataaaccagtgccagtcagtgcctcatattcagtggaaagttgtctgcagggccaagttgggaggcgaacttctacctcattgtctgcagcaggcaatgtgacccagtgccctgctttttccactctagtgatgatagcgccctggaggaagcagagtccacacccaccaccccatgctacatgtcaacaggggtactgcctgctaagcaaagatgtccagggctgggagcagtggctcaagcctataatcccagcactttgggaggccaggcaggaggattgcttgaggccagaagtttgagaccagcctgggcaacgtagacctccgtctcttaaaaaaaatttagctggcggtggtatgtgcctgtagtcccagctactcaggaggctgaggtaggaggatcgcttgaacccaggaaattggggctgctatgaaccatgattgtgccactgtactccagcctgggcaacagagtgagactgtctcaaaaataaaataagtaaatatcttttgatgtccgggatacagtcaaaaatctcaagaaccaggaagatcaccgcatgaatgcgaatagccagtaatggatacaagcactgagatgaatcggatgttggaattctgacaagaattttaaagcagacatcatgaaaatgcttcaataagcaagtatttatttattttaaacaacaaaaataggaaatctcagcaagaatttatgggcctaccatgagggaaatttttgaggtgatagaaatatatatcttggcattgtggcttatgcatttgtcagactcaacaaatagtgtacttagagcaggtacttttaattttctgagtaaagtatacttcagtaaagttgatttacaaatcagggattttcatccctgaagattctggttcagtaggtctaggatagagtccaataattttttttttaattaatgccccaggtggttcttgggaactcctgatatctccagaggaacctaggctagttgagaattcttcagaatattaatctgttagcaatctgtgtaaatagaaactaggtctggtaaattatgaattaaccagataactacttgcagaataaacagaatacataattagaaatcattaagtgtgttatcaccacatggaaataattttttgtattttttttattgggtagtgttgtgaagaatattacatggtatccttagaagctgtaaattgtgatgctgggttataaaaaaactgtattgtggtatgtttttgcctctctcacttaaccccacccttcactccattccttctcaggacacttatcttcttggtggctaatggcagggtggattccacatttgggaactgctgttgcctgggcagtcatggttttcatcagtgtgtcccagggcgtggtgctttctgtcaacatcctgctctccatagaggctgagaatgatccctgatgcagtcatcacggcttttaggcctctcccattggcctcactttaacctgatgactatcatatttccatctaggctgcatttttaaatcttgtcaaggaagcccagggactctcctcactgataagccatttccaatccaggcctggggttgagtcaggtcaccttatgttcttactctttcccttgacttagattggtctggctggtccacccagataaagtgtagcagtgtctgaagctggatgtgaggggtcgggaagttgttgatggggatgccttcattccgcagcacacatttcaaggcaagcagatcattttcctatagcagtactggtcagagctggattcaggggaaggctgtctgtgtttcccacgtgggccgggtgagctgctagcatttctgtcagtgctagaaggaaagtcattctttcaatgtggtcccagattcaaaatcagttttgagtgggtgtcagaatgtcattcctgatagcttctctgttttgacagtgcaaataccccggtctcatttctctgcttttaaataatagatccttgagattggccctgggtaggagacctcccccaccccacttctttctctgagttcaccatgggattctcctaatctagccagagctggatttgatccttgggtcactcctgtggtctctagccctcctcagtgcttacttagttggtctttgtttctattggttgtttttgcatgtgtcgtggttatcgtcatcatatgactaatgtcagggggtcaggcacagttatagcttctaattgtgttgcgcttttggcaagggaactatgtgtgggggaaaaatacttattaggaatcgtcagcctgcattaaagggtcgtaatacttgaacaatttgcacatgatatctatctctacatcctatatggactgtgctttctaggagggattagttaggtttttcctttcctagtatagaaccaggactagtaggggaaggcatagaggaaaatactatggttctgtttcagagagagcattcttgcaggggtttcccaaatgtaaatttttttgttttttagagatagtgtctcagtctgatactcaggttagagtacagtggtttgattacagctcactgcaaccttgaactcctgggctccggtgagcccctcgcctcagcttcccaagttagtgagactacaggtgcacgccaccacacccagctaattaaataaaaatattttgtagaaatggggtcttgctatgtttcccaggctggtcttgaactcctggcctcaagtagtccttctgcctcagcctcccaaagtgctgggattacaggcatgacccaccatgcctagtcaaaaatgtaaatattaggtcttatgttactgaaggtattccaggaatgtttggatgtggtacagaagatgtgggtattgggaaacctctaagaatatttccaaattttatcttctgttgttctttaaaaaaaatataagctgtgaatacaaccgtggaaccacaagtaatataagaggagctgatttcttggtgcctgcactgctgactaaagatccagtctggttgcttattcagtaaacctttgagttagtgcagggagtcactctctgttttctcagggagcccttatttgagtaactgtcattacctctttccctaacccactacctttaattgtccttctgtggttagaaaaacttagtgtttgaaaggcatagtatctcaagggaactttagaagtatatcttacctttgctcttgggcatttccagatgaccctggcagtgtggccacaagcaaactggagaaggctgccagtatgtgcacgttttaataaatggaggatatctagcacctcctaacccttaccttctcctccatctcatcccattttctgattgaacagtcacgttatttctagtcttaaatacttagcttttctagttgtgttaatggaattgttgtatgtatttcagttgtattacttaagtgtcttctaaaagacatttgtatactttataattcagagaaaattctttggttgattgaagatcttgctaccaggtcctggtggaagcagctagaatttcttaagcagttcctgtgaatgtttcctttttatgtagatcatttcttggaaagctgtgttttaaaataaagctctacaggcactactgttttactctaaggcctttgagctctgatatctaagacatatttatttcttcaactatgcccaggacagtgctttgcattcaataggtgaccagtaagtgttgagttttgttgaatataaaattatttacaaatgattttttgttttttccctttaaaaattaggcttccgagaaaactttgggcttcagagtccctgcttccaagcccctctttgtaacactctatgaaatgaaaagcatctttggatggtatggggagagctgaacaatgtgaggtgggagggcgttggcctttaatcaggtttctggggacagatcactcatgctggttcatgctggcccaaggctgtcttctttcttgtttgtggatgtgggttatgttcctatactgagatgtgctggatgaaaagctaataaatattaatgaagcagttacttctgtcaggcacagtattggctagagagataggtagaaataaatagaaaatacagttcttgactttgagaaccttattgtgtaattggaaaggtaaaatgtaaatgccttaaaagttaattaacagtaattcttaaggatccttagattgtctaatacagtggttctcaaacattagtgtccctcagaatctcatggagagttattaaaatacaaatcacagggccttatccccatatatatatatatatatatttttttttttttttactcatttggtctgtgtcatgagaatttgcatttctcagttaccagatattgctggtccatagaccacacttggagaactactggtgtggtgcagttattctcaaccttggctgtatgttagaatcacccagggagtttaaaaaaaaacccatgccaagaccccacccactgtagaccacttaaatcagaatctcagtggggtaggacctaagcatttttttaaagctccccagatagttgtaatgtgcagtaaggtttgggacttactgctctaacgtgtcagggccacagaactttggattcagagatatgatgttaccatgggctgcagcagtgtggacagaccagaggagttagcctgatcttaaagaatgataaataaagaaaaaggaatgatttttgttcttgtaaagttaatgctgggaacaagccagttggttttctagctgtttcttgggacagactgatgagtttgtgagctcttaggagtcagcatgatttcccattcagcgtgagctaatgagtgggactgaggtgtgggtcaccaccatcaataataagcattcactgaccacattctctttttcctgatatagatgagcttgtgtttatcctaacaagcttagatgtgtgtgtgtttggggtggggtgtggttgtggactgtgcaatagtgagaggctgaactttgaaaaatgactttgccatttttacatttcatctctttaagcctctgtttattcatgtataaaagaaagtactacacatagttgtgagcctttttttttttaaaaaaaaaaaaaaaaaaaaaaaaagagtctgggtcttgctatgttgccaaggctggtcttgaacttcttgggctcaagtgatccgtctctgcctcccaaagtgctgggattacaggtgtgagccaccgtgcctgtttgttagtatgtgtgtgaatactactacaattttaggaacactgttttatttatttagggacccccagaatctatcagtgagcctgacacatagtgtctgtgcagtgaatccagattggttgaatgaattggaaaggttatcttttcacattgactgcccaggcattagaaaggatgggaagagcttgtttcctgatctttacaaaaaatgctgccaccttgggttttccaacttaggcaagaaatctgttatgttcaaaataaaggagtataacttaaaaaatatatagatagaagccaggcgcagtggctcacacctgtaatcccagcactttggaaggccgaggaaggcagatcatgaggtcaggagttcgagaccagcctgaccaatgtggtgaaaccttgtctcaactaaaaatacaaaaatatagctgggcttggtggcacatgcctataatcccagctactcaggaggctgaggcaggagaatcacttgaactcgggaggcggaggttgcagtgagcccgagattgctccactgcactccagcctgggtgacagaacgagactccatctcaaaaaaaaaaaaaaaaattaaaaaaaaatatatatatggaaatacattttctcagtgtgtatactagtcatagctacctgtgacttattctttattttgtgtatttttttcagacagggtgttgctctgtcacccaggctggagtacagtggtgcaattagagctcactgcagcctggacctcctgggctcaagcagtcctttcacttcagcctctgcagcagctgagactacaggtgtatgccaccatgcccaactaaaattttccatcttttctagagatgggggtctttctatgttgaccagtgttcttgaactcctggcctcaagtgatcctcccactttggcctccccaaatactgggattacagatgtgagccaccacagctggccttacctgtgatctaaagaggtattttcaattgatgtttggccatatcagattttagttgctattaaattttattcttaatttatcaagtttaattgattattaaaaaattgcactctaagaataagcctgtgttttatttcttggaactactagagccttcgttacaatacattttagagggctccaaagttataaaataaatactggagatttggtgcttgttaaaattttgaccttttctattaaagcccattggagtgatgtacagagaaaaggctgtcttgtgttgtgatagggccatgctccatccacaggtcctgggaaggatgatgtaactgtggtctaacagcattgtctgaatttttggcctagggcaaagaggaggagggcgggtaaagaaacctgatcagaccatttgatgctaatttcacaggtgactggtcactgtgtgcctggctgttgttatttatagagctgtaagtggctggagctacacacaggaacctgaaaggatggtctgtattagagtgtggtggtagatagaagcacagcagtagaatctagggacaaatggtcactggtgagtgtcattgctggagttaaatgagactcattagtggctgttatgatttccactcttacttcattgctattcctgagtctttttgaaagcaaacaacaaaatagaccgaaacaacctctgatagactctccgttatttttaattgaggttgataggattttaatcaggtcaacttgcatactgatttcaaccaccatttaaagagctatccacaaagctataaattagaattatagttcaaaaggtctgactgttttaacctactgctcctattccccaaattattgatggggaaactgagatctagcagggttaaaaaaccagcccagtttcacagttagcagtgatgctggagctgtgatctggatcttaaatctctcagtttagccttttctgttttctaccgtattagtcctacaatgaaaatgcacttctctgtctttaaatttcagacgttgtctccatggcctagatgaaggttatcctttgttatgatattttctcagaattactttgaaaaatggttccattgttatttcttaaaatgaaagtaatatgaaaacaaattccttctattgataatacatttgcccactactgatagttttaggaataatgagaaaagagggggccaatttatggtattggccaagaaggagcgctcagcagcactggactgctatgtgtgggctggaggtaccagcagataacactcggaggcagtgggtcctgtgaatcacagcttggcctcggcataagctctggagaccagctctcctaaggagaactgccttctttggccctgccctcagcagcctgttggcagaggactagaataattgtttgtttaaaagttttactagctaattatactgcaccgaattgacaggcatctctattagagtctttccagtctcttgaaggctcttctccacattacttgtaatcttgcctcagtgtagactgcagtggctgatttttgtttgtttgttcttctctcctttcccttcccacttgttgcaaaggccacacaccaagtctggagagagagctgcctgtgggctgggaattggctgccttcatctggtcagccatatgtggctactggaaaaagtgcctttgggtcattcattctcaggtcaccaggccctagagtaaagccctaaacatgggctctctagcagaaagacttattaattccccttctcttaagtggaggcaaggaggtgtttctgaaccttcagaataacccgagggaacttgaaagtacagattcccggatgctatctcctggatgtgggttcaggttcagtaggtctgaaatgggaccaggttttagaatcttcttcgcggcccggctcacacctgtaattgcagcagtttgggaggctgaggtgggcagatagcttgagttcaggagtttgataccagcctgggcagcatagtgagaccttgtctctactaaaaagagagatcagctgggcgtggtggtgtgtgcctgttgtcccagctacttgggaggctgaggtggcaggatcacttgagcctgggagatcgaggctggagtgagctgtgatggtattactgcaggtggggtgacagagtgagaccccatctctctctcttgttttttttttttttgtttctttttaaaagaaccttcattacattaattgacttccaaggtctcatccagtcatgatggtttttgcatggtccctaccagtagaagatggatttcagaccacagggaatttatttgtagctacagtcaattttcaaattatttgccttacaaatgttttcaatcccagagacctttttcccagctggttcctgggttatattgccaaagtccctggttggtatgcactcgagaactgaaagataattttcttcttgattttaagaaaagataattaaggagggaaatctaccattaaaaaaaaaatcagacattacaaccaagtataacttttagagcagatcctctattgggaaggagcaatatgttatgttaccttgtatttgagcagttaattagggtcagatgtagttagttctcatgctttggccttgcaaaagtaatcccctttttggaaaggctttgttgagtccctaggaattattttaatggtctctaagtatgtttaactcagtcataatattctagttgtttggatttgttgtgtattgacattgacttagatattctcccctgctctgggctttacctcttactcgtacccaaatccatggtccacatgctgtggtgtcccctgggcatgcccagccttgccatgtgtgcaaggtaatccctttgaccctctcaagagggtgctgctcatcttttttttttttttttttttttttggcttcacttatcccacttgacattgccaaacgtgctttgacttgaagcaccgctgctcctgtggctgtctcctttgcttctcctcttcggctcattgagaatctgtttgagatacttgtcatcctttggagattagaactcactttagagggaggaatgattttacactgggactgttaggatcagtttaggaggaaacaggcccacgatgattttaggaggggtttctactgtggtccttgtaaccacatagtttgtactgagctggacactggccatttgagtagatgcttgttctccagttatagaatggttcccagctggcagatttcccactgggattcagtttccttggccgctgctgtttgttgtgctcacactgatttttgcggcatctttccaggcccttgagtcttttccaagcagaagaaatagcagaatgccttgccctccccttctcttctccttttgggtattccatggctattagggaaggacttcctgtgaaataaaatgagggcaaaggaaagtagcatgcctgtggcataaaaatgctgttagcaagcttgaggcatatcagagagattggtcctaagagtaacatttactgcctttctgcttttgaacttttctttcccccttcctttgcctgtttctgaggtctgggatttatccagaatttaagaacggactgtttttgatcatttgaataggtatcatcattcagcagggaatacatgtgcagactgagatgtctcttaaagccaatttatagtataagtcatttgaaatgatttcttgagtcagtaatgcatttctgcttcaaattctctgcctggatttgtgcattcatctcccattttaccaggtgatttgctttattatgctgctatgacagcccccctccccaaccttcaactgctatccccagatacgtgggcatgcttttcagggtgagtagccattaaactacccaaaatgacaccgaacgttgtctacacaggcttggaaacatggagggcctggattccagtaaaattctccaggctgcttcgtcaggctattgcagaaaagattacagggtcctttaagattagttttggagagatctaggcagatggatgggtgaagtcccaatgggaagtcagtacccagttgccacttggaataatctaaaatcctggcatgatctttcctctcataacttgaagtactcagctagaggagagcctctccttcgcaagacccagctatctctttgagaagaaaagggggtttggatggagtccaaccttctggtttgttttgcccgtctgccatttgccttttccttgttggtgtttgctgctgtttgttctttggagtctgaggggcttctgaccttggctgaagggcttctaaccctggacaggtcccgaaggagtggcatcagatagttgtgttttaatttcacaaatctgttatttctttaagaggaaatgagcaactggtagacccagaacagtaccaaggggagctggggagttgttatttgtaagtgtagagaaagaaaggaacagttacagggaggtttggtgcatgatacacagctgatgccttcagagaataggaggttttctttctgtgctttttctcataacattggaggaagaagaaagaggaggcatgtggcttgttggtggttgaactccagtgcagaagttaacattccactcatttagctcactaatttattaattaatttcacaaatacctattgtgctactatgtgccaggcacccttctaggtactgggtttacagtggtaaacaaaaaaaggtccttgctgtcgtgaaccttatactctagccaagggggtggtggtgatgaggacatatttataatggtggtggtgatagtgataaatactatgaaaggaaaaaaaaacaagaaagggaagagaatgggatagggagctattttagtaagtgtgttcatggaaggccttataaatgactatacaatacataaataatcattaaaatgagattttattacctaaaatattttgaacacttcagttgttcaaattattatggaatgctagcatgcatagggactgaaaatatttttttctctgaagttttgagggttttccaaggatttagcttctctttgtttctctggatattcagactcacatagctagattagagttcaccatcacagttgctttcagcattgattgagacagtcttatgttgtaagggtctgctttttacaaaattgctataaaattgttctgtgtgattgagaggctccctctcactcaaagtagatgtttggctgtttttgttgttctgttttaaacagtaatgagtaccttttggtaattaaagtccccttcacaaaactgtagtgagtgatgaataagacataaacaaagaatcccttctgcggagcagagtgccaatggccatagacataactcaggggctgtttgaccacataactcagtgcagtggcttttcaccattggaagggtggaatggtctggtatggttttctggattgctctgataaacaggagttatatttgctgtcagtttctatgaaaggacagcattatatgagccatggtttgtcaggggcctactgtgtgctgggctctttgctataggatcaaatgctaactacatctattccacaagacaccctatcacagtgattggtttttttgttgttgtttgtttttgagatgaaattttactcttgttgcccaggctggagtgcaatggcgcaatctcggcttactgcaacccttgtctcccaggttcaaacgattctcctgcttcagcctcccaagtagctgggattacaggtgcccgccaccacgcccagctaattttttttatttttagtagaaacggggtttcatcatgttggccaggctggtctcaaactcctgacctcagggtgagaggtgaagccagctggacttcctgggttgagtggggacttgcaaaacttttctgtctagctagaggattgcaaatgcaccaatcagtgctctgtgtctggctaaaggattgtaaatgcaccaatcagcactctgtagaaatgcagcaatcagcactctgtgtctagctaaaggattgtaaatgcaccaatcagcactctgttaaaatgcaccaatcagcgctctgcgtctagctaaaggattgtaaatgcaccagtcagcactctgtaaaaacgcaccagtcagcgctctgtgtctagctaaaggattgtaaacgcaccagtcagcactctgtaaaatggaccaatagcactgtgtaaaatggaccaatcagtaggacattggtggggaaaaataagggaataaaagctggccaccccagccagcagtggcaacccgcttgggtcctcttccatgctgtggaagctttgttctttcactctaaatcttgctgctactcactctttgggtccgtgccacctttaagagctgtaacactcaccacgaaggtctgtggcttcattcttgaagtcagcgagatcaagaacccaccagaaggaactaactctgaacacaaggtgatccacccgcctcggcctcccaaagtgctgggattacaggcctgagccaccgtgcctgacctgtcacaatgattttttaaactgcatatcttaatccattagtgggtgacagtcagaattttattttattcagtttaaaaaatagaatcaaatagatgacatcagagtatactacacttagtgtgtgtattgtttcaaaaaaacttgttttaagtgtatgtgcatgcaggcagacatcagaaatttttatgtgtcatgctctaaaaagtttgaaaacaagcctatcagttgaggtttggtatcatttataggcaagtaaactgaaactctgaggttaaggacgttgcctactatcagaactaaaatttgaactcagctctttctggctttcagcatttgatccaattatgtttctcacagagctttccctctctaatggttttccaagactcttgagatcacagagacactgatttgctcctgacgttgttctaaaatcagaggaggaacatgcactctgatgaccagacccaagtttgactggtttctcaaaacatctttacataacatagtctatttcaggagaagggaaaagaaagatgactctagaacttgtctttattaagaaacaaggaaaatctagacactctttttctgtcatagaaagatagcctagttttaccagagaggagaaattctaaccagaagtagtatcaggatctttctctctaaagcacttaaagtcttttgttggcgagacgagtagagcaagaggaatctgccaccttgtgtaaaacattttggttttactagtcaggcatatttttgaataaccttcactagcatttattatagtagttattttattttattttgacacagagtctcactctgttgcctaggctggagtgcagtggcatgatctctgctcactgcaacctccacctcctgggttcaagtgattctcctgcctcagctgtaatcccaagaagctgggattacaggcgtgccaccatacccagctaatttttgaagcctctattttagtttcccccaactttactagagatggggtttcaccatgttggccagggctggtctcgaactcctgacttcaggtgatccgcccaccttggcctcccaaagtgctgggcttacaggcgttgagccactgcgcctagctgttacaacattttggcaccagttttacctacttccccagcctcctaggaatgaagtggaacttttattaaggacagatttttcagaggggcattattctcactggcattccttccctcttgcctggaatcacccttgaatgaattcctgattggttcagctagactttttcttttacagaagaaattgctcttggtgaagatgccagaaaaatatcgtaaaaacctgctctcttatcctcttctctgtactactttgttaccccaccccaccccacctcaagcccccagtaaaaaatgaccttttggcccagggccctatctgagtatattgtgtggcagagttgtctctggctgactcccaggattgttaatgacttccttctctgtccctaaataattgcttgaaaagacagctgtggagagacattgcccccagcttgcaggctcattaattcagccctatgaaagagggtgcaaaggaagaaggtggaagttactttgccaagagtagcaggcttgggggaaactaaaatagaggcttcaggggaagggcagcagcatggtgtcagagattacacttggagtttgtgaagtctgggcaggcttcaatctaaagaaactttatgcacaaaagcccaaatccagggaaataaatgaaagtgattattcacttttctaaagtccttacagtagcgttcctctggtattgtttgaatacagtttaacctgaagggcacttggtttttgtgcagctcttcaagaacagaagcatctaagtaagtagaaagtctgagaaattaacagagaagattccctaaaagtcagccttcattacttgaccattattcataattctgcatttgtctattcctccagtggccttgaagcaaaattaaaaaaaaaaaaagacacttctatgccccttaaaaaaagaataatcaaaacttgcatagacagaataagaatcaaatacactggggaacaaatactctgattagctgtccggttcagctctgacgcgtctagcactctgagttataagggaaacgataggacacttggtttttgttttccaacaacaggaaacatatcaggtttctaagaagatgtaaagtctttcttaaaacccaattatagaaggaatttatgcaagtctttaggcaaggagtattaaagaaattaatgtttaatgccatcaacaagttttcaagcagatgcagaactcctagtgtgggtgactttttggtgtttaccttatatcaagaatgcagcatttaaggccactttgacagagtgcagctaagctttttgggtttgcttgtgtggacaatttccattcagcaatggctctcaaacttcaatgcacatcagaattacgtgggggcacttaaaaaaaatgtatgcccaggctgcatccagaccaattcagtcagaatctctgatggtgagccccaagtatcaatattttgtaaaactgattccaaaggttagctaagtgtgaatcagtgcgttagatgatctttaacgttaattatcttagctggatttctcaaaggggtagtcctagaatgctgatattccctgttattaatttaagtaagtccctgttgtttctgttaacattctcttagaactctgagacttgtatttctgctgggacccagggctactgcacctttcttggcctataggagtgttgtcagaaccaaagtacttgttaagcagcagcttaggatcaacattagcagacctcattgtggctgttggagaatatagaacatcagatgaagtaggggcttgacgtttccacagccctaaatcacatatttcagagtacgttaagattccttttggaactcagatctttttctggccatggatagactgttgtcttggggggatgccagttgtctctccagtgagaaaaggagatgtttatgtattctctagttcccttctggaagttaaaaatacctgtcattgttagatttggtttctgaactctctgcccctaacaaagctgaaatgatgacagtgagtgaagtatttgcttaaataaatatcttttttttcaactttgaagaactaaatatatctcaacgtgttgaaacatcagagaattggctgggcccagtggatcacacctgtaatcccagcactttgggagtctgagctgggaagattgcttgagctcaggagtttaagactagcctgggcaaaatagtgagacctcgtctctactaaaaataaaaaataaaaaaaaaaatggctgaatgtggtggcacgtgcctgtagtttcagctatttgggaggctgaggtgggaggatcacttgagccctggaggtcaatgctgcagtcagctttgattgtaccactgcactccagcctaggtgacagagtcagactctgtctcaaaaaagaaacatcagagaatcattgattttatgtaatctagattttatcccattccaaattgtgcttctgtgaatacacattatggaggataacggaaagggtgtttagggaaggggatgacaatgggaggagagggagaaaagggtggtgggagaggtaatataaatgataattaccatgacttgaatcttggtaaaatcgtataataggaaccatgtggtactggtgttctgattaaaaaccacttcctggctttgtgaccttgagtaagctataactctatttttcagttttctcacctgaaaaattataatgatacctgcctgttaggattgttttgaagattgagattgttcgtaaaatacttagaaaagtgccttggcacatagcaagtactatttaagtgtttatcagagcatagtctcaacttgtcccattaagaatattataaaactgtaaggtccagatgatgctttattctgtaaaggccattaatggagatgcttgaacatctctaaattacctttccctttgcttgctcaggaagtttgctaatctaaattcttcatgctgtgctgctgagtgtcatgtgtgattgcttgtgcaaggagacccaactgggttctatccgcacttaactgaaactcaagttattccctctctagccttaattcctgtcttctaactctccaatcgatttcttggctccactaattgaaacctaccccagttttctcatgctgttgagcagggatcttcttgagactgattatgatgggagaatgacctcatagtttctgatgccatcttccaatttatgtaactcagccccaagcatgctttttaaaaataatggccctaaattgctgacatcttgtcatctgctcagactcctaaatctttttgtgttccctcgactgaatgggattcactggagcaagatgcctttgtgcagtctgcatttagtgcacttggcgagtgacctccaatagagctgtgtgttcccttcgagcaacatgggtaatgattacagcgacaatgctgctattgtgtccagaggtttggggctgtaatttcataatgaaattgaaaaacatgagattaaaaacctgaatatagcacagtaattatatttaagtatcacaaatcatctccctgtatttagttaggtgtttgagatttggcctctttgtggagtgcagtcacgtcgtttcatacatctgcaaaatggaaggcttctaatttatggctaaaatgtgggaattgctttctcttaatgggaaggtgaggagaatggtattgaatttgaaggagctggtttgcttcattgactagagtcaagaagggaggttgtacaatagctgcttaaggtaaagaaatgtttgggtcttttcatggtttaattcccagatacttacacatgactatagtctctccctttagaaattaactgacataggctggcctgggaaattctacagtcctgcagcaaatggtgcagttgcagaagtgtgaatctttacctaaggcagggtttctggtatagataaagacttaactggggtttgtttcccacaggtaagttatggatgagctgtgcctggcccatttccatttactgtctgagaatctgcatgtggcctgcaggctctgtagttgggctgagtcctcctggagtaggaggctggggaaggtgttggtggtggctgtcgataggcattcctgcaggatggtgggtggagagttagggtgaggggtgttctttaataaaggaatagaaattagagtggaaagtggtttaaagctagtgatacctccttctccttgatttctaggaactatcaagtatgaaatgaacatagaaggaagttatgaaaggaatcattattattgtcagtgattcttgattatctactataggcaaacacgttaagttgttgttttttttttgttttgtttttttttaagacggagtctcgctctgtcgcccaggctggagcgcagtggcgcaatctctgctcactgcaagctccgcctcccgggttcatgccattctcctgcctcagcctcccgagtagctgggactacaggcgcccaccatcacgcccaactaattttttgtatttttagtagagacggggtttcaccatgttagccaggatggtctcgatctcctgacctcgtgatccacccgcctcagcttcccaaagtgctgggattacaggtgtgagccaccatgcctggccaacactttcagttttggttaccatctttaaacttcacagtagacattgatacagaggtatactttctctgtgcacatatactgcctctcaccccaaataatttttgatacagcagtgcagagtgtccctttttttccaaagctttcctcccagattcttagtgaatctacgagactgagtatctgaattgcctaaggccttttatcacaaaggccttaggcaaatgtatgcaagtgtacatacattaccaggcttcatcaacatgccctactcagagacatttcggttcattaggtaggggtgggagaggttgtggcctaggaatctgcatttcaacaagcaccaggaatttttatatacaataaattctgagaatcattgccttaggaccttctttctcaggggccgggctattccagtgggtgtgttatgttgagatttgctttgtggagatgtgaacttgctgttcagtcccttttcctagcccctggcttcagtatatctttcacaaaaatacctacttttattctgtttccactggatacaaggagggctgggctttttgctgctttacccactattacagatagcaggttgggagacagtttgagtcctgtgtttgcactccaggcctactagggaagaggtggcctgcctccagcagtaaactggtaactatctaagacctatggtgctctctgtttccactggaaactcattgaaaatgctaccactattcatgtttttgacctctcagagcaaagtatataaaagcagcagttcaagtaaattcgtcaaacatttattgagtggtggctgaggctaaagtattattttaaggggcctgggacagataagtaaaacacagtttccattctccatctatcctgtctttctttctaatgatgtagacagtcctgacacagaactatggcagacttagtgtaacctgtgacatgatcgtgtctttgaacaagtgaaattaaagtgctataggaatgtctgggtgggaacagttagtttaggttaggcaaaaggcttcttaggggaagtggctttgggcagggtgtagggcagaggctctcaccttggctgtgctttacaatcacctgagagaattttgaaaaaccccaatatttagaccaaaccctataacaatcagatcagaacttctggaatttggacagagacagcattttttaaatgtttaaacatttaaaaacattaaattttttaaatgtttaaacatttttaaagcttcctacatgattttaatgtgcagccaagactgagagccactgacaaagaaggataaataggctgtcattcagatgggggatagtcagagaaggaaaggtattccaagcttgagagaataacataagcaaagctgcagaggcagcagagtgatggcttaagttggagaatgccactcaaagcgggggtgattggagcatggggctcctggcatgagcgtggagggaaaattatgctgattaggtaggattggattaaaatactgcatcaaggaattgggagacatgattttgcactgcctttggaaccccttttcacctcatattaggatggagaattgaggttcggagaacttcttgcttgcccaaagtactagtaagccagcaggcatgcttggttccctttgcaaggctctttgccatagacctgctgtctcaagctgtgcagtacttaagacttctcttttggcatctgtcctatagcacttttctttcatcagagcaccctaaaggtaatttagggtcagaatggtaggaaggtattggtgttaggcaagaatatggcacgatttcttatctttttgctgggcccctgtgggaatgatatgggagaattgctgggaatactgggggcagatgtttgcaagtaaaagtgtatatgtttctgtgttcttgcagctgcattcgttttgtgcctgattccactaaggactgtactttatctgcttattgctgtttctaggaagttaatttgcaggtgctataagtatgcatgcttcatatacttcatttattctttcttccttgaagcctctcctctttattaggcactattcatttgtctacttggtacctgtatttttttaatgtcactattttgacagtaccaataaaggtaaagccactcaattacgcagggctctctctttatgctttgggtaggtgcacctgtgcaactgaggggacggtcagtgttatcaaggttacctgttattacaagtagaagaacccacagagatcaggagagagctcattttcctccattagtaggaggtaggactatacattcacaaacacgaaccttaaaatagctcacaaaatagtgtcatacatgtacccagccatctttccactcattccttctcaaaaggaatgtagtaccatatagtagttaagaatatagacactggagccgatcttcttgagttccaatagtggctcttctactttttaaatctcattttccttcatctttaaattgaagatagtaacaatctcatggggttgtgataactaagggggtaatgcatgtaaagtgcttagaaaatgcctggacataggaagctctaagtttgctgctactactgttattatggttactattattaatcattgcaaggaaaatgtatcaacagatgaatttggttcaatactgccttctagttttgtgaccttagaatttataggaacaaaaaagatttgaaagggaggttgggctggatcatagagagccttgattccatgttttaggatgtatacacagtgagaagtccttcaggttttggtcttggtaagagttgtgaatcagaaagttaactcttgtagccaggcggagtggctcatacctataatccaaacactttgggacatcgaggcaggaggatcacttgaggccaggagtttgagaccagcctgggcaatgtagtgagacccctgtttctgccaaaaaattactcttgcaacttcatgaaaaataaatgattagcagaattagagcagttaggaggccatcttaatagtccaaggcacaataaggcaaggaaatgaatgagagcagtggcagcagacatgaagatgagcagttggatgcgaaaggtttgttctatagatagattcctcttggcttaagaaggggaaataggaaattaattagtaatcagaaatatttgcatattagtcttctccatcttcatccttgatgagaggagagcttgttatgtatgtaccattgctgggtacaggaggcagaagagctagcgccagaacaaggagctcagctttttctggtctctgcttttacgtggctcgttataaaccaggacccaattagttctttaggcatgcctgcctgttctctttccatgtaattactttgtggagcttgggttcatgcacatagttacctcgattaaaaaataagtttttggagctataaattttcaaacactgctttgagagggtctgtcaggcattaacattcaaggtttctgtggtgggctgacgatagcctctagcctctggatgtttttcacattccaggaaatgacacctgaagttttcagttccttttcgcatcttcagcaatccatagacagtggggtgaaaagatgtaacctaattgaagacggatggagtggagtagaagttgaaaatagggaagaggctgggtgtggtaactcactcctgtaatcccaacactttgggaggccgaagtgggagaatcacttgaggccagaagtttgagaccagcctgagcaatacagtgagacttcgttctctaccaaacaaacaaacaaaagctagttgtgcatggtggtacccacctgtagtcccagctacttggaaggctgaggtgggaggctcatttgagctcaggagttcgaggctgcagtgagccatgattgtgccacttcactccagcctaggcgacagagtgagactctgtttccaaaaaaaaaaaaaaagaaaagaaaatagggaagagactgcatgagtcctgccatgcagtctttcccagaattggacatttttgtggtgtggtctggaagaaggaaaacatttatggtcatacctctccaaattgaacaattgtgggaatatgtacagacagatttgcagggtagctgaaaagaaatgcagttctgttatttttttgttatagagtggtaacttgagtgaggattatgaaacattgcctagcagaactgtttttttaattgaccttcatgtataattaagaatatcaattattaatgttaaatatattggaattttaaaaattgtgattatttctttgtaatctgatttgtgctatttgccctgattatcagagtgttgtttgagattaaagtggtctagcttgggttcagtttgcaccaggagttttgaattaactaggctccatctgaatgtggaagattttcgtcgtgaggatgcaatggaatcgtaagtgtaaagggcctagtatagtgggtagtaatttattttactcctttttttccactttaaatgaagagtggctaaacttcaacttttgggacattggtctctacctgcacctccagaatgtaacctcttggggaagatatttggagacctggggacttttgcaggtgggtagtattacgcagagcccagatacccctgccttcttgtctggaaatcagtgattctcaaactgctttgtgcttgagtattacctggggggacatgttccgttttcagctccccaagccatagagttaagattcaatagacttgaggagctgctctcagtccaggattatgtgcagatcccgaatctgatcttgggctgctgtgcttttccagtgcccactcagtatttctggggctgcaaggaaggcagtggttccccttcacaggtacgtgaagctcttaactccatttttgtccttttaaattcacattaaagagagttttagatatgcaggaaaatgagaagggaaattgaccttgcctgtctctgggtcttgtgaatagaaaggaagagcctgcgcttggaggccactgggaatttgtggtgttccagaagacctctgctctcatgtgggctcttggcagcctcactgagagccacaatgggcttccttatttaagatgctcttaaattttcttttctaacactataaggttatgtcttcaccagtttctcagattttaaaaaaagaaacagggaggtaaaacaaatcccaaaacattttttttccttcttgtaaaggttacaaacataaatcatatttgagaacaatgaatggaccttattttttatcttcagaatgctgggcctctggcatcttagaaagtctctttactttcgaaaggaaggagacttgtatagtgagagcatcacactctggggatcaggtaacttggctatgctactgggcacctgggacttcttggtcagaacaagtctccactgtgagcttttttttttaatccatgaaatgtgggggtcctgaagctatcaaagcgttaatgttttatgattctagtgatgggcttctgtctgcgtgacaggcattttccagactttgttgatctatttcgagcttgtgaggaatagcatgtaccacccttcattacctcactcatggttcctcttcatcagtgctttataaactgtagtgtgtttgtgctgggaggaacgtaagagaacatgtggatcacccctttactcattttacacatgagaaagatgataccccaagtgattttctctaaggttgggacatgactggggctctccttgcgatttgcctttcccttcagtgcgttcggtaaacgttgcattaccccctcttcagggtattattctttcagttccatatgcctttcctttcccctgggatgctggagtattcagttttatttctaggcaaaagtactcctaactgtggcccctaatttttttttgttatgtatcttttctagaaagagaatttgattatgcattgtccatatgtttacatactgtactcataaatgaagttataaaatatatgtaagttaaaaatgtggagaaaagggaagtcttgtgcaccattagtggggatataaattattattggtattacggaaattagtacggaagttgcccgaacaattaaaaatagctgggtgtggtgactcactcctgtaatccttgcactttggaaggccaaggtgggaggactgcttgtggccagaagtttgagatcagcctggacaacatagtgggatcctatctctacaaaaaattaaaattttagctgggtgtgatggtgcacgcctgtagtcccagctacttgggaggctgaggtggttggactgcttgagctcaggagttcgaggctgcagtgagctttaatggcaccactgcattccagcctgggcaacagagcgaaacctagtctaaaaaaaaaaaagtgtgtatataagtacacacatacacacccctcaataaggctagagagaaaaaaattatatgtaagtatggtattttttttttcctcaatcacagtggatcagtttatgccttccctggatccagggtgaacttgttttgaggaccactgatccagaaagtggtggagttaagtctgtaccaccagctttagaatctcctgtggcacttattaaaaatacgaattttggtatctcaacccagattcactgaatgagaatgcctcctggtggaacctgggagtctacgttgtcttcatttttatgtttttaccaatagacatggggtctgttgcccaggctggttttgaactcctcagctcagagtcctcccacctctaccttctgagtatctgggaccacagtcacaatgcccagcaaagtctccattttaaaccagaggcaagtctccaggtgcctctgaggtccagcgagtttggggaaccggtattttagacaggcagggaagtgtcattcatgggttcatgagcatgggacttcttacactgacatctcagaaattgctcagctgttactgttaaatctacagtgatacagttagcactctggaaaatcagatgggcagttttcatttgagttacatatgagggactataacctgcataatcatacatggaatttcttaaaactccttggcattctctatgtggttttttgatttgtaaatccaaatatttgctattgtgcctcagtctttttttcctcattagaaatctaagctctccccgccccctcctggtgctgttccttgaggggctgtgtttttatttctgagcttttcccatttgtgtgtgttccttttgtctggagtatgcccaaccccctcacctttttacctgggcagttcctactatctaaaaaattccctataaatgacattatttttcattcttaaaatctaaagataatgaagaactagctgataatcagcatttaccaaaatagatttaagggttattatttgtaataactcatgtgtcagtaaccttatgtatgtaaggatagatcagtatcttggttattaagcatatactctctgaaacattcgaatcaaaccagtgtaagtcagataaatatgtaacaggaaatttgtttctgactattcactccaggtcaatgtattcccagctgccttgtgggtatcagggttatctgttccaggatcagctttaggaaagcccctactcaaatctccatgtagcaagagtgcaggctagttgagaacatgtgataattaaggttaaacaaaaaaatcaaggcagaatgactagaaattaggacagcagggaaagcaggggaagcggttgagctggtagaaatgggtaatacctatgattatttctgggatcaacagatacatccctgttgtagaagtccaaagcagtccttctttttggtgtcttttcctgcctttggtatgataagcccccctaacatctggcacactattggggtgacattgtgaagttacctctgcccacagtacttactccagtttgatatttttaagaaatgctcactttccactagccatagtttattggctttcagaaagtgtctggcagtgagtatgccaaaggtcaagaattctggcagagtttgatttatctctgctcccttgatagcagctagccttggaggcatagaagctcttgacaagtactatgagtcagaaggccacatgtgactaggtccctgcccacctctccagggtcaaatagatcttgcctttttccccagcccctccctgcactgttcctgaagagggctgtgtttttctttccaagccctcccatttatttacattccttctatctggagtacttcttaccccctcacctttttacctggctaattcttatatatcttttagataattctacataaataacacttctttcacctttcctaaactagaataggtattcctgctgtatgcttctatggtcccctcatttcccctagaataacttactacagtttttcgttcatacttactgttatccccctggactgtctgttctgctaggataaggattcttgctcaccatttcctcattgctaggcataaggtatgggacatagcaggttatcaataaacattttttgactgaataaaagcataataaaacaatatgttaattaatggggtgactggcagggatctagttgccaatttcagcattggtaattaacatggctagatttagctgctaggttctatgagaaagaatgattaaaaataaacagaaaggagatggaagttgatacgattaaaaacattttatgtgcctgctgatggacctaaaactgggcaaacctttctgcaaataaagctctaccttgatggtcttattgatataccatatatacatatatatgtatgtatataaataagatatacctatatataaaatatttatacctatatatggtatataaatgaatataaatataagatatataggtatatatatgtggtgtatatatacataaatatgtttgtgtatgtataataaaagacattactctccattgaagtgtttactacattatgtactatcttaaaacaaaacttcccacaggtgtcagtacaaacatgcatttgttcatttattcattcattcaacagttttgttgattgtttgatatatgtcaggcacttttctaggtgctcaagacacaacagtgaacaaaacagacaacaatctctctgactcaatggaacatgcattttagtggaagggaatgtcaataaagaaacgtctaatatctagagtattagaaactggtaagtgctaggaaggaggaaagggggccaggaaatgatgtgatgtgtgctgttgtggtggtggggcatgcaattttagattcagtggccaggaaaggagtcactgagaaggcaactcttgagtaattacctaaaagggggtgaggaagtaagccaggtgggtatttgggagaagtgaggtaggacagtgtgcatagctctttggaatgtgctcctcatccctcatgtttattacgttggccagaccagcaggttgggctttcagtggcctgtttgatcagaatctgcaaatgtttcctgtctttggatagtttccctgactaaatcttagcctgaagacgtatgttaaggggagagcgtatgtttcttcttgccaacttagttttatggaaaaggccctaaggaaaaagcctgtcttttccttttcatgggtcagaatttgtgttttgttattttctaagctctagtttgtggtggaaccacctctctcagatcttgtttttccttcagggcacagtgtatttctcacttaagtagtttatgcagtcttatcacagtgtcccctgcatggggacctgataacttactctgattgataacggaagggcttttctgtctacttctgtctccttgatggcttccttatctgttgtcctgtaacactaactgtgaactcatttcattaggtaatgaaatgttatcttctgtaattgcttatttgtgcagcagtcttgtctctgcaactggagaggaactttaggttctttctgaaccttagagtactggctcatagtgcctgtgctataaccatcattgattgctgttggtcaaagcacctgactttttggggtaagtaaaccaacatcttgcttttcagtgttttgtttttctggattacccatctatgctttgggtttaatgctccttaggacttggccttagtatgctgctggagagcccaagggaacagtatattagtaagggatgaattctttgtgaattcttaaatcttccattgcgaagatctttgtacagaatactggttctgtttatattgacagttcttcagagaattgtgtgttgactgttcatggcagaaacaccataagttaattgctgtttcaaatttcattgacactttccccctcatttggaggtcatttcctcaaaaatgtcgttgtccacatgacagtttgtgtatgcttaataaaagagaatgacaaacccaagttcagctgttgttactggactgggtggtttttagctcctcccacaatgggcaataatcagtttggggtctcagcagaattataaatacctgcatttcatagtcttcctgaaggaattgctttacttggaatactgtagttcagactgctgatgtaccgtgcactcctttctctttgatgatcagctctgaagtgcaccaattggagagaactcttgaataaatgctgtcacttgtcacatgtggtcactttctggggactgtgcatgtgccagtgggggccatctagaagccaccgatgcccactaatataacaaaactcactgggtttgcttctctataatgatgttggattgctttgctggaaatccttaccatcttggtttctctcctctgtttcctgtaaacaccaaataaaagtccttgcatacaaatgttaccatctttggaaaaaaaaaaagtccttgtagttgttaacagttacagaaaatataacctgaagacttggagtcaaaaaacaaatccctgccttcccatacagtcagtaccagctataagctaattaaactcaactgttcccacctgttcccggggaggcctctaacagtggcacatgcttttctctttgggacttaacatttttcagaactctttaaatttcattttctaggccaggcatggtggcttttgcctgtaatcccagcactttgggaggccaaggcaggaggattgcttgattctatgagtttcagaccagcctgggcaacatgacaagacactgtctctacaaaataaacaaacaaattagccaggcgtggttccaggcacctgtggttccagctactcaggaggctgaggtgggaggatcatttgagcctgtgtggttgcggctgcagtgatcattgtttgcaccacagcactctagcctgggtgacagagtgagactcttgtctcaaagaaaattttttttcattttccattgacaccatactaaacaacgtgtatttccagaatcaacctttatttccctaagaaaatgtagattgtgatgtccctggtgagcaataagttaatattggctgatagtatttgagcagcagtgacagataggaggaagacaggagggaagagatgggagtgttgctgggggagtgggtgtgaaaccataacacacatatatggtcacgtacacatctgtagtttactcaaatggcattttcacaaagcacagtagtgttgcaggtatcccccagtgggcacacagagctttcagtcctcactgtgtgaaacttctcatacctttgatgttgaatttaagttcattagtggctcctatagcatgtcagaggtttacctcacttggttcctgactcaactctgaaatgctgagtttagggtggatttgaagtgtcaccttcgtctctactttctaagagtcagtaaagagctgccatgatagttaatcctatagtgcctccaatgaagacttaaatatacttactagcccagactttgctttatcattctcctgatctattagttttattcctgttgacagccaaaatgtaggatcatgaaccccacagttacatggatggtgacagacctgagttgttgtcgagaatcgtgctgagttttgttatcacatttcttgtctcgatttgtagcatctctggattttacttctttaccagaatagtggttatcaaagtgtggtcttcgaagcagcaatatcatcatcatctgggaacttgtttgcaatgcagatttccaaggctctaccatgacttcctgaatcagaaacctttgaggaggaagccagcaatctgtgtcttaacaagccctcctgtgattatacccaactttaagaatcactacacagacagacgttgctttccttttagtctcttgagcttgtaacagttgatattttaacttttatatgagagaggacagttatatcttcctttaaactcttatttggtgcagttgattgtcagatgcagagtgctgatgtgaggatggactgtgaatatgatccactgtggcagtgtttatagtctcagcccaatgccttgttgacttaagtagcagccttgataacaggagataaatctgcaaagatactgtgaggttacatggcaaggcttttaaaatacaccaacattacatttgtggcaagtgctttgctcaatgttggcatttttgaagtcaccctttacctctgccccctgcccagaaatttccttgtgagaaatgtttttacgttagacaaactgccatgggggaggatagtcagaaagaggagacaaataatacgcagaggcagacttttttttacatttgttgctcagaagaaaaaaattccaatgaagaatgaaagaggcttcatatcctgaataaagtaaatgatctgggtaggatggtacaggaatagaatgtgactataaaaaagaaccaaattgtgcagacaagaaaatatgaaggaaaaaagaataggaaaaagacagggaaaatgcaaattcttatggaatatttttgcaaatctgtgtacagaaggaaccaagcaacgcagatcagttcttctgaggctgggagttctaaaaattatgcagtatcaaggaaggctttcttcctgagtcaagtgtaggaagcagaaccaacctttatttctctatgaagatgtatattgtgatgtccccagtgagcaataagttaatattggatgatagtatttaggcagcagtgacagaaagttttctttctcctgactgaatctcacaccaaggtccctttttatttttaattgtttagtttaatttttgttttttgttttttgagacagggtcttactctgttgcccaggctggagtgcagtggcgcgttcatagctcaactacatcctcaaactcctaggctcacacgattcccccacctcagcctcctgagtagctgggactataggcacgtgacaccacacctggctaattttgtaacttttgatagagacacacacggtcttggtcttgctatgttgcccaggctggtctcaagcggtcttcctacctccacctcccaaagtgggattacagatgggagccaccatgcccagccaaggctttttttttttttttttttttttttttttttaaaccagcgtcacaaccacagaagaaagacaagaggaagatatgaagacaaaactcaattttttttacttagtgtgtctaggtaaaggtttagtaggagataatgtagaaatgaaatatgataatagcttatttgtgttgagtgctttgatgtatgaggcattattctaagggcgttatacttgttgaactgtctacttcttacagagtctgatgagctacactctgtttgtgtatttgtttttggtggcttttttgagacagaggctcactccactgtccaggctggagtgcagcggtgccatcacggcttactgtagcctcgatttcccaggtttaggtaatttacccacatctcagcctcccaagtagctgggactgcaggtgtgcactaccacgcctggctaatttttttgatgagctagactctgttaccctcatttgctagttcatgaaattgaggcagagagagaaagtaagcaatctggccaaggccacacagctagcaaatgggatttaatccctagcattttcattccagagccttgcctttagccatcacactctactgtttctcttccatagtcgtcttctttcttgtgattccaagttaaagaattgtcatggatgagctttttccaggagtaaaggtacttgttggactcttcatcagatttggtcgcgggaaaagaggttgttgctcttccttagagacctgttctttctgcatttaaaatctgagtgtaaatttttttttagctggaaattttaaacgtgtagcaagtgtggccagcttgctcttgtaatgtttagtttcctggacctcatgttgcctccctaaaacttaaatggggttgtggttgcacaacagtatcatggaaatgaaatgaatcttaagcctaatgagtttgaataagatgagcacaatctaattttgtttccagtcgtttttcctcctttaaacaaagaatatcatgccaaattggaaacattggattgtgtcactgtgggtatttattttttactacatgtcaccaagatccagatttgttgagtgtattagttacatatggggtaaaattctgattttttaggtgtattagttatgtatggggtacaaaattaccacaaaacttaccatcttaaaacagcaaacttttactatcttagtttatgtgggtcaggaatttctgagtgacttatctgggtagttcttgcttgacttctcttttgagattccaggagtaaaggtacttgtcagactcttcatcagatttggtcccgggaaaagaggtcattgctcttccttagagacctgttcttgttgcatttaaattcttagtgtaaatttttttttagctggaaattttcaacctgtgtagcaagtgtggccagcttgctcttttaatgtttagtttcctggacctgcagccgaaatgttatctggggccactgtcatctgaatgtttgactggagctggagagtctgcttctaagatggctcattcatatggcttttggcaggaggccttggtttctcaccacatggacttcttaacatgacagctggttttaccagcgtgactgattcaagagagagaaaaatgacctaatcttgcaagtcagacactgtcacttctgccacattctgttagtcagaagcaggtcattaatggcagcctgcactcaaggggaggagaattaggcccaagctttttttttttttttttttttgaaatggagccttgctctgttgcccaggctggagtgcagtggcacgatctcccaggttcaagcagttctcctacctcagcctccggatcctgagtagctgggactacaggcttgcactaccatgcctggctaatttttgtatttttagtagagacggggttttaccatgttgttcagactcatcttgaactcctgacctcaggtaatctgcccgcctctgcctcccaaagtggggattacaggtgtgagccaccgcactccggccaaggccgcacttttgaagggaggagcattaaattgtggacgtattttaaccaccatagtaggcctgactccacacctactaaatcaaactctctgggtatagtaattttcatttttaagattctctcaaatgatttttatacacacttaaaatagaggacaactgggtatctagaagtaaatgaatgctatcatggcactatactagtttatttaaaaggccagatgtttttcacatgtttagcattctaaatatttgaggtttgtggatgaggtcacttggaagtaaaaaaaaaattttttttcaggtttgcgcttaggcactaaatcatatactaggtaatatagtacactctgctcagactgcattttatctggatgggcccttagctttttttctgttgctcattcaggcagatgagccccactctaatgtagcctgtggtatctgaccagctgctctcagtgcatatagcccaagcaggagctgtagctcctgattagaaagaatgaagtatatgtctgggcagggcaagccaaaagggattctgaggttcttgtctcaagatccagggtgaaccaggcaccatctgatgatggtctttggctcattggctcctacagctgcatactttgttaggagacatgaggggtacagaaccaggagtttgcaaagaacaatcatttgccttctggagcccttctaacctggacatcacacccttttgatgttaaatgacagacgtctggctctgtgtgacatcatacctatcttatcttagtgtacctcagctaacctcctgaggcttttggtggggaatcaggcctcattccccatcatagacataatttcctttttttttttctgagatggagtctcgctccgttgcccaggctggagtacagtggcgcgatctcggctcactgcaagttccgcctcccaggttcacaccattctcctgcctcagcctccccagtagctgggactgcaggcacccgccaccacgcctggctaattttttgtatttttttttggtagagacggggtttcactgtgttagccaggatggtctccatctcctgacctcgtgatctgcccgccttggcctcccaaagtgctgggattacaggcgtgagccaccacgcctggccgatcatagacatcattttcttaccttcccattcacattagctcttagccatctgaatgcatgcctacaaggaatgcaattggttgcttaagaacggaggaaacatgttatggaaatctatacttctcttcaaatgtttgtaccactcacctacccaattcccttcccaccccaatcaaaagacaaatacccatgctcagaacctgggggctcacattttacctgaaattccacaagtaacagaagcacacatttaggggataaaaccctagagagagagtaacacaatcctggctgccatctcagaacaagagagcattgtacccagagtccatgatcacatactggaatgactgtgtgacggagctgacatgccccaataggtacaacagattgttctgcttgtaaccaatcaataccacaattaacaaatatttattgaacaccccggaagcaccctggtatatactgtcctcatcagctatttgttagaataacacgaaacctcctgatcctctgtctgccttcaggcttgcctctgccccaataaaatcaattctctacatcaaaaccagagtgacttttcctaaaatatacacatttgaccaggtcatttaccttgaaatgttctggttgatgttcagcatccagataaagcccacacttcccagcatgacctaagaacctgaccgtgtgactctgcttccctcttacagcttctccacacatgttccagcgtccaggcactctccactcctcgtgcctcccaccatgcccacctctcttgtccttcccatctttatgtgccacataacagcggctaagagtgccggcgtcagagctcataaggctttgattcaaaacccaactctatgacttaataattgtagagtcttgggtaaattactggatgtttctgagcctcagattcttcgtatacaaaaataaaccaccagcctcacaggattctcataaggattaactgtgatcatatttaaaatgtttagcacagtgcctagcccataattaagactgagtaaatattgctattgctatattgatgtatggaaagcccttggcacacagtagttgtttaattaaaaaaaaaaaaagatccttgtctccgggagcctcagtttttttttgatcattggaacttctcagtgtgacattcagagtttgatataggagtggggatggcattggtgtgggtagagaactagggttttgagggaaagagagagaaagttgataggaggagcatagatgtaaaaaccattgtgtgtttccatgtgatcttccttccgtttgaatatgactaaaaatgtcattcgttttggggcagggaaaaatggtagactaggattcggaagaaactgacattctgacgttgagtaagtcactgctttgcgcctttattagttcatatgtaaaattggttcatcagatactgtttttgagagctttttaaagactagaaaacataacgtgaaataaaatgacaatattatacccctaattctacatttacagcatattcaacatttttttgaaagcaacatttttgtttacacataacagatgctgaagcacacagccccctagaaatggaggttgccaggaggataaagaagatcatgaatgctgccagtgtctctaatctttgccctcattccttgtgtgtctctcatttgagaagttctcacctttcctgggggttctctggccagagtgtttttactctgcaccactctacctgccgttgactgggttaccttcataaaagaggaatctgaagggccttatgggaagagtactgctggtggacacatggaatcaggaagcatagtttgaaatctagcacagattaaaacttgacctaacactcaaaaggttttcttctctgtgatctagggctctctgtggtcaccatattgcatcactatgaggtttaagatgaatgtgtgggtacctagcaaaggtctggcatgtgatggatacaggacagtcttgtcttttcctacttggacacctgagatagttccccagtgtaccctgaatatctgaatccaaaatcttcagtcaagaaggagcctctacggactagatccaagcctccctttctgatcttatttctattcattaccttcatgctccccctcccgtccataataattatcctccagactcaaggcccttcacgtgatttttagtttattacaccttagcttttcctttcttctgtatagactttgctgtacctgcaataagtgatacctttcccaggtccatgggacttgaaaatcctgtttccatcaagcttttccgcaaaccacccctcctcaccaggtgggagccatcgttcattccctgttcccccaatgcatgttgttttgcttctattatagctcttatcacagtctgccttgtagcatagtcatttctgtgtgttttccctctggattcggagcccctggagggcaaagactatgttttattttatgctgtatttccccacccccacagtgcctagtgcagtaggggtttggtaaatactgcttgaatcaatgcatgaatgaaattgcctctcctagttctgtttgcaaggctgtaatgcagaccaggtgaatgtagaattttggcttactggatttagtttagcataggaagggagttttccaagaagcaatagtggttttgaaaacagaaattgcctttaatcttgtggaaaacatatgccagccctctccataatagtctcaattacaggagagcatcgtgttactgtaaaaacacaaataaataaacccatgacaatactgtgtttgggagataaaaaccacataaaagccatctttccccaactctccagcatcataattagggtatttctgggaggagaaaaaaaagacaccagcaaaaaacaagtgatactatgtttaagaacacttcttgctattggcaagatgggagtagggagttagattttccatacagcacaaatacaagggttcttcccagctcctaccaggcttgatgctatatagattacactgcatgataaatttgggcactagaggtgccaaagatggtggcagaacctggagggcagaaaatgtcacccagaaggtgatgctgtgaaatttattgctctgccacactttacctaaacatgtcctattattctgaatgctgggtcttcattggctcagggatgcccttggtgcgtccgttgccatgggctacaactttcaactgtattttgtttattgctggtcatttaagtctctatctggtttttttttcttttaacttgagggctccagatttaggttcttttgaggtaagagtaggaatgactttgaaatattgcctacttttgtcagtattagttaacaagcactgagggctgaatgacactgaacagaacccagccatttctcagcacctctgttgccactaccctggtctgagttgccatcatgtttcacctggactgcctcagtagcctcccacctgacctctttgctcctactttgcctccctgcagagtgttcttcactcagcaaccagagtggcccttttaaaatgtactttagatcatatcactcctcagttcaaaatcctccagagtgcctcccatttcactaagaatgcaattcaaagaccttacttaccatggcctacaagacactgcacggtctagtgcctgctatctctcaccccatctcctactatccccttagattaatcctctctgacccttcagcttgcttgctgttcttgaacctggtcaagcatttcccaactcagagtctttgcattattgttctcttagcctggaacatttggtcccagatataaacacatggttcatactctcacttccttcaggcccctgagtgtcaccttgttggggaggtcctgtccacctgtatttctattgctggagcaagcacttaggaagtctttgttggaattgtgaataagcattgcccagagattctagcacatttggaaaaagagagtgtggtttagaaggacagtggctctggagttggagcagttgggcactgctgggtttgcctgccccccattggatagatggctgatgttgggaaaattatttaacctttctaagcctaggtttctctactagttaaatgagattatgtctatctctcagaatcgttgtgaagagtaagtcagataatgactgcaaagtgcttggcaatgagtcttgtacacatactgggaggcttcctaaataccacttctcacaaatcctacttcctgcttgtgaaatcatgttatatggaagaaggggagtgtctgaaaatggtttgaatcttgtgtgtaattctcaagtaccagcaagtagttgtgattatatttaaagcacctagccctgtgcttggcatatggcaggccttaataaatacccaagtcttcctgcttttaatcatcagacttagactctgggtgtgaactaaggtagctctgtgggcacacagggattttggtaaacagaaaaagaagtcagcagctgaggtaggggtggttcacagtcttgcttgtggttcaacagggactgcatttatgaaaatggcaagtgagcccagggcaattggaactttgggccttgccagcaagtgtggtatttcagtttacatcctcagagtaagtacaatttcaccattattccattgaggctctccttgccaagaaaaacccattgtaaatttctggtttaaaggttctgcagttttagggagttgtactttttgttgctttaacattttcttggcaccacacattttaagctgcactggcttaccttgtaaatagtatacacattttgtgaaaagctgaaccacgtcatttgttttcctatgttccttatgggaaatggtgatgcttctgccccactagttcccctgggtttctgatcaggcagtttggagtgagaaaatgagactgagacaaaatatagattgtcagcaagagattggagctgtattcacaaaagcactttgtggacatggtagagccaggcaggagagaaaagtctgtggccggcagggtgtctgtgtgacgtggacccattgtgtgtatgggctcctcccgctgtaccagtggccagctcccagccaggccacccgggcgagggcctctgaagcagagagccctgcacagtctggagccgctctaacccagtgtactgaataggactccaaagaataggagctgtgttccctttgtcacctgcaaccctgctttcagcctgcacagtgaatgtgcacttgggggctgaattggcacttggaaaaatctgcaggaactttgtgtgtgcacagcgtgtgcccagcggtatgggcgaatggagcgtgcacgctggagatgtctgggggctgggtgcttgcagaggagggctgacctctttatgctgcagggtttgccaagaatgctccgcccttgacagtgttgtggccaacagaaaagcattcgtggcatcttaatgaaaggcagcagttccttttttcaagaatgataggcattcttttcttgagcgaggtccccatttagggatggagagagaagccaattatttttcagttaaaatttattttttaaaatagtgatgcctcagttgtaaattaccctggctttgccatgaagacatttacagctagccttctgacttggttttaagttgctgccttgtagaataataaaatagtagcccaaactgtgataaggcatcaaagactttcatatcctatctgtgtagctgatgtgcgttgctccatagctagaaaatggatatattttctgaaagggaatgggtgtatttccctttaccttgcagcttgcacataatcgaacacttcttttattgaaattgggggttttctcccttggacttaataaggagatatagatatctatatatctatatatctatatctccttaagagggagtttcataagttcaaaagttgtcaggttgaaaggattgaggtattggaaacaacaatcttaaagttacctttggaatgatagatctttgaaaaaaacaggtagtttatagtacattggaggaaatgctctgttgttttgcatcttctccaggcctctttatgactactttttttttgagatggagtctcactctgtcgccagactggagtgcagtggcatgatctcagctcactgcaacctccgcctcccaggttcaagtgattctcctgcctcagcctcccaagtagctgagactacaggcacatgccaccatgcccagctaatttttgtatttttagtagagacagggtttcaccatgttggccaggctggtctcgaacccttgacctcgtgatccacctgccttggcctcccaaagtgctgggattacaggtgtgactacttttttaaatgcttcaatgaaacttaacatgatgacctacacatttcagctgcgcatatgttctacctgttaatggtgagatacaacagagccatctttgactacttcacgctgtttactctaagaggcctgtatcattagatgacttcctgttggaagcagtaatttgtgtttggacttgggtgactgtcagtatgaatctagccaagaaaggtcatgtcacctgctacacagtttgctagagggaatacaggccaagccttttgcctctgaaatcaaagtactgtagaaggtgtaatagaaatgatgcctaggtttgtgtattcagggcctgagtttctgattaaagctgttaacaatgggggcaagctttccccgtgggagacaggcttcttggatctaaacctttctgacatctcaaagctttatttcctgatgatttctaaaagggaaggagccagccccttgaaattaaaatatcgacttacattccgttctccccagacggaagaatattagcagattgaatcagttggggttagtactttcttttatgtgttaaactcagttattctggctaagatcagatttttgtctaggacggagctgaaacacatgcggaatcttgttggttgagggctggaaacgaaggttggcttcacacaggttgcttctccaaaccgtaggtaagctcttcggccccgtgcacagcattcacagctgctgtctgctgcgctttcttgctccatcctgtctagtctcagaagtttcatggtactaatatcttggatccttacaaaggactgacttttgacccagttgactgataactatagagtactttacagtttaccaagagctttccttcatgtttgctctttacatcaaaattacaagatgggttttattatccacattctttttgtagatatgagggccagagaggttatgagttagccaaagtctatccagtaattgacagagccaagattctaggctgggacatctgattccaaatctactgctcttcatgctcctttatactgcagctacttacctgctcaaagtatgtcattcactcattcgttcagcaagttcttggtggcatgggctttgaagccagacagctgggtcccagtatctgctcactagctttgtgacctctgttacctcttggaacctcagttctttcatcagcaaaatgaagatagtaatagtacctatctaggaaggctgttgtggagtcctttaaacagtgctctggacatagcaaatactccataaatgtttgccattcttcttcatcatgggctcactcagtggtacagggactccacaccagtgacagcactgctgttgaggatcacttgttctgatgcaaatatgaaaatagaagactgacaattgcatagtaaagggattgctaagatataagcaggatgctggggaagcttgaaggatgaacagctgtgttttcgattgccaagaactcggctctctagcagctcacccttgttgcctctacccctatttggtcacattcctgtcttactcattccttgctgaaggcagtatttaatgtgcaggggttttatgggtactttgtgtataacctctttgaggaggaagagaaggagagtatgtctggctaagggaaccttagtggtcatttgggattataagacctatatttaacagttggaggactgttcaagacaaaatagattccaaggttctggtgtgcagtgttctgtctgagcaccacaggatatcatatgtgagtggcttccagtgggttgctgagggaggggactttgtgggggaagtaggccttgagttggacctgaaagaaatgaggatttggattatgagtagcagaagcgtggagagctgggcagaggtggagttatgatatttaaaccatggcctgccttgggtggcgggacagccctgcccggggatgtgggtggtccaggaggcaggtgctgtcccctcctgcatgagaacctgcctctggaccccaacaggatgcacacagcttatccccaccctctgcaaagctacctaataatatctttgtgtttatggtaatgttttttgctgatttggtgggagataaaacctagagagacccacagcatggatgctaggtctgagtgggtctgtgagctgcaacctagctgcagcccctttgtttgtgagctgtttgcctgcatttaaatgccatttacataaggagctgtcagagttgagttggcccatgattattccttgatgtatgttgaaaaaagagaagaaaagaaaaccctggctaatgaggagctgggttccttttctccattgatgacagcttcctttctgatctgatggtccgtcagaaactaaggtggtgtgtgactgtggggttatgtccccgctgaagccgtcttttcctcagagttgtaattgatggggagacctgtcacttgttatgctgatgctgtgcagatttttgtgcagctgccagccaagagagttgtaggacagcatctgattgggtgcaggttgtggcaaaaatgataataaatagagagctggtgagggtagattttgattgacccgagattgtatattattaaactggagtctgcatgtacatgtcagtttatgaagaaccagacccataatccaactttaggactgtggcagttcgggtttattaaatgtgctttatatcactattaatattgaggagcaaagaggaatatctgtaatcttttaatctatgcaataatggtttggagggagattaccagatacattggactattgtttgtctataattgtattcagaactctccgaagcattgatttgtttctggcatgctgatttggctcagcagtctcataaagctcttttatagtcctctttgctttgtgttttccaaaaataattggagaataataataatgtggctggcgataaagaagagagagtaaggttgaaagcaaatttctagccgagtggatagccataaacatcttctatgctcataaacacctgggtctgtgacctttgtgtttataagatatttatcgcctcatgggctctctgtttgggggttaccacttcagtgccttgtaaaatttgattgtgtttagtaagtagattctgaatttttgctgagtagggaaaaagtgcccctcacctttgttttctttggaacaaccaatctgccaagaggggcagatctcaccaaggacaggagcagagagcttgggtgtgcctgagttttgtggaaatggtacagtgggacccagtaagggtatcttttgtacttgattaagtggcttgtgatggaaatgacttttgaacggaagggaattgtgcaacacatcaaataaactcaagcagtgtcgatgggttttccttttccagtagaaatggaatttttgattcaagtcgaggaagctttcttgggatttggatttttgccacttcctcaccctttcttcccatttccaaaacaggcctgaggaaatgagccagagaaatggtcaaattcagtttcattgactttaatacgaaggtatgactaagtgctgcaaaagcacagttgtcttctatcttcagcagtcctctaaacatttcttggggaagttttaggcactttgtcaacctctattgtcctcctgatggtgttgcttaattactcttgaaggaaacagttggattcctgtgaactgatgacaggtgtatgctgagctgcctgtgtaaactattggctgcctgttcatgttgtgcacagtggatcagaggcatatgggagaatgtgccaaaacgggaatcttaagggagttttttaaaaagtaaaaattgtttgcttttttgctgtggtgcgaacatggctcacttccgccttgacgtgctgagctcaagtgatcttcctgtgtcagcttcccaaatagctgggaccataggcacatgccactgagcctggctaattttagtgtatttttgcagagacagggtcccactatgttgcctaagtgggctcaagtgattctctgtgccttccaaatcattaggaatacaggcctgagccactgggcccagcccccagtaagctttattataactcaactagcttcattataactaaagtatgagccagtcttgaggtgtataggacctatatttatcaaaggagactgttctacctaagacttagtttcttgtcctatgaggttaattgctgctgcatttcatggagtttatgagatgtgcttccctctgcccttcttcaatcagatggtactgcctgggagtcatatacatgcaggactgataaagagcggctcccacagtggcagtacctacagtggactgtgctgtaggtaaagggaagctccatcacactggcatgtgggaactggactaaaaggccacgaatcccccaacacttactctctgcccagctttgtgaaatacaaaataattatgagttccagactccagagatgctttccacctagttggggaaggagaagtttaggtcagtggttctctaagttggtccccagacaaggagcaccctaattctctggggatttgttagaattgcagattttggggcatcgcccagactaacagaattggaaaccatggatggtgttttacaaactctgcaggtgattcagatttatgctaaagtttgacaactcctgctttaggttcatcagttccagggggaataaatgagtaaacaaggcacatagaattaagggcttcctatagggcacagcgaaggagagaataaggtgctttatagcaggatgctaagctggactgtcaatcatgtgggaaaggggtcaaagactggaagagcagggatcatcaaggcagtgtttgctggggagagaagttattgagccaggttttgaggactgaataggagagaaagaggtagagtagcatgaatgagctcagatgtgatagggagggttctgttccttcaagagcttagttaagtgtagtgaaaacacacacacactccggacaagaaaaattaatgtaaaatcaactatagaacttaggcaggtttatgaagaagaaaatatattcctcacaagttggattcctgtgagttcatctcttttattacctctggcaatggtgcaattaattggggccagggctctgcacctggaaaggctttataacgtgagattctcaagaggaagattttatttgcctaaggctactactttaaaagtgagagaggcactcatgaaaattaggggtaactgtaaaaagtgataagctgctcaacatagattcagtgcccagtatgtataaagtgctgtgtgtatactggagagagggaactggaatctaacttggggatgggggtggatccagaggagtagagatatgaagaaatacacatttaagtccagtaagtttttcatgcacctgtagtcctgagaggtgaagccagctggacgtcctgggtcgagtggggacttggagaacttttctgtcaagcaagaggattgtaaatgcaccaatcagcactctgtgtctagctaaaggattgtaaatgcaccaatcggcactctgtaaaatggaccagtcagtgctctgtaaaatggaccaatgagcaggacgtgggcagggacaaataagggaataaaagctggctaccccagccagcggtagcaatgcagcactgatccccttccatactgtggaagctttgttctttctctctttacaataaatcttgctgctgctcactcttagggtctgcaccacctttaagagctgcaacactcaccgcgagggtctgcagcttcattgctgaagtcagggaaaccatgaacccaccgggaaaaacaaacaactccagacgtgccacctttaagagctgtaacattcaccttgacgtccaaggcttcattcttgaagtcagtgagaccaagaacccaccagaaggaaccaactctggacacagtccaagctactccagaggctgaggtgagaggatcgattgagctcaggaggttgaggctgcagtgagctgtgattgcaccactgcactccagcctgggcgatagagtgagacagggtctccaaaaaaaaaaaaaaaaaaaaagtctagtaagtttttgttttcctttaaaggcagaggggagccactgaaggttattgagcagggaagtaacaagattagagttgtaatcatgaatctaattaaaaaatcagtgactggagggaagtagatgggttagaaggctagtctagttttaatactgtgaggcagatgagaagggcttgaactagcagagttctagaaaaatggtgatgtaagcaacaatagagtcatattagttaagggtgagagggaagaaatatttacaattcactgtggaccagccacttatgcctgtcattggtagagcttaaccatcacaattttagcaacacagagattgatttttatagaaggtccaaaggatatgtagcttggagacatattcaagatttgactcatgctgggtgttatggctcacacctgtagtggctcacagctacctggtaggtcaaggtgggaggactgtttgagcccaggaattgggaccagttgggcaacacagcaagatctcatctccaaaagcaaaagatttgattcaagcctgcctgcctgcaaagcctgtaccctttttgctctagattctagactttggcgaatagaatgatacattttgtttataattggacagttgttgatcttggcagaagtgttgactgctgggaggtgttaagagaaaggaaaaagcagcataagatatggaagtttgtttgatgaaactgtatctcaaagagtttaagagttttagcacaggacagatagaatcttgccccacccaagatgatggaagaacaaaacaaagtctgtgctgttttctttgttaaccagagttgagagtggagtccaatccaatatctgcctagtgggagtctcttgagtcctgatcccatgagatcatacatatggctgctactcctgttgtgaggaaggttgcaattttagaaataaacctggagcttttgaaggtcctatttattacttcagcccacttactgccgaggtccccatgttttgcaagtgacaaaaataaatctaaaatggaaaactagggagaaggtgagagaaagtgtccagagaaactggggactttgagttgtttggtctaagctacttatttgcatttttgtctccacttcctagcaagcatattggtacttagcaatggtgggaggaaggcagaactgtaaaaaaaacgaagtcatcattctatccttacacttgagtttcctttcagcaacctctctctcccttgtctttgtcccgtctcataacttaggcgtgatgtgctgctgtatctgccttgctgccttctcctgagtggaagctgcagctacagtgttggttattacacctggcaattagattgtgcaggacagtagttggctaggaatggcataaggttgcatgcctcgttaaatctgaactccactcagcatagactcttgtagaagcaagggggatttgtttaggtaaggagcccttgaaaggagcctgcttgttgaactgtatgttgagcagcagtgatgaaaagatgcctaaacatgtgtcccacagcagctacagtccatcagcattggacacattggtagatcacccctgctgttaacacaggtcttttcagcttactcgtttgtgtacttaactgttgagtgctcttttaattaggggcgactaacatcaaagtactatagttgtgccgggcctgctaatcaacaggtttcacttatactggggatcacttcagctttacaccaccattatcatgacattgatttttctgtgcacataaaaggaagcacttactgaatacaggaaaaaatcatgattgctaggtggaaaaaaaaacaaaaaaccagcaagaggaactcagttacccagggaaaatgtaaacgtttcatatgaacattgacagtgaaatggatttgatgagttttgaggtgattttgttagatactttgagagaaattgagaattctgtattccgaagagacagccggacttgaaactctagaggtatgattttgaccaagacctgaacttctctttgcctcagttttttcatctataaaatagggttagtaataataccaacctcactgagatattgtgaggattttgtgagatattgtgagattgaatgattagcttagtcactggatgtaagtactcaaattatagctattaataagtgtgatacggctgggcacggtggctcacgtctgtaatcccagcactgtgggaggccgaggtgggcgtatcacaaagtcaggagttcgagaccatcctggctaacacggtgaaaccccatctctactaaaaatacaaaaaattagtcgggcatggtggcacctgttgtcccagctactcaggaggctgaggcaggagaatggcgtgaacctgggaggcggagcttgcagtgagccgagatcgcgccaccgcactccagcctgggtgacagcgcgagattctgtctcaaaaaaaaaaaaataagtgtgatacttaatgtcataaatcattgttattatttctgagaactgatatcttgtggtccattgttgtggcagaagtataatttatataggaaccgaaaccagccctcgatttttttttttaatcgccgatcttggttgggcttcactatcattttcatcagcttcacaacccctcagttctgagaaccctccttgccatacaagccactggagtgtctgcgtttcctttctgtggacattgtcacctttcccttcattttggtaaggccatggaaacagagcaatcagataaaagacctgggcatttggcactttcattggccatacttctccttctggcttgagtttatatgtggtttggggtagttactggtgaaattgagctttgcagctgtctacttaatctgcatttcctgatctgctttggctggcaatcaaaagctgtatctatttcggagattgcgcaataagacttttaatgacaagttaaaagacaaagggttggtgggattgaaccttatgcagaaaatacttcactatacttcggtggctcctgtttactggtgattttgtgtggatagtaacttaaaatcaagaaacatttttgctaacatatttcctgggccattttagaaagaaatttctttatttagccagtaagtagagctttctttagcgtttacatagttatctttttaatattaatttttgcaatccatatgaatgaggccacatgtcctttaacaattttagacctcttctgttatgcattactgccatctgtcagtatgagagaaagcttcctggggcagaaggacttaaaacaatggttctcaaccctggggtcacattagaatcactggcagagcttttaagaaattttagtgcctgggccagttccagatacatagttgctctgggatggggcccaggcattgatgtttttaaaaaactccctaggtgattctagggtataactgggctgagaggctctcctccgaaagcactgtcttaatggaagaaccagtggcatgagaacagttctgctttttctcagcagtaaccttgttgtcttccattgcagtgctgattttgacaatggagccatgcggttgtatttgggtagcggtttggagggtaacaagtgtgtcttttgtatctctgaatcctctgcagccagtctagtgcctggcatatactagatgctcactatcctccacttcacttcttttggatgactaaataatggaatggagcccagatgtactagcctttttacttaatccctgagcctttctccttcagtggtccgtaagggagcaggtccacaagcatacacttttattgttccaggaggaggaagacgcccagcttcggaatgcttgaggcataaaactgatccttggttaagatcagcagaggcttgctgtgtgcaacataaattgtcaggtaaagaagcaattaacgtagtgccatttatttcctctttaagcatctagtccttatgagtgttgtggttctgcactccaactggaaacaggttctctattgccctgttttgctcttaaacacagacacctttttcagtcaagagaattagggccttttaaaaactcttctttctttcttttcctttttaggtagcccatattgaatcaggtcctgcagctatagttattcatgcagggagaattctatgaacacaggggagaatggcctgggagtttgataatttgttattttttggtttgtagattgagaagtatattaagtaaggataaccccttatagttagttagttattttatagttttcctgtccagaaggttttaatctctcacacggctgtggactggcaaagtaactaattattgtctccagtttatggataaaaaaatttaagatgcggcaaggttaagtgacctgcctaaggtgatagacctgggccttgaatccacagcttttgactgtaaatcccttcagtacactgagctttggatagtacttttgcttggattagaacaccctataaatgtgactaatggcatctcagggttctgtcctggctgtcatagttgaatcctttatttgcattgcatgtgcttgcttgtgtgtgtgcgtgtgcaactattaatattaagcatcttgccatttgcctctgtagagcacagttgatagacgggaatatacacttgatgtagtcaagagagtgtcatcttttattaagaattctgatcttgcctctccaaaatgcctactttcacttttagtctattgtaagtgtgaatatttgtgtgtggtattttattcctaggcaaggtgtttttctcagtctatgttgtgtgtctaggatgataatgttaaagcttaatatatttagttttggaagactacatttttctggggtggtttatgagttgttttccttcctccaacaaattattgagtgtctagtatgtgttctatgctgtctacctttacttccatctcaaggaagtctaggataaaaataacattgtttatctgtgaagggataaagagtcaacacccatttcatgtcagctctgtctttattaggcatttggctattgagctttctaatttcttgacttttgggagtgtttctcccagttaccagacaggtccagggtgggaaatgctttccttgggccccagaactagctcatggagaggtggttgtagcttctgggaattttgaaaagagccacacccaggaatctgcttggactatgtgttctttctgtcctgcctttactctcctcttttctccctcttataagcaaagcgtctttttgcttccttgcccccaatcccagagagactgttaacttatgtttgcatgtaaggagaacagtcagagttaaggatctcaaactcaggaaagtggtttttgtactcaagagctccctgtgtgtttgcgcagcacacttacctccatccaggatgcacttatcctgcgtagatggattgtaaccgtgatagagggggaaaaagaagaggggaaaaaaaaacccctaaaaaaaccctggattctgaagatggctgcagtatattcttcaatagaaatttgaagcatgaagtggattttagaacaccacatgaagctcttcttacttaaaacacaagaacttaaaacttggccaggggaaaggtgtagggaggtggagaaaagcactccttccatttaaggggaagtaagcacttgacttcatcaattgtggttaagataaacaaagcttatctttttggttggcatcagaaggggcatttaaagtctcatgaaatgagagaagggttgttctgttccttatttactgtacttgaacggagtcactgaaaaccttgatgggatgtctctatgactgctcattcctagttgtctgcagcactgtggccagtgaatatgctggttcccacagaggaaggcccacagcatggtttccttcctcttcttttaattttgcctcgtgtcttttgtagacgagagtgctctgcagtaattcttttgtagaaactgccatgcctcaaatcacattacataatacaggctggggaccagcattccgtgaggacttgatcaatgggttgggaaacaaggttgatagcattgctgtggaggagatgtcaatgcgaatttgtcagctcacctcacatccttgcttgcagaactttgattttatttaggtgttcacttccatgtggacttgagttcaggggggtacatcttgattagtctattccagtcattatatttctactccttgtcagtgatgggcttaggaaggtccaggtctggctggctggacatgaggggaaatcttgtgtgggcacttctagaaaacgtttccttgattttgatgaagagaagtataatttctatctggttgttgtctgcatgtggtgctttgaaattggcagttgccatctttgaaccgtgagccagcgtaagaggacaggcccacatgcaggggacagcaaagctgtacaaaagatagatactatctttgatgatattgtggagctgttgaattgatcagcctgagtccattccattttgggacttcttgttatgtgtgagaaagaaaaatcacgttttaactattttggctggattttctgtttccttcagtctagtgtattataactgataactatcttaccccattcatacaggatggtttgagataaaattagaaaatattggaaatgcttttacacaagtatgacacacacaattaacatagacattaacataaatattatattgtaatgtccagtgttctcatactttgcttccatatcacttctgctagcattttctccaaagcaaggggacaggccatgaggatgaaaaacagccatttaaaaactgtcttgggggttttcagtattctttctgtaagaattgacatgatacataactcctaaaacatagtataaggcaaaaattattctttcctgatgaacttgtatttcttcttattggaaagtggcaaataaaataatccagtataggaggcatcatgctacctgacttcaaactatactacaaggctacagtaaccaaaacagcatggtagtggtaccaaaacatacatatagatcaatggaacagaatagagacctcagaaataggaccacacatctaaaaccagctgatcttggacaaacttggccaaaacaagcaatggggaaaggattccctatttaataaatggtgctgggaaaactggctagccataggcagaaaactgaaactgaaccctttccttacactttatataaaaattaactcaagatggattaaagacttaaatataaaaccccaaaccataaaaaaccttgaagaaaacctaggcagtaccattcaggacataggcatggggcaaagattttaccatgaaatccccaaaagcaattgcaacaaaagctaaaatggacaaatgggatctaattaaactaaagagcttctgcacaacaaaagaaactatcatcagagtgaacaggcaaccaacagaatgggagaaatttttgcaatccatctgacaaaggtctaatgtccagaatttacaaggaacttaaacaaatttacaagaaaaaaacaccaccaccaaaaagtgggcagagggtatgaacagacacttctcaaaagaagacatttatgcggccaaaaaacatatgaaaaaaagcccaacatcactgatcattagagaaatgcaaatcaaaaccacaatgagatgtcatctcatgccaagtcagaatggccattattaaaaagtcaagaaacaacagatgctggagaggctgtggcgaaataggaacgcttttacactgttggtgggaatgtaaattagttcaaccattgtggaagacagtgtggcgattcctcaaggatctagaaccagaaatgccatttgacccagcaatctcattactgggtatatacctaaaggatcataaatcattctactataaagacacatgcacacatatgtttattgcaacactattcacgatagcaaagacagggaactaacccagatgcccatcagtgatagactggataaagaaatgtggtacatatacaccatggaatactgtgcagccacaaaaaggaatgagattatgtcctttacagggacatggatgaagctggaagccatcatcctcagcaaactaacacgggaacagaaaaccaaacagcgcatgttctcactcataagtgggagctggataaggagaaagcacagacacaaggagggtaataacacataccaggagcagtgtgggaggaggcaaggggaaggagagcgtcagaacaaatagctaatgcatgcagggcttaaaacctagatgatgggttgataggtgcagcaaaccaccatggcacacgtatacctatgattacataggtatacctgtacattctgcacatgtatcctggaactttaagttaaaaaataagtaaatacataaatacataaaaattcagtatgttttcttgttgtcttatttcaccaatgagctcagatccaactttaatggttaataacactttgtctaaaattcctaatatatcttctaatattttctagttggttttatttattttagttattttaacaacagtgagtgatctgtatcacatcctcctggaagtaccttggatttcattataactgaggaagcgtttgttatttgtttaaatgagtgtcccagatagcttgcaatggagcatatttatttgtttactctcttatccattcactacacatttattgagctcgtactaaaaattagccagacacttaaatcgttttctttggcttgattgtagagctcataaacaaaagtactaggaatttagaattgtagatcacagagcattagaataggggaaagtcatttttcattgttgagcctgaggagagtttcgaaggtgacttgaaggtattgatttgaggaatgccgatggttttcatcttcttttcccatcactaaactaagtatactcccttcagaggtagagagccaggagacctttatagtagtgaaaggacaggaaaggaaggctttcatagacagcctggtactggagtcagtattcaacagtgaaattctggggtatagaaaatagttaatttatatactttaattcccacctgatccccactccccaagaaggttggaatccttgtttttcctccttttggaatttgctactttgaagggtttttttcttttgaaggaataagaacagtctgttcattgtgctatttagtgcaattagaattagggagcaatatttgttctgtgagttatctaccctgacagaagctctgatagaagctcagaatagttaactgccctcatagaggcttggggcatcattgctggaaatgagatgcctaactccaggacttcatcctgtggactgcagaattaaacggaaccaaagaaaataagcaacaaaaaacagttggaacagcttctcagtggacttactgctgccagtcttggtggggaagcaccagtgcttcttggactctggctactttgatcttcccagggtgctggagaacctggaaggacccaggttgtctctcctatgtccactgtaagccttggtaagaagcatgaaccttctgtaagccaggacccaactgaccttttaagatttttttttttttttaatcatctgaacatgctatgccgttgtcttggcattgctttgatcccagatgtctcagttttaaagagcacctacactaagtggcaaggagaaattagaattatccatattgatgatgaaaaataaacctcagagggcttccaattgcaccctaattcttctcccttaggatattgagagagtgaggtgtagaatttaaagttaaaaaattttacatcactttacttaataattgaaagttacttggctttggcccttggcatgatttaaatcacaatggatttgagagatgctttgtcattgacttaattttcagggttttaactcattcagtaagttggcttggcagccctaagcagcattagtattttgtgtgacattttcaaaatatcctttgaacctatggtaatccctaaggcagccatgttctaaaactcagagaaggacctccccaggggcttgaaatacctgtgtttcctcccctcaccgacaaccccctaccctgctccccatagcaatgttttgaggttgtgtgatctggatctgggttgaactcctgcagcgttttaaaccttttgtttctttcttctttaataacaacagtgtttcttaccctggtcatctattgagaagtgtaggtgaaagtaagcatcaacagaatggtgattttgaatatgggaatgggttcttgggagccactgatgtacctatagggactggggatatgattggtagttctagaatgacgttgcagttgctctatacatgacccatcacgtggaagatcctgacctcagcagcacacagcaagcatgtaatagctgcagagaataatgctgagcactagtcaactggtaagcattacagactcccctgcttctctctcccatgggtcaactggtgttgaataacagggagactagtactttggacatttttacctactgaagttgactcatgctgttcctttagaaggctaataaatttttggtgattaactgaataaattaacaacaggctaagagaataattacagacctatttaggaaatctagttcttggttttgcttggagattcttgccagaactttaccttgtaagttagatatttttacctgttgcttctcagaaaaacctacaagcatactcttaggtttataccttctatccctaacaacaacaaaaacattaactgtaaactgcctcctgttatctgagggtaaagtcgtaaaaatcaaagaggaattttgaggagaaagtcttggtaacagaaaatactaattagttgtctgtgttgtgagatgtgttgcttgagagtgtctgagcttcagagaatgtataatttccctccttgatgtccacaaggagcttctaggatactttattaaaagacgagtaatcagttattattcttcgtaggtatatctcaaactgcagctttaaacagaatcaactagagggctttgttacaatacagattgctggactccactcctggtggtatggtaggtctggaaaagggcctgagaattaaaatttttaggtcctccagtgatgtctaggttaccggtccgggaaccacccattaagaatcactgttgtatctggtcctctgcctctttctgcacatcttatatccatgcagcaggtatgaaaatgagctccccaaaagcattcaccttcactgttgacctgattattatataattataattggatctcaaccttttaaaaggccaatcgtatctgaactacatattaattataaatcttagtgaaagctctattatattatctcaatttttttttcttttgagatggagtctcactctgttgcccaggctggaatgcactggtgtgatcttggctcactgcaacctcgtctcctgggttcaagcgattctcatgccttagcctcctgagtagctgggattatagatgtccaccaccacgcccagctaatttttgtacttttattagagtcggggtttcgccatattggccaggctggtttcaaactcctaacctcaggtgatccgcctgccttggcctcccaaagtgctgggattacaggtgtaagccactgcgcccggcaattatcctgatatttgatcctgaaaaatcttgcttgaacttgaaacttgtcctagaatgtctttgaaaagttcatattccgataagtgtattacattctacaacaattatgctaaaaggttacttcacagaaaattatatccacactcatgatagaatcatttggaagtttaaaaaatatggtcatggttggactccatccaagactgattgaatatgaccctctgggattgggcaccaagtaatatacaattttgaaaaatttccaagggattttaatgggcagctaggtcatgaaccactgcgataggccttggagagggaggggagcagcagggctctggtaagtcctttacacttgctttaacctgctgctctttccccttcccactgttaaactcccctgcacctctacgtcactcttctttacaggctggctagcgtcatcacattgtaggtcgttttctgtgggcttaggaaaacagtccaacagactgttaccctagtgcgtgcaatgaaaggcctttattcttagggttcaaattattttacaacgaaattgtttagtttggagcctagccagtttcatctcttctatactccaggttgatcttctgttttagatggtgttcctcactctgccttcttcacctgaataaaggaaaggcaggcaatgtttccagagctcctgagccacccttagtgctggaggcaggtttaggaaagagctggctccctcattgctaaacagaattaatgttgttcaatcactttattctggctctgtgaaataatacacaggaggaattgctgctttatgactttaatctgataaactacctgctctggtgtgttacattctgtgtgtgtttctctgccaccactgcagaataatctcagccttatgtgtagcaactagaatgcaaggttcaaaactcaaaccaagccttgatgcagacgtcaaataagaactactttagaatgctctgtgataatgctaggcacttagcatgactgctggggctcctaaaaggagccaggaagcagcagagcctgagaatcctataacatttccttttgagcttgggcctgaagcagccaaatgctgtaaccaaataaaagccagtttaccttttgcttttcttatgtcttcttttcttgttctcgtcttataaattatgttcacacttttccttttttcttttccattcatgcctttcctccgttttctctgtactccatgcatctgccgcctgtctgcttgcttggtttttcttctgtgttctctcagcttttcacttttggaagagtcaggaatcttgtatattttgagaattagcgaaacatcgtgggtatttatccaaagtggaccttgtacagtctcttttatgctcgtttttaatctcaccaatttctagaatctcactaatttctaggtttgttaagggacaacatggtgtattgctggagatcaagacacaaagagtaacagagcctcagagctcattaatggtggtctgaaacaaggaaaggagaattaaaataatgtccttaacccaggacataagagatacagatagagagatggcaaaatccatggcatatctgtgacggttttctttttttgtagaaaatatcataaatagatcttagaactctgatcttctgatttttcttaacacagtactctagggagaggccactagacaagatgaatcccatcactgttagtgggagcttagagggaattttaggtgagggaaaatacggagataaatgccatcttttgagataggtcttttgattcagtgttgaagatttgtgtcaagagactcccaaaccataatagatattgcaggccttccctttactgcctgttaacccaggcatgtgacaagagcaagatttctagagattgccatagaggaagaataatttcagtgactttgggaaagcctgaagactgatttagggtgaaaggcacatgtcattaaagagtttcattatagattgctggttttattaggaggtaagtggttggagacattcgtttcctggaatcatgtaggacatttaaagtgttgaatgctatatacaacaccccagaggtgaagaagatgtttatcaatttaggtgcacagatgtcagtctgattattgggaagagggtgaagaggtttgacagtatcagagtatggacacatttgagcagcagcagctcattgtcctagaacgaattgcctcctggccgtgatttattgacatagctgatggagggactcagcagaagccaccatttatctgtttcttcagttgaccattggaaagccttacaaaattatgtgcgtgagaaatgtcaaagtgacagatttgggttcaaaagattgtacacttttatacatccaccctttgcccttctttttggacttgagtattttagacaaaactaacattttcttcagcttagtataaacagatttctgctcagattagctgagaaggcatacaccatgttatccttttatggatgagtgatacatgtgatgtctttgtcaaataggaattgccctctgccttgtgtgtttggagagatgactggccacacctctgaagcaatcagctgtggccaaattaacataatatggtacctgtacataaaactaaatatagaacaattttatctttttgtagtaaggatactatattccgaagaattcatgtaagttgaattatttaaagtggatttagggacattcattgtaaagttaatctttggtaaatccttgtgtggtgattttttttctctcctcttttgcatccccatttgaaagcccacaatttaatctatttgggtaaggtagattcttatgtgattaaatcactccagtttatacgcattgaggagtaaagtcaccagactaaactcctcaggaacaatgacagagagttttgccatgggtgtttgggaaaactgcatttactttctgcacacttaaactctgtttcagtccacatatttgcacgcctaaaaaaattaacaaattttcacagtaacaatgatactagcgtttacttattgctcaaaagaggtattgaccgctatagtgtgtgtgaagttggaaactttaggatgatagccatagtttgtacttcgagctcactctagtgggggaaatagacaagaaaacccataattagtacacagtaaatgttaggtatatttctcatgtgaatgtgtgcagtatggtaactgctcgttagaggggaccctatagaattgattacctataagagaccttgactgcgcttgggatagttaaggaaggcttcatgaaatagcgacaaatcagggttagctcctggcctgggatgatggctaaaaggactaaagggcgagtctttgcctcagtttcttatttgaaaatgaggataataataatccaactttatagagattattatgaggattctgtgaaacaaatgcacatagatagttaggcagtcctggtaattgggaagacatcaataatgatgtaagttatccatgtccctagtcctttatttcttacaacaacaatcctttcaagacagtagtactttccctattttgaagatgctcagagaggttaatttgcccaaggttacccagctagaacttggtagggttcagctttgaatctagacgtctctctcctggttaccttttgttctctttatgctactcagggggcccaaaatgattccagctgcttcctgcttcattatccccctaagtgccccactgagaggagtctacaattgcctgcccctcctctccctgcctcctggtcttgccatgagtcactgctgagccatttgtgtcagagaggaaaatgggggcttgctattcacatgtagcaatttgctatgtgttcttgcttatttgccagggacaccagcagagaagcgttcatcaagaggcgtcatgtttgttaagggaccacatggtgtattttaaaagctcttaactctctctggtatcatcgattatgctttagcataagaaataaagtgacactgagcctcttattaataatacacgttttccatttaactttgactggttaaatctggcataaaatgcagacttgcaaaccagcctccctgggatgtgtagcttctcttaggctatttatgatgcggatctctgttgagcagcagcctctgcctgcagctaaggctctggactagatgttctcttttccttttctctcttgatggcatggattgttttgtttcacaaggctcatgttctagatgggattgtagctggtctactacaagctggtctagttgggattgtagattggtatggataaatactgaaatgggagctggtatctgacaactggaggggttatatatgtgcccccatattctgatcaagctttggcattttgtgcatttggcaaaagtcagtggtcaatatttgaagtttgcatgaagttagaagaattttgggctctgaatatgagatgacttagagataatatgtttattttacagataaagaatcaggcctaaagcgattgatgatgatgatgatgatgatagcagaatctctaacaatggttaagccagacactgttcagagtgatttttgtgttaacttgcttgatcttcacaatgactctgtcaggtagacagtattattatccctgttttacaagtgaggaaactgaggcacagagagtttcagtcatttgcccaagccacatagctggcaggtgatagagctggggtttgtacccaggctatctggatccatcaaaacctttgctatctgtgtatcactacactgtagcttgtccagagttacaaagctgggcaggaatagtccaggacccaaatcccagtcttttgttggctgaactatatttgttatttaaagattcttttagcagtggaactcttctttaaatggagatattactagatagcacaaccaaataaaaaaagtggaaacttagctgctgtggtttaagtgggataggccaggcattgaccatgcattccctttattcagcccttgctgtggcttctgagaaagccacatggagcatagttttattttatttattttaatttttagtccctacaacaagactcacagtagggatatgattttaaaccctggctctagttagggatatgagctccagattgctctcttttgggtcacaattaaaatcctaaccggcaacagatatttttggtcagatctggtcattctctctgcctccgtacccattgggggcaaactatgaagcttttgtagctgcattattgtagatttgcaggatttctgttcgtaatcagaatcgggtatgtgttagaaaaaggccttcctgagtgtatgaacccctttgcctgctgacagtctctgggctggagttaacattaacatctgcatgcccagaggacagtgaattgctaacttttcactggctttctttttgcttggacattttacagtgctccagggtcatcattctgggcagtacttaccttgtaagtacctgattttggctcttttctcactcactagtctgtgatctagtcttctctctgtgtctgcagagttcagtcccatttctggagcaaagcagtagctcagtaaatgtcagtggagttttttgaatcactttttattattccagattataggcatatatgtatagatcaagtaggctgaatatgacttaatccccaagtttcttctataataggaccttattttatctctccaagtaatggaataaagggatggaagctggtctagttggggttgtagatttataaacaagacattaatctgaagcttatattcttttagagagttacaagaaaacccaagatctccccccatccccaattaaacactttgttctttgtaaggatagtagagtagtaggagtgggggtattcaggaaagcaggtcttaaggcagaagaatcacatcaacatcccaagttctattcctcactgcctcacgaatggtctgctagccacctgcagttgttgttgttgttgttgtcgtgttttgtaggtaaaggaaatatggcaggagagtgaagtataagaggtccaggagcttggtggaggtggaggagaggggggatggggaaagataaagaggcagataagaaacaggaatcattgtagaccagtggttttcagagtgtggtccctggaccaacagcttcagtgtcagctgggaacttattagaaaggcaaatttgctggtttcactctagacccagtgagtcaggaactctgatgggggtgggcagcgtctttgaaaacctttacttcactaactttttccccctctatcttaaatattcccaattgttttaggttttagttgattcccatattatacttcaattgtgtgtcagtgagtaggtctgtattaaaggagaactgttgaggaaacataaagaaatctctttgtattccaaaaagcgtttctcagagttaaattacatgttttgttagtgtctgttgcttttgttcagattaagctctgaaacaaaattaagattctcgtcaaggcttgagcttattaatagctgtttcatttgtttagcgctaatttaaaatgtctgatatctgtagaggaagtgctttataaaaacacatacttgttaagtgttccactaggagaagcactgtgaagtccaaaggatgtggagattaggcaaataactgtggttttgttgagctctcttcagtgtaatatatgtgtgggtgggataagaacactgggcttcacaggtcgaagaggcttccactggtcagatttcagacaatttgtgcattcaagagaattactgcaactgagtgtaaaacactgaacaaataaaaattcttgaactcatagtgatgagagatggggtgggaggagagaaagagacagacagacactctgggcatcattggaggtgactatgatgtcaacttctcattctataaattgtaaattacatgaaacaaacaccctgtctttactgagaaactgtagttctttcatgattggtaagagaaacctctgctttacaaatggatgctaccaaataaaatatagaaggatacagaatatcagcatttgcatcctgcagtgaaaatttgaacaggcaagtgccgtcaatgcaaaactagttgaaagcatgttggggaacagaataatcttattagagaataacccacaaattaccagcaaaggggaaagtatacccttaacaatggcggtcaccaccttaacaaagtggttcaacttagcatcacagtggtaggatagcctgacagtaggagcttcctgatgtgacgaactacacagcatcaccaacaatttatgccaaaaatgtttaacctgaatctaaccaggtgtattaggctgttcttgcatggctatagagaaatgactgacactgagtaatttataaggaaaagaagtttaattggctcatggttttgcaggctttgcaggaagcatggtgctggcatctgctcagcttctagaaggaggagaggggttggcacatcacatgacgaaagcaggagcaagcaagagagagtgtgggggaggtgccacatacttttaaatgaccagatctttcaagaactcactatcacaaagacagcaccaagccatgaaggatccactctcatgatccaaacacctcccaccaccagcattggggattacaattcaacatcaggtttgggcagggacagatatccaaactataacacaaggtttacagaaaatagaagggtttgaaaaacaaattaatccacaccaggaagaaacagaccaaaaatgtgggtcattctcaagaaaactggtatgtctgatcttttcaaaaagccagtgtcgtgaaacaaattgctggtgggtattactccggattacaagagactaagggaacataacagtcaaattcagtgtacaaatcttgatgggatctggcttaaaaattataactgctgtaaaagatgtttgaggcagttgtagaaatttgaatatggactggctatcagataacattaggaacttaatgtcttaggtgtgatagtattttggttgtgttaggaaaatatctttattcttaggagttgcttattaagtatttcatgaaagtatcatatctgcaattcactttcacatggttccatgagagagacgagtgcatagataaggtgattttggcaaagttttaacaattttgaatctaaatagtaggcatatgggtgtttgttttatatttatatttatattcagcatagagaaagctgtgaattcaggaaaagtttatatgtaatttctgagatttctagctcatgcatgcatttctgtttgagaatgccttatctagaattttttatcaagaaatctgaatggtgtttaagaatatcttatctagaaatatgttggcatcttaatattatggtttggtagataaaatggatttttttaaaaaaagacttgcaaagaagtggatgaaatgctaatataagaaaattagattttataaggaacatgtgaccagataaacttgtcctaattattgtgagtctctttaaagcacataccttaggacattgtgtgttgacgcttttactgttcataacatattctttaagaattctctcagagccttaagatgatttgtttttgagaaacatctgaagtctcctgtagcttattctgatgttatgaagtaagtgactaaattttgatcacagaagtgtgtgacagggaagtagtgggatattctttgcccctctttgtgtcctgtgatgctggtggaaatttcaaaggaagagtttcaaaagtagtttactttgttcaaactctctagccctaaaccatcagtgacaccagtgagtgtttcttattttacctatttgggtgtgttagatgtattttcactgggactattcttttggtcagagagcctaaagttaagtgtttgagcttctggtcctgtgatctcagcaactggacttgattcaggtgctttgactcaagggcacagtggtagcatcaccaaaaatagatgaatggcagcagatccctaatggctggctctctgctggttgcccgtctcagctcaggacttccgagaggtataaaacctcactgatagccaggcataatggctagggtttactcagagatgctgggggcttgagtgtagtattgctctgttgtaggctgataatggagtatgtgccaggtgggggcaggatggtatccaggcagtgtgggcaaagggctgcagttagtcccttgttacactcagtgacaggtgactctgagctgtctggaagtaagataaagtgattcaaggataggatccatacctgaaagagaggtattcagaatagcatttgaagtcaggtagacttcagctcttccaatggacctgcaagaggtggtcaggaaatatctcatagatgaattaaagaagtgttacatgaaaatgtaaaggggcaaaccaaataaaatgggttcattaggtcccaggactagtggaggggcattcatgttggaatggagagtagtgagaattggggaggggttgcataggggcttgttcttagggcagagtttttcaacaacaggtatatataagaggtcaaaatttaggaagtctgttagagaagattataaactccatgaggacaggagacatgtctgcattgttcaacactggatacttgatataatgcctggaaaatagtagatgtgcagtataaatttccgttgaatgagtaaaaatgttaagtggcgaataaaggaatgcatggggatgatacagacaaagcagtaatctgtggtggttgatggctgacctggttgtagagtaccagggggaatgtgaatattttagatttcctcagaggctagtttctgagatgttttgtttaccagtgtggtaaccttctcatggccctagctcaaatggtaatcaactagtctttgcagcacaactgtgaggtaaacatgctgtgtccattttagagaagaggaaactgagattcagagagatgaaggaatttgcatgaaggtccacaactaagaagataagatgtgaaactagatatttcagctcttgaatacaatcttctttttacttgagcgctcaatgctggggacagttctgcttttcaagtggcctgataaatagtatctttgtatcatgtgagagttattaagactgtgatagaaataaataaggaaaaattcacataccagccaatcctcgttactctgcttattcccctattcatcatttggctgattgaatactgaagatgataaagctgaatcggtagagcaatgtgtgattaaaaaaaaatctgctattccacttaatgggctacagttattagaaagaaatagaaaccccagttaatgttagtatgggctacttatttaggaaaggagatttttaaatgaaataagcctttcctttttattatattgctggagacagttttcatttttgcccacctggtacttaaatggttattgctataaggaaaccagtcttactgataaccgaatgaaataaattaaacagacacatgcaaacaaatccaaaatgtgcctgagaaagatgtggtcttctagctttcagtcattcagtgagacatttggcagagatgggtgcagcagataaaactgtcatggttttcagaagtcattccaagacaccagagaggaaacatgacagacactggaaagagaccctctttcagatatgagtaatatatattttatactcatattaatatttcattggagagaaggtcaaaatctacatttaaatggaaatatttaaaaagcagaagcataatatttgactaagtgaaacactcagggtttttcaagaacacaagctgcacccctgggacctcagctctctagatctgttgtttcttagagcacggtagaatgtttgaattcctttagttttatcggtagatcttagccctggcatttaggaatcttaatccctctactccccttccatttgaccccgaattgtgttacatactacctaacagtgtgttcagtgcacagtatggcctctctcagtcctataaaattatttaaatttctaaaaattcatttttctggtcctgtgaaatggacataataggattgtggagatggacataaataagatgctttcaattatgagtaatggaaaacccatctaacaaagtatggtggcaagaagatgggaataggaggcccagggtttattcagaggctgtgttcatccttcgtttccctctgctattcaaagtgtgttagaattcaccttcaggcttctgacctcatgattataagatggctgccattgtttcagaataatttcttcatggcatctaaaacaagaagatgggatgccaggagcaaaagaatcttcctggtacctttttcctcctttttatcagagaagatgatttttcctcaaagcctacagaagacttgcctttatgtctcattgaccagacttgggtcacattaccactccgttatccctgccctcaaactggcaaagagaatcaagaagaccttgattggcgtagatcactcatgcttgatttcctgaggctcgtctcattgcctctctcagaaacttggggctctatttttattagctaagaagggcaatggttattgtctgccacagtgatgctcttgtgtgaagtaaaggtgcataaaatgcatgtcttccctggactttagtgcatccttggtttgtaagtgactacgattacatgaatcagaaataaatcaggaaaaggaaagttggtaattttggcctattcctgcagaaatcatagcagggaggggagtgtttgtgaacgaagggagggtccagttctctaaagctgtgctggtgaactaccactgcatagggtggccctctgctgaccctagagcaagctggaggtgagacgagtttgtcaggacatcccagattctttcttctgtactctttcctcttctctgttttccaccaatccaatcaaaggcagtgctgatgtagtcagcacaactcctgggatgcaggtgcctggggctgcaattctgttctgacactgactgtggacattctggttctgggcagccacttgaggtaacaataatgatacacagttcctgcttttaagaggttcatgatgaggagcttcactgctcccctgttgctttatgacaggatgaggattcagactaaatgaccacttccctcttttctcactctcaagttttatgatttctttcaagtttatttgggattttttttttttggtctgtgccttttgttaatatattctacatgcattttgcttctaggcatattgatattcacaaagtttaccactgacagttgtagtctgagagtgtacagaaaaaaacgtagttgaccactctatgattattctggactctgtgactctcttaatgcaagccaagaccacattagcctttttggcagtcttattactttgtggcttttgttgggtttgcagtcatccagaatttctaagaacaatatttggaaggtggctttgcagagacttgagccactgaacttctcttgtcatgtgcttcctttacttcactcctttctttaatatatgcctggcattgggcccagaatccataatacgatattcataataaataccaacatcttttgagcactccctatgtgtcgggtgttacactaagtgctttacaggtattgtttcatttaatccccacagcaactttcttcccctttttctggagacagagtctccctctgtcgcccaggctggagtgcagtggcacaatcttggctcactacaatctccacctcttgggttcaagtaattctcatgcctcagccttctgagtagctgggattacaggtgtgtgccaccatgtccagctaatttttgtgtttttagtagagacagggtttcaccatgttggccaggctggtctcaaactcctggcctcaagtgatccgcctgccttggcctccaaagtgctgggattacaggcatgagccaccacacccggcccccacatcagctttctaatctaggtgttaataattcccattttacagatgagaaaacaatatggagcaagctaagtcatttgagcaaagttatatagtagcaggtggttgaggcaggactagaatctaggcaatctagtagcacagcccaggctcttaaccttgaaatgcaccttaaggcattttataaatttgtcttactttccttaatttttcccctctcccctaccccccagtacatgcataattgctttaaatattattacttgtcctgtctttcaagctggcttaatagaacatacgacgtagagatcaaaagttacagagtactaaagccgtagaataagagtttctttattcattaattcatcctttaattcctgattgactcagttcctgaggtattacactgagcgtgtggatagagagaggaaaaagacctagcattctgcctttgaggagttcacaaagtcatatggtaaatggtgggcctgagattcttgtcccgcagcaaattctgtcattctttgtagatcatggggaaaactttgcattttgctctaagtgtgctgagttcagagtgtaacatctactttgctccgccatagcctttaaaacaggattcatctctgagcctcagcaccagtacatctctgggaatctacctggccttcttcattatgtcctgcttccctgacctacatttttttcctttttcagattgatttgttgttcaaaaggccggtgcccctggaatgaggacctacaagcttacttttatactagaaaataaaagactagaagaatcaagcctttgctcagatcatactttgtgaggtgggcaagagtagaaagccgaacacttgaacgtgagagcgaggagggagccacagatgaaggttgaggacagagaaagggaagctggagggctctaaacttgcagaggcctgacctggcacttcatctgtcgcctctgaaaacagctctgctcttgctcttgctctattctcatccaagtactaggcgatcctccttttatcacttcccagtttcttcctttagtttcctctaaggtcattcctcctttgcactggatttactttggagtaacagttgttggtgggaggttctgattctgcagagagagaaactgaggcatgggatagagaacagccatctgtactttgtcctgtaagtcattagagactggcagagccttgtcatagatcccgtggtttgctgtaagccacaggtggccctcataccctcataggaatagggaccttcttccttccttaacatgattggattttgtttttacctgaaaatacgagctacttctaacagaaggaaagacgattgcagcctgtactgcattgcccctatctgtaaccccattaagaggttgtaaatagtactataatgatatctcagtcatttgttttgatgtatccaggcttttaataaatcagccgcagcttgcttaataggaatatgagagcagagcacgttgctgccagcagctgctagtaaattataaagcattcatctgttttacaagggaattaaatgtttgttctctttaaagggttttgactaaacaagggtgtgtgcgtgtgtgtttgtgtgtgtgtgcacacacacagtggcttcctgcccatgccctcccaggtacagtagcaacctcaggttcctggggaacacctgtaaccaaagccatatgaattagagtgcccccaggtaaaccctgtcattattggtctctgctctgcgtgcatctctaaagcaatatttgttggattacatttgtcttccacgtcaaaggattctgtgaaatacaagtcccatttcccgctttctcctttttttcttaagactgtctagggaaggagctttagataaactatacatccagcacaacattcaattgtctgcacaattgagttagcctactttatttgacttttatgtttacatttgaagtggactccccccgccccccgccaccaccttttcgacacccttggttttattgactaaataatcttcagaagacaagacatcagagttggtgcttttggtggaaattaaaccacagcaggtgtttcaagaccagctttggcaacactgcaagaccctgattctacaaaaataaaaaaaattagccagttgtggtggcgtgcgcctgtagtcccagctactggggaagctgaggcaagagcatcccctgagttcaggagtttgaggctgcagtgagctatgatcatatgactgcaccccagcctgggtgaaagagcaagattgtccaaaacaaaacaacaagacgtggggtccagctaaccaatattcaagagctgttggctacttatcttgtgaccttcaacaagttatataggtttttaaaatctattactttattttttgttacttttaaatttggaaataattgcagatttataggaggttgccaaaataatatagagagatccagggtgaccttcacctagtacaatatatgtgtatagctctatgtcgttctttgacatgtgtacattatgtaaccatcactgcagtaaaagcacagaactgtttcatcatcacgaagatctccctattgcttcctttttataacaacttctaccaccttccctatcctcccctccactgtcttacctcctggcaagtactaatctgccttccatctttataaattttattcatttaaaaattatataaatgttattacacatttgtatttatataaaatataaaatatatcacataaatatgaaaatatgaaatatatacattaaatcatacagtacatggctttttgaggttgactttttaaactcactgtaatgctatccatcaaccttgttgcttgcttttatgaatgtttattctttattactacctagtagtattccatggtgtggacacatcagagtttgtttaatcattcgcttattgaggaacattttgattctttttacttttgggctattataaataaagctgctaggaacaattatttacaggtgttttgtgtggaagtaaattttcatttctgtgggataaacactcaggattgtaattgctgagttttatagtgtttggtttttaagaaatgtcagacttggctgggcgcggtggctcacacctgtaatcccagcactttgggaggccgaggcgggtggatcacctgaggtcaggagattgagaccagcctggccaacatggtgaaaccccatctctactaaaaatacaaaaataaattagccgggcgtagtggcatgcgcctgtagtcccagctactcgggaggctgaggaaggagaatagcttgaacccaggaggcagaggttgcagtgagctgagattgcaccagtgtactccagtgcaacagggtgacactctgtctcaaaaaaacaaaaacaaaaacaaaaacaaaaaaacccggaggttgcagtgagcccggatcatgctactgcactccagcctgggcaacagagcgaaactctgtctcaaaaaaaaaaaaaaaaaaaaaaaaaaaaaaaaaaaaagtcagacttttccagagtgactgtaccattgtacattcccagcagcagtgtatgagggaatcagcatccttgccaggatttggaattgttgctgttttttaatatggctgttctgataggtgtgtaatgatatctcattgtgattaatttggatttccctaatggttagtgatggcagacatttttatgtgcttatttgccatttgtatgtcctctttgatgaaatgtctgttcatgtcttttgcccattcttttggattatttgacttttactgttaagttttgaaatgttctttatgtattctagatatcagtatcttgtctgatgtatggtttgcaaatattttctcagtctggagcttggcttttcattattataacaggatgctttgcagagcaaaggtttttaattttggtgaggtcaaatttatcagcattttattttatggagtatgcttttgatgtcatgtctaagaaactcttcaccaaacccataggtcctgaagattggctcctatgtcttcatcagaagcttaagctttacattttacatttaaatgtatgacccattttaaattaagttttgtgtaagtatgaggtttaggttgaggcttatttattttttgcctatgaataatctaattgcttcaacactgtttaaaaggcatttcttctaacattgaattgcttttggatcgttgtcaaatatcagttggccatagttttgtgggactgtttctaggttctctattctgtccgttgatctgcgtgtctgtcccttcgccagtcccttactgtattgattacagtataactatttagtaagttttgaaatcatatagagtgattcctcttactgtattcttttttgttaatagtttcaggtattctagtttctttccatgtaaatttttagaacaatcttgaacgtatttacaaaaattttgcagggattttgataggaattatgatgaatacttttatttttatgttttgtagagacagtgtctcgccatgttgctcaggctggtcttaaacacctggacacaagcaatccccccaccttcgcctcccaaagtgccaggattacaggcgtaagccactgcgcctggcccatatgtgaaatctgcatatcaattttgggagatttgatatctttgctatactgaactttcccatccatgaacactatatgcctttccttttatttagatcatctttgatttctttccatcagcaatttgtagtttttagcatacaggtcctatacatcttttgttagatttgcatctaaatatttcatttttctgagacattatacataacattgtaattttgattttgcttttcctgtgttcattgttagtatattgaaatacaatttgtttttgcatgttggtcttcaactttgcagagttgacttctaggagtttttatttagattttttgggatttttgtaagcatatcatctatacgagcatgtcatctataaacagggacagttttattatttactttctgatataccttttccttttattgccttattatgctggttggagcttcagtactatgctgaatagtggtagtgagagtggacatgcttgtcttgttccaaatctgaagtgaacaagcattaggtctttccctactaaatttgatgttagttgtaggtttttgggtagttgttctttgaagctgaggaaattcctttctattcttggtttttataaatatgtattgaatgcttttttgcatcaactatgatggattatgttgattggtttttgaatattgaaccagctttgcatccctggaataaatcccatttggtcaggatgtataattctttttatatattgctaaattttgtttactaatattttgttaaggacttttgtgtttataagaggtagtatgtgattttttttttctttgctggtatttttagggtaatagtagcttcataaaaattggaaagtgtctgctttccctgttttcttttcttttttttcgagacagaatctcactctggagtgagattcagattcagattcctaggctggagtgcagcggctcaatctctgctcactgcaacctccgcctcctgggctcaagcgattctcctgcctcagcctcctgagtagctgggattacaggtgcctgccaccatgcccggctaatttttgtatttttagtagagacagggtttcaccatgttggccaggctggtcttgaactcctgacctcagatgatccatccatctcagcctcccaaagtgctgggattataggtgtgagccaccgtgcccggcccctgcttttctaatgttatcatttattgctaaaagtttaccgttagtactgcttgtgtcccctaaacttggtatgttgtaatttcattttcattcagttcaggtcattgtttaagttattttgaggcttcctgtttgacccatagattatttgccagtgtgttttttagttcccaagtttttttagattttcctgttatctttctgttatttatgtctgcttttctttcattgtggtcagagaatacactgtatatgatttcagttcttttaaatttgctaaggtttgtattatatcccaggatatggtctatgttatttgttctgaggtcatttaaaaaaaaatgtggcttatgctttgttaagtgtagtgtgctataaatgtcagttagatcctagcctgttgatggcattgttgaaatcttttacatttgctgattttctgtctagttgctctatcaattaattgttgataaaggggcattttagtctccaactaccttttgtctatttctcttttcagttctgtcagtgtttgcttcacactttacaactccatttttttgccacaaatacatttgggattactatatttgcttgattgattgacttacatatcatttttaatgtccctctctgtttctactaattttctatgttctgaagtctacttattttattcatgtaggtactcctgttttcttttgactgttttcattgtatatatttttcatatttttactttttacatatatttatcattatacttgaagtgagtttatggatagcatatagttcatgcttttttattcattcaaccaatctgtattttaattggtatatttagtcactgtacctttaatgaaattattggtgtgttagaagacccaggcagctcatcactttgaagttccttgcatcctaaggtccctagcagttctgcctgttctctctaccttcaagaatcttttaatgttcatgttatatatataacacccaggaattgttttactgtacttagcagaaatgataggaaaagtacatctgttccatctttctggaactgcttctttacttttaaaattaaaaaaaattattgatacacctataccacaatattgctgtaagtgagatgaaagtgaaaaaggattcaacatttaaattctatttggacatcagttattatatctaagtgatatatgaaatcatgttgctctagaacaatattaacagattttatgaggttcccttataggaatgaaaatttatacgtgtactctttctttctctttgacaccactctacccttttctccttctctaacatattccattaagaaattttactcaaacttatgctttgcagttggaataccctaataccgattataagtcctgaatcatttattaagtaccttgtaattgcccagcactgtgctaccaatgcctttcagtgactttctaaattcaccctgttaggtataattatcttactgtgtagctgaggaaacagaggcttagagaagtcaagtgatttgctaaggtcacttagctagggagtgttaaaactgggacttgaatacaggtcttagagtttaaagttcatgctcttaacctttatgttttacttcctccctgtattctcttgtacttcatcaacctgaattctttagagctttttgatctgttgggacctagtttgaattcttaagcattttattatttttatttgcttcaatgaaaggtaaaagatataacctagattttatccattgctagtttcttttagtgccatagtggttttatctgtcagcgtgtctgtgtgtttcttaatgttcctagcaaaatttaagatgtgatctagtaactgtattcttccaattgattcatctttagtgtcactttaattttatttttgaaaaattaacgttatcttctcatttctctgttggagtgtgattgagtgattaattcagcaattatttatagagcctactgtgtgataattattgtgcgagatgctggggatattcagtaattatgtgtttctttgttcttgtaattgttctgtgactttagttacatctttcttcagaatctttcaattcacaagtcatctgtaagatttcactcattttctatttctagagtgtagtccagaaaccatatgtgtttgtgggagtttggtttaattttggggaagatattgatacttctaaagttaggtacaccatggtctactgtttacttttcaatgcaaatagagactttattgatgaatgctttccttctcaagtacatgttttgagattggtgaaaatctacagaaaacaaataattttaccccttacgctgaatgctgggaaaagaaagggtcttgtctataaattaagagcattacctatgagcttcacaatgtacgtgatggacctagtctgtgtaaaatgaagattctagaagcagaagaaaatggcttcaaaagcaaatcagaggttatagttcatggacaagctaagtactaaaccaatcttattgttgtgaaattaacattttctgttttatctctgtggtatcacggaattttattattggacaggctaatagagatctgtttgagcagcctattcattttatagacaagaaacctgacacctgtagaggtaaaatgacttttaaggccttttgtgatttagcctccaaacttgaagacctgggcccttgttactgtatcctctggactgcattttagtaatattttatcatttcattatagtctcatacttacccaatattcttcctttacagggtttcagttttctcaactcaagagagtagataaggcacttaatgtagttcatttctagttggagtctgtaaaggtttatgaattgctttgttaatccacgtcactttgtatcttagctttctagactttaaatgttggttgtagtccgtataactgccagacttaacttataatgaatgccttcaggtaggtagatatttgtttgtgtgtgttccgtaaagaacaaacaaggggctaagaattatcaactcttgctgtgagggccccttagccaggcttccaccctctgcctcttcagtcttagggacttgtcaaccaacttctgcttcagggcctcagggatggtgggtggtggggaccttaggttggctaattttaccatggcatgacttccatttttaagagttattttcttggattgagacacagttagcttgcctgtggcttccccgcagtgattcttctgagtggatggaataaatcaagtttctctgtgtttcctgactaaatattgcaggttgtttgtgccattcctcactttttggattttagataattcactattctacatgcttcattttttttatgtttcctcaggtgagccccaacttttaactgagtactttagaaataggctgagtcccaaggggtcagtggaactttcttgttccacctagcataggcctgaaacagaggctcagtcttgggactccttccttcagcctggaaggaagaagtgagggagaaaggaagaaagtgatcaccaaggcaggcctggtgcctagaagctgagctttgagaagcatactttagtaacgcattttctgtgtcctctcctcagttaactcgtctcttgaatctttattattaaaaattaacacctgaactggtaatctcagttcctgcggtccctctctgtatttcaactttacatcagccactttttttagtattataaacaggagatcttttagacccctaggcttccagttttgattggccgtcaccttctagctccctcatctcattacagactaagctggatgcattaactagttgcatagtcttggacaagtcacttaagtattctcagccttagtttcctcagttgtgcagtgggtctcctcacacctactcacttaagaaataaatgaaataatgtgtgtgagagagttttctgaacaagaaaatattagctaaatatcatctttccttgttgtacccttgtttctacaggacacagttggatcagcggattcagtgcttttcctgggatctcttacaggttccctccatgcttgttgcccttgactgatggtatattggaacatttgtacacagtggccttgaactatagtgggcacttgaaatggcaacattttgtattcttctaggaactactgtttttctttgaaaagccaggaatttcacggctccagaggaggggatgcagaagctatttctttttattttcccctgttaaatcagtataatgagattctatgtgcatagtaatccttaagctctttgcctagttccttttgccctaggcaccttggagtgatggaattgtagtcagtcagacatgtgcagtgtattcacacatacacttagagggctcctcgtctgctccccctagctaagcagcccctttgaaatgtctaataaaatccctgctcttgtgcgctgcattgaaacaaagcaggctcacgcagtcctggaaatgagccctgagaggtattatttctatatgtcggtctttatttgcctgttttgacagtgtcgtacaatgagggtcctgctgctgatgcagcagaatcacaaggagccgtctttgctgtgtaaattctccctcaaaggtctggcattcgacctgcctgctaaaccctctttgaaacaatgcaatgacaaaatattttcttcttactgataataggcagattataattgctataattgcttctacctcattctctgaagggaggaaagtagggctatggaatgagtgcttaaaatttttatttatcgtcttagagatatagatggttcatttattatacagaagtttacatagcagcctctaagtgtacgttgtttctcaatagttggaattaaattcgtacttttggactactgtttattaagacattcccgggaggctgaggcaggagaatggtgtgaacctgggaggcggaggttgcagtgagctgggtttgtgccactgcactccagactgggtgacagagtgagactccgtctcaaaaaaaaaaaaaagacattcctccttggtgatgaataacacctgtgtgccaaaaggatttttctcattggctctgattaaggggatatccagccaataaccgtagcaagccttagggtgaatttttggcaatctccaggtctagtcattgccttatgggcagtctgatggcaccttgggcattgtcttattgccctgagcacaggtgttaggggcatggagtctgatgagccgtgctctgctgtctacccccagtctgttctccagaccccctaaccaaacttctcatagaggtgaccatcacaaggacctggtgtgtggctagatcagtgacaatttatgaccacttctggggaaatagctcagagtgcacgtccttcgtgtggtaggtccaaaatattatctttgtatgttcaaagtagcataagctttagttgctgctgttggtttcaggagaatcacctggatgtcagtgccttggggttattaataatggtaaaaaaccagtatgagggtggagcttagaagtagaccaagacttgtgagtcatgcactgctttttaatttgcaagctaaataggtgctaaaactcacctaccctggctgctgagatagtcactttctcctggtcctcctctattgtaaagagaagaggttggacttaatgcccttcaaggtcttttctctctgactttctgtgaaactccaaggtgagtcctaaattttgttttggtctataaatttaaatgcttcccctgctgagctgctttgggctgagaatagaatggatggaatttacaccttctctctctctctgtcccatgtgatgctttgattggctgctaacagaagggaaggtggtcagaaggcaaggaagccttggcaaagaggaagaggagtgaaagtactaaagaataggaacaactgggggtcagccctggaataaaaaagacttcacagggcagttactaggcttgcctcactctttggaatcatgagaggtttgctaggtatgtactgtaaggcccgtgtggccagagactgagtcttggatttactctttttgccctgacattgccttgtgtagcactggatatcatgtaggtactaattatttcttctttacttaacttcctggaaaccgctgcaattgtcaagtgaatagaagtgaataggactgttatattaaacattatagagaagggtccatgctcacagcatcttcatcattccaaatattgtgcttgttgaagcagagaaccttgtcaggacagtcattgtaccaacatttacgaaatgaaagcaagagctattaaccactgtataagatttgaggatattgtgctttcaaaggaagcaaagagggtttaaaattactccagtgggatatctctttagcctcacttaaggattgtttaaaaggaaatagaaataaagattgtttcaaaagaaaaagaaataaagttagaggtgaatagatggtatatgtaagagctttatgttttggtcatactaagtttattgttaagttacaacaaaaaaattgttaactatcatgtctccagttttgcaggataattttcttttaatgtattccaaaaactgacctcagaatttgatgaagtgttagacaagatgacaaacagagagactgttagtaacgggcagaagtcattagtctcagactcatattcatttgtttgtggttattgattctagtcactcctattcttatctccatccaaaaataggcattaaaccctaatctcttgtggatgtttgctttgtagatttaggagaataagaacatgtgaccatacctggttagccatctcaagatttgttatgagctagttgacttcaagagccagtgagctgggttgtgcaggatacttgttactggataattctacttcagatagatgctctagttgctctgctaaaatcctctgttctgtcaagcctgtcagagccagagtgaaaaaacaaaacaaacaaaaacaacaacaacaaaaccctagtagagtacctgaactctaaattacagagtttaaggactgaaaatgaccttgaggatccagagtaggactctcaaactcacatgttcctggggtagacaggtagcagagtgaatgaattggacaactataagcaatgggggagactgaagagacattcaaatttagaaaattttaaggacattatacctgcctgacaaagaggtgtttttttttgttgttgttgttttttgttttattttctgtctctgatgcttgaatcaggaggacaaagagctctgatgctgattcagctgcaattttgaggacccttgaccctaactatcaggttatctatttctggtttaaggatgatgacctgagttacaggtaggaaaaggcatttaaccaaggagagacagctagtgagggctggagcctggggctctgaggtgtagtctgaggttctttctctacaccatggtgatatctgaaggggaaggcaggaacacctggatttcaatcagggatttaaaaaaaactttctatttttttagagaggtataattaacatacaatcaaatgtactcatcttaagggataacttgatatattcttatgtgtgtgtcctttcatgtcaccaccacccagatcatcccaagattctccttgtgctcttttccaacatcccccacacccctgcaccggaatcacaatttaccagggaaccatggcacttttccttccacttgcagagctggtccgtctgtcactggcccagttcctcccctcacctccctctcctcagattcaattgtaaagagctatagcaaacacaagggcacatgttgcttaatttttttttcccacataacccaacagaatcttgggtttctttaaagtaagctctctaattatgccaatgccattgactcaccaagtaggatgccaggtcccacagggtgtgtccttcacagggttctgagggtactgcttcttgcaatgtcaactgctttatacaaaagcatatttaaggtcacatgatatttgccaagttattaattattcggaggctacttttcctctgaaagaacttcagatgtccgatgtcatgattttattaaatcaaagacccatatttcattgtaatggacatggcactcaaaacctgggaatcgactcattgaaaatgtagccaacacaacactgaaaacaaagcccacctcacaggcaatgcagcttccttaaaaaaaatagctgattcccaggctgaagctgttaagcagatttttatgcagggcttcaagttactaaaaaagcaggattcaatatgcctttctctttgatttgtaggagggggtgggaagtaatgctgctgctctccccttacccccttcagaagggcttttaccatattctgaaagcaatgcttgaaggacccataaatggattttggctgtctcctagtgcagggattaacatagaattatagaagtgtgctgcatggtggttgggaaaatagggaggatgccattctctttttggagggacatggtgctcccgtctcttgcctgtggatgttccctataaagcagcctgtcactgtgaaaaatgcacacactgtaccatctcacagttataaaggttaagtaagcatcttgagcagtgccccactgcttttgtactttccataatgtcagccgataaaggattattgaaaaaggcttgcaaggagataaaaggcttgcaggttgaggttaaacaattgaaattttctgttcccagtgtagtaaattaccaatggcagatttaacgtttgttaattattagagcaaagtactaaggattgttttcttttgcctaattaattacctcatctggagtggaatgttaattcagataaatgattatttcttaatacctctgaagctttccttggaatctcctagaattgccagtcctgaagtgtggtttcctcacattctggggaagataggggataggtgaccaacgtgactactctcttggcctttttcccgtctcagaagatggcaggataacttgtttagacttttggtgatggagttggtttgctgttctagttagtagaacatgagtgtgcttcctggaatcctgtgcctcataaccaagtttttgagttagtctctcgtgtggttttgaatttaacattgaacattctttttacctttggtaattctcaatttggggcacctgccgtgaacattaaagatggtatcctttggaaaggacactctagtttcttaacttgctttttacctttaagttattttacctcctgatgtctgttcagaatgctagaggcaggtttttattctttcttggatctaaactatatcacctctaatagttgtgaatagataatattcaaaaaaggtaaaatcatgactcatgcagatataaaatatccacatgtcaaaaattttacttattttaaatgagggaaccagatagatgttacaacaggtaccaaggagaaatgaaagaaccacaaatttatatggaataaaggaaatgaaaacgaacccacaaatgaacacaaaacttttgggggagggttgttcctctaggggacagaatgtatttgcatagctatagacacttttcagagttgtaaaatcgcccagtcagacacaaaggtaagtgtccctgtaggatgagaccattttctgaaaggagggccattaatctcttttgcttttttttagggtcagaaacttccccttagacagttgtgtatgaggttttaatccagttacttaggatgacattgtatcttcaaagtagattagagatgaattatgtgacttatttttctttttagaaggaagcttaaaggtgacttggggagatgggctggtagatctgggccattggaggcgagctacaacccatgtgaccagttaccctgcacagtctctactcctgataaggcacttattttatgagcacttttcataatgatatgaaaaggcagcgggattctgtctaagattatctggagtgaaagctggaggctgatattaaatggatagtcctgttttcttttggtgctgccaagctgagctgtttaaaatgatgcttggaaaaatgcctcctgagccaggaagttgtctgattagtgaagagatttccgagacgtttggctcagagactaccccatcataccacacatgttcttttccacattcacctgagtcttccaaagatacgaggactcggggtggtgatagggtgtacattcttacatacacatatgtgtatatttgtatatacagtctgtctatccatgggttctgtattagttgattcagctaaccatgcatggaaagtatttgaagaagaaaaaaaggatgtttgattctgtactgaacatgtacagacttttgtccttctcattattccctaaacaatatagtataacaaccatttacataccatttaaattatattaggtattatgtaagtaatgtacagatgatttaaaacatatgggaggatgtgagtaggttatatgcaaattttacaaagggacttgagcattcgtggattttaggatcttgggggatgctggaaccaatcccccacagatacagcgggacaactgtattcatataaatatataggccagagattggctttaggggagtctgcaaagttccataattatatgcatttttcttaggcagtattgtgtctgtcagattctcatagtctccaaaagttttatgattcttcaaaagtttaagaactgcttacagaaaccatgcccccagtaattattctgaatctatgtgttaccacgtgtatgacttagaagaagtctagatgaaggttccacctaattacagaatccactgctgtagccacagctggattgagttatgtggcagccctgccccagagctggggaggctgcgtgtgtgcccctccacacctgagtacatcctgggtgtgctgaaatgaagcccagggagatacaaagcaccataatgccattaaggccagcacccgttgggtaggggagaggctgaccatacagacttctgacttctgcgtttcattccctgctctgaaacctgtccgtctctcaggcttgcaatctgccttcctgtctctctgacagacctgtgacttgggctatggttctgataccaggaaataatgcaggggtgggagtcttagtcccaagcaaaataaatcactgctcccattagacattacaatgtttaaacccaagtacatctgtctgccttcaaaaccaagatttagagcatgtcaagcaggtgccatgcctccaataacacatactttgttccaacatttagtagattactgtgagattttaaattcaaattctcagacattcactttgtttaggaaataactgcaataaagcaaattgtctcctgttctttttttccccctacggtgcagccaagtgagagcaaatcaattcctagtcaattttttgttgctgttttcctccatgctagagaagagatgatgcagctctctcctgttgcagccctgtgctgggtgtggttccctctccttaatttgtcatctgaaagcaattttgttcaattagagattagaattaaatttcagttgtagggcttctgtgcagaggaaatgatgcattaatgaacacacagatgtcatcttgcagccatgatgcttgcagaacagtttcttcaggattcaaataataaaaggggccacagcagcaggagcattgtttactggttggcatactaagtggaggctcacatttatttgcaaaccatttatcattctgtatactgagagggagaacatactttatttaaaatatttgaaataatgactcttaaaatcggataacagaagcattaatgccaggtgccatgcagtaaattgcataatgctgttgggttggcactgacactgtgatttgtgttgctaatgatctatccaaatagatgggagttgagaataaaaagagaatattcctggaaagagacaaggcaactagtgaattaaaagtgtagtgagaaagggaaaaaatgtgtaggatcgtattttacttattggaagacccatctgctcttctgtacacacattatgtaagtttcactctctgtattacaaataacctgcagggtggataggaagttcatatatctgccttcagctgtttttttcactcacagacgtgaatgaacagaaagatttatgtcttgtgtgttggatattataggatggtaggttttttttttttttttaagggcgttgtgtatttagactgtgatattctgtgcactgctttgcttgaagtgagtgatggctgcgactaagaaggcagcaagtggggagtgggagtttggggaggtggaaaagggtttctgtgagacaatattggtttgtctggtctttgggcctgggctacacacatgccctttgacacttatggttaaagtgtttatttccgaatggtgcccagagctatgttcagtgtgtcctgagtcactgttgaatttttaaaatttggtagtctctgtgctgtccagaatttcttagatgtgttttgaatacagagggctctcagtatcaggtggcatccacgctggtcattgatgttgacagggatgaaatctcacttaaaaccctctaatttcctagttcaaggactcttccttattcctcttcccctgttgcaaaaggaccctctgatgttggttaagggttaatagttctgtccttgaaatgttttctttctgcgacatcacatttttcttttgctttatccatatcttgtgccaaggccattctctttcattctcatttcctttttaacccctgtgtgtactgcatcaagtcctattttgctgtctcttcgaatttagagacatcatcagtgcatatcatccattatacaaaaaagccagtaatagcccaatttttatttcctgtccaaatttttctcctcaacttcatatccatatctctcttccagaaattttattagaagcacaatgtatctaggataaaatgtaccctctccctaactcttccttaccttttataatggtgcttacgttttccatgtcttcctacttaaaattgtattcatgtttgtagtcttctccctgacttcactgctcatgagttctacctttttcttgtctgttataagtcctttccttttcatttcttttgctacctgccttgtccagatcttccttacacatcacctgcaagtagctgatcatcctcttaactgatctggtagttaatggtgtcttttgctcccaagcctgcctagtcctctgctcatctacttatttctgcctactactccaaagccttcattggctccccattgcccaaaaatgaattccaaacctcccagtcctggtgattaagtagttccctcccatacccaaacaacccagccctgtcttttactaacttttccttataggtgtgtgttttgttctccctgttctcccctgtatgcctttcaaaaccctgtccttgctaaagcccagcttggatgccttttcttggaaaccttccatgattgcccccctggagtgtactttgttgctctaggtataaatgactactgcacttatgttaaggcacctgtcacatactgtaggtatttaaggacctcctctctctgctggatgatcatcattttgatagcatattccttttgttttcaacagagctttttctattaattttaaatgcaatatactgttgcaagtagtagttggaaaaaatcacagagcaagcaaagttctggaatacaatttttaggtcttcctcaacattcctgtcacagtagatgatgtacacttacagcagaagacgatggttagaaaggtaagagcctagggtctgagtcagcttcaactagaatgtgagaactgagatagaaggaattatttccaccttcccggggattttctagcatagcctatgggttgtggtttgcccagcaacaccttaatctagttgcttatgtttagtaagcatttacagcctgggttagccggctggggttcaagactcttggcctttaggccagtgcttgatgcttctgtcagcctggaaaaaggacccatgtatcactcagtggttctttagccaacttgagcaagtaaagaagtctaggaggcagaggtcttctgccagcttcagcctttaggattgttagggtgatgtggggcctgctctggtgtgtctcgtaaagaggatgaaggagcagtgagaattgtgtagactagcagtatcctttcatctgctttgttgtgagccagcttaggtggtcttttctctgctattaaaggggaattctgactccttgagttgatgagatggagtttgggaggcagataggccttgaggacttggtgggagtttgtaatctgggcggcctggctgaattcatcacaagggtggatttttaaattgccttttttgctcacctactcaaattgagtcactgagcagtatacttgtagatgctttaacaagtagattatattgaatcacatttaataggaagatgactaacacaagggagttgttttatgttttaaaaactgctcacgttcctgaactgcagaagcacctgttctgttactttttaaaatatggtcgtgaatatttttccctttttggtttccccagggcagtgatgttctggttctgaggtctagtacagcatttcctttttggccttttgtccttgcttaaattctcttccaattcttcccttccaatccactgacccaggattagagtactaaaacctcacttgtttttccttatttttgttcatctaacttaagagtgcgtggcaaaaatcttcctttgtttttaactaagctcgttaccttcaccctggtttcataatgtgtcaccctccctctctccccctattttttcctcctaaattaaaccaacaggagtcatttgaaataggcgcagtgccagaattagcaaataaaaatacaggacacatagataaatttgaatctagataaacaaataattattttttagtataagtatgtctcatgcaatatttgagaatacttactctaaaaaatcatataggaaattcagatttagctgggcatcctgtattttatctagtaaccctacataggcatatatttgaaataaaaataaaattttacattaaagaaaacattataaagaagaaaaatttaagtttattgtgtgttaaatattcccaatgctttccttactgaaaaatgtaagactgtggacaaattatgaaacagtttgtgcataagatttataagttagctacctaatgaaaagcttctgttggctattggaatcagccatttatcctaggattcagctttatctctttgctaagaagatgctcctgattttgaggtgagaatatttagtgcaagcggtagaccattgttacatatgatatatcacaagcacctgtgtcaaaaacaaatgttgaagtattcaacaattttttcctcatttaaattgtgcccagctctcttagctcaatttcttctggcataaagattcttaacacaaacaattggatgatgaagacagtaaattcttgattgagcgaagtttttatccaagactagcttccctctgtcacccaggttatatgtggagtacaaactaattatgaagctaaatcttcctcagaccacataagtaagtctactccaaagcttaataaaatgattctgcaatatttgttccatgctttgctttttaccaagcctgtgcatacgttctgatttgattctcctgacagtctatgagagaacagtgatgatttgtctcctcattttataagagataaatttgaaattttgataggtgaaatggcttgcttaagatcaagcaagacttaaatcttgatcttaggccttttgggccattgctctttccactacctgtattgacttttgaatgtaagtgatttgggaattaggcagtttaggagtaattgtaccagtgttcccctctgctagcttggaagatgaagagctgttttcatacctgtgcattgtgctggaagaggtatttgcctttggttcagtgcatacctataatacacattgggtcttcttttgaggaacagctgcctcccctgtacaaacagcctttctgaatgaaggggatcagccaccgttgacctgtgagtttgaagtattgcactgttaatgtttgggcaggatttttttgaacatgtggttgtaccacagagttacgcaagcgaaatattcttggaaatgacattctgcacaaccgtagggagaaatattgggaagctggcaagagagtcaattctatcagtgtttattgagcacctataatgtgcattttgtgaatactggatgatgtggatgagaaaagatgtaagtcctactcaggagcccttcctgccacagtaccttcattagcatctcctgcctatcagtgcttgaaattcctggctcatttttgatatattttatttctgatttgaggcatcgtgtcctttattttgataaaatattatctaaatattttatatcacataaattattaaaataaaatattattttttgtttgttatgtatagtcccctaacaaagtttgaactttttgaggtcaaggatcatatatatatatatatacacacacacactcatgtacagaagaagttcttgaaaaatattggataagcaaataaatttgtggtattcttggggaatcttggattaataaatggatagcatccctcggttgttgtatacctatattcaaaggatccatgactcaatgatggggtaaggaggctaaaagaggcaaagtcaatgactgaattgaacatggcatatcatctcaaattatactgggaaacaacattattgtctacttgttaaccaaatatatgcagttgatatcattcaggccttgcacaagttccttagtgtataatcttggtccttagaatgaagtgagcagcaggtacatattcagagactcatagtttgatggcatgggaactgtatctttggagatataatagaaaaaactgtgccttatctgattaaaaatgatttcctaaaaagtacttggataattcctaattgtcccagttttcataaatgatttggaaaatgctgtttgagactgtgattgttaatatactgtggaagcctattaacttctttttagaattcaaaagcctttaatatatggggcaagagaacatggattgacaaatggataagagtaactaactttattgtaaatcactgttgatatttggtccctgcctttgttcttttgttttactttctttcctcataggactcattaccttttaacatattagtaagaccgggggaatttgttcacttttttccttgatgtataacaaatcatattgcttaagttaaagctaaagtagatatttaggttaaaaattatgtagatatttaagttaaaaatgtgaattgacttaaggaataatattaagagaacaatgtagcaaaaattgtcatatatatacatatctgtgcgtatgtgtgtgtaatatatatatatatatatgtattcacgttatatacagacatacacacagacatatgtaagtaccagggatgaaacaaaaaaaaaaaataaaacaacatgtgttaagtactgtgttagtactaaagatgacagaaaaaagtacaaccctagatccttggccagagatgcttacttgtcttacacttcttacagtcccctctttactacacgacaggttaacttaatcaggacagactgtataagttacagggcccagtgcagaatgaaagcatggagcctgttgtatagaaagtaggacaaaggtgccattaaaggtggtaaaatataaaatatttttcttctaggggatctctctcaactttttatggtgttttaaattagctgtttaatgttgctttaagtgaggaaaaattcaaattttaaattgctagcatgaattttaccattcatggttctgttgtgcaatgccagttttaaatgcagatatgagagcattcaacttgtatgtagaatcactgaatttatacagtttatgttatgcctcataggcacataatgtattttgtttttaccgcacagtggaaacactgcatgaaatgaactcagaggtttttatttcacttgttgatatgcacacatttaaccaacactctctaccttcagattacaatgagtaaggaaggactgaaagggactgtctttccctttcctcctgtgtcattttcagtgtgattggctaatacagggaagtaatatgtgtaagaaaaggtatgttaggatttcttgccattcatgtttgttttagaacactatttccagctttctgcctttaaattgaagttttgatttgaagggaaagtataggctcccaaggttgtctgtctttcctctggcttcgtcgtaaccataacacacttatagggtagtcccccctttatccatggggaatacattccaagacccctagtggatgccggaaaccacagatagtactggcccctgtatatactatgctttttcctatacgtacgtggctgtgataagtttaattagggacagtaagagagctaacaacaataacagagatttaacaacaataactaaaacaacagttattaaccacagtactaaaagctatgtgaatgtggtctctctctcaaaatatcttactgtactctactcaccctttttgtgatctgttgatctgataactgatctgagacggctactaagtgactaatggatgagtagcatctatagcgtggacatgctggacaaagggatgattcatgtttgggtgagacagagcaggacagcacagggcctcatgctattcataatgcctcaaaatttaaaactatgagttgcttatttctggaatttttcatttaatattttcagattgtagttgactatgggtgactgaaattgtgaaactggagataagggggactgctgtactctgatttttactgaactgtcacatattgcaggctcactggagttctatgttactgggacatacaaacactatgtgaatggggcagccaggaattcgctcgcgcctgttgcgtgtattttttctactcatggacatgttccactgtgttatccgacttaacttacaaaacaaagttcaaagataagattatagagcattaaaccaagtgccgagcccttctgagtgcagggccctgagcgattgcacaggtcacacacccatgaagctggctctgaccttaatagataaggaagcacagcagagacataagctgggcctgatgccctgtgttttcacactgaggaaagcatgaattatctcttacgttccttgtttgaaactcaggcttcaaaagtaggaaaggttagaacatcaatccattgtgcctttccaccttttatctgtaacttgctgaaatgttttcttcctcctcctccttttcttgtcatgttggatatgtccttaatatatcagtgtcaagtgttgtgtctgaatgtgaacctgaattctattctaagtgctgaaattaaaacagtgtttctctgtttagtttctaatgtattcggggtactagagtatctaaaacagcattttaagaggctttaacattttttgcctttttttctcccgaattatacaagtcatttttctttttctgatttgttgtctcctgagaaagtaggcctccctttttttttcttgcatgtggcagattagtatcctgtggtccattgcaaccactacagtggttggtaggaagtagaacttgtagaaggtgcagttaaaactactattaaagtagcagggaaccttctttgccctctcagatgaggaccaggaagttgactttcacatttgaggtggcacttgatgtagcctatattcttttttttttttttttttttttttttgagacagagtctcactttgtcaccctggctggagtgcagtggtgtgatcttagctcactgcaaccttagcctgccaggttcaagcgattctcctgcctcagcctcccgagtagctgggattacaggcacgcaccatcacacccagataatttttgtatttttagtagagacagggttttaccatgttggccaggctggtctcgaactcctgacctcagctgatccgcccgcctcagcctcccagagatatagtctatattctaaagagactctcttctaatcaagtggttatcatctgctaatactttgaggaaaaaagattaatgttccaggatttataagttcagagaactagcttaacagagtgcagtgcttcacagatctgtctggctgtggaatcagattgactttaggttgctgtggtagctctgcagcataggagctgggaaatttagtaaccttacttggtggttctcagcccttattggtatggttaaggaactttgaataaacacctgtagagatttgaatttagttgccgttgggtggggctcaggctttttttttttttttttgcatcccagagttagcagtcagggttgagaacactagcttatctcagaacatcaatattctcatttataagatgagagaattagactgtatgagatcgtcgtgagatctaggcagatgaacacagcacttggccagtcaatgtgagtgactgttatcgttaaccacccttactgattctttgctgagattggaagctagattggcattcatttcttaagctggaaacctgtgctgatttgttagaaatgctgcaaggaacagaaatgattatctatcctaagggaatgactcagatcttgttagaataccatgcccaacttctcacctcccagaagagtgtgtcacagaatagctggaattacacctactttatgtatgaagattatccctggaatagatacatctttgaggaagaagttgatttattcatttgtgtaatgtttattgatacttaatacctatcagcacttctagactgtggcctggaggaatccatagattggtaattggttggaaaagtgaatgtaaattataacacagaagaacaagtgttttgttaaggataatggaaactttaaagctaagtagaagatagccaagctgagaggcctgggtgggctagggaagaaggttattactggcagaggaagttgcagttttaaagagacttagaggctggacacagtgggctcatgcctgtaatctcagcaatttgggagaccagggcaggaggatcacatgagcccaggagtttaagagcagccttggcaacatagtgagaccgtgtgtcaaaaaaaaagaacaagagacgtgaagacacacttggcatgactgggaaacttaaagtagtttagcatgtctggagtatacttactccagaggtgggagtccagaagatggtgataagaaagaggttagaaccataagcagggtcccagtcatggaaggctttatttggagattgaaattgattattggatagccattgaacattgtaagcaaggaagtggcatgcttaaacttgcactttggagatgtcacaatcctacaacaggctgaaaggctggagacatggaggccacttgggatgttgttaatggaagtccagatgaggaggtctgaattaaggtagtagcagtgtagtcacagtgaggtggacaacagatggcggagattaagaaggtggaatttgtaggtgtcagccccaggcattgcatctattttttttttccaagttgtggagacggagtttatctctgtcacccaggctggagtgcagtgacgcgatctcggcttactgcaacctttgcctccctggttcaagagattctcatgcctcagcctcccaagtacctgggatcataggcatgcaccaccatgcccagctatttttgtttgtttgttttgtatttttagtacagacggggtttcaccatgtcggccaggctggtcgcgaactcttgacctcaggtgtgagccattacgtccagttgcattgcatctgtttgatgttgggtatctaggatgtacatctgtcaactcgtgatgcctccctgaaccttcgatgattatctattgactataatctacccccaaccctttttttttttccattttcatctttcactgaattcctctgtggatccattgatcacgctttgcatatttattccttctcccccaaccccattcttcctggatgagctttttgctctcttttaaaccattgcacttgactgtctaggcatttgccagtatatcaaataagtatgtatttgaaagtctaggtgagcctttcttaaatactggatgctcagtctaaggtatccattgtgtttatggaattactttctctcctgtgtatctaaatggtactagtttgatacttttctgaagataattgagaaaaagtaactttgatctttttttcttctgtggttcagaagagaaattatttgtttcttgctcctatctgagccagattgcaaatttagtgctaagatttctggcattaagaggattattattattattgttaaattgattgtctcattagattaccaacatgaggctcatgggacttaaaagatttatgcccatatcctggttccatttttgtgtagagcctgtgggatgaaaatggctcacaggtctgtttgtgacacaagtagcttgatagatggcctatggttcatgtgtagaaaatgttggcgactatagatttattttagtatcattttaggaagcacaaaagtggtgtcccaattgaaccttatggagagagcatcattactttccatcacaggttcagactttgggaccccagggctctggaaatggaactctttgaagaggtcagagcctctatgcaccctctcagtcaactcaactgcatgtagaggagggaaagaatgttgttattattcttaatattcttatagtagcgtctaatagtacattagtaaatagttattcacaaatggttgttcctattgcttagcaatttctgatttcagatttgtgttttggatatatgtgcatactgaccttctgccttttaataaatctagaattcatttgatagtacaaattaacaaaaccagttgtaataaaaatattgaattttaactttaaaaaatatgcagtgtggccaggtgtggtggctcatatctgtaatcccagcactttgggaggccgaggtgggcagttcacgcggtcaggagatcgagaccatcctaacgaacacggtgaaaccccgtctctactaaaaatacaaaaaaattagctgggtgtggtggcgtgcgcctgtacctcgggaggcagaggttgcagtgagctgagactgtgccgctgcactccagcctgggtgatggagcgagactctgtctcaaaaaaaaaaaaaaaaaaaaaaaaatatatatatatatatatatatatatatatatatgtatatataatatgtattatatatacataatgtattttatatttatatatattttgagatatatataaaatacattatatatatacataaaatattttgtgtatatatatatatatatatatatatatatatatatatatatatatatatatatatatatattttcagtgttcatataacaaatttcttttgagagctaccaaggaccagacttggtgctgtgggatatttgataggtgtgagacagtcttttcctcagagggtttgtatcctaggagtagggataatgataactgcataagccacctgattgatctggaattggatgcaacttttactacaggaattgacataaggatttagacccttttccagtacattgacctagtagtattaacaggactgtggcaactttgaacttccctaatgagaaaaacatgtgttggtgagcaggtattatcacatcttcccttgcttttctgtttaaatacagtatcctattcagataggcaaatctctgatgttttgttgagtgaagtctatgggccagatcacataatagatgatgtgtttgttggttgcccactgattagcttgggacttgttacctagaggtccatggcccttctgaagtcttcattatgttgttagtttcccaaaatgatccgctgacacttgttctaaatatggtttattttttgcagcttaatgatttacttatttgccaaatactgggatttggtttcagagagcatccttttctacctccttgggtatataggccttgatttataatgtctagttactctgtcaatgaatcagttagtgaccattttgagtgttaagagctttgagtaaagaagtgtgtgaaaagccttctgccaccaggaagcttgcttccctgtgcctagtctaaaccaaaagtcttcaaacttttttgattgtgaaccccagttggacaaatcacttagagtaagcacctcattttaaagttttatatttatactactgtactaatatatagatcagaaacataccgaattagaaagtaataaagaatgagatgcatatttatttatttacttaaacttttattttagattcaagggatacacatgcaggggtgttacctgagtatactgggtgatgctgaggcttggggtatgaatgaccccgtcacccaggtactaagcatagtacctggcagtttttcaactcttgcctcctccctcccacttctgatagtccccagtgtcttttgttgccgtctttatttctatgagtacctagtgtttagttcccacttacgggtgagaacatgcagtatttggttttcctgttactgtggtaattcgcttaggagaaaaacacatttaaatagacattataatgcagtcttacccctcagtggaacatcctacagaccactggtgtagacagaaagtgctagaggggtgcttgggagagagaaatcatccctgaggcacgtagtgaagaatgagttgtgtgcaggacatcaccagagtcatggcaggccgtggagaagatatagttggtaccatcttttggtgtaagcagcagggagccatggatcttcctaggaggagccacaaggtagaagtggccatgccatagatgcctgcatagcatagtgggctggggtagacggtggggggcatgtgtgtaaagagagaatgtgagggagacaggttggtatcctaatcctaatcccacagcagaatagaaaggcaaagaggatggtggtggcaggtagggtgaggaggtagtgaatatgtggacatttcctgcatgaccagaactgctaaggaggaagtgagtcttgaagtctgctggacaaacaatggtttgtagtaggagaaccctaaggtggagggagcggggaggggaaggactggccacatcccaaaaccttattatgtccaattttactgcagctgttttatgactgcaacatttttgttcaggaaatcgtttatttacccccacaccttttcttttagactaaatgacaagaaccagtgctcacatccagggtcaaagctaatctttgaggaggtggaaaacgcctccttgtttcattgtctctcttgaaagtggtgtctccctttcactctcctgcaggagagagatgtccaggtactgcctaagcagccccagtgaaaacggatggttcttgaggcttccagaggtcaatctggcataagaagtaaagaagaagccacatgactcggagaggcagaatttctttccttggacaggatagagcttttaattgaatccaaatcacatctctcatcctgtgaatgctggagagcagtacatttttaactaggaagagcatcaattatgtattagccacgatactaatttaccctgagtgtgtgtcttagagctggctttcatctctgcatagccactgatgtaatgccattgtgtttctatactcaaccagtcgctcttaagatagggtgtcctgctattgaaaagagtagaaagtagggattgctattgctgaggctctttctgtgttcttacagctgagggccctttgggataccaccttagggtgggagagctgttcactcaccgttgtgctttgagatgcagactggggcttgtccttttactctgatgctgctgctttatcagttatttggtattattgtgttccaggataaatctctggaaccctcagttatagatatttgagactttctgtgtgtgtgtgtgtgtgtgtgtgtgtgtgtgtgtgtttgagacagggtcttgctctgtcgcccaggctggagtgcggtggcacgatctcagctcactgcagcttccctccatcctgggctcaagtcatcctcccacttcatcatcccaagtagctgggactacaggcatgtgccaccatgcccggctattttttttttcttttttttttgtagagacgggattttgccatgttgcccaggctgatcctgacctcctgggctcaagtcatccactcacctcagcctcccaaagtggtgggattgcaggcgcgagccactgtgcccagcctgagattttgaacatttgcctccagaaaatgtaggcagtttctgtggctgcttatttcctcgccagtaatatattttgcttgttcctagagtactaaatgtaatgatgaccaaagtggactgagcatttcctagatcttgacactcttctaagcacattatatatattaacttattaaattctcacaaaaatcctatgaggtaaatactattatcatccctatgttacagatgaggaaaatgttaaataacttacctagtgagtgtagcataggctctggtgtaaaaagctgattcaaacacctgccttgccactgtgaatcacggccctcagtcctttcctgtgaaaaattgatttttattttttttgagacaaggtcttaccctgtcactcaggctggagtgcagtggtgtgatcataggttgctgcagccttgacttcccaggcttagacaattctaccatgtcagcatcctgagtaccttttaattttttagagagatgggatttccctatgttgcccagtgtattagtccattcttgcactgctacaaagaactaactgagactgggtaacttataaagaaaagaggtttaattgtctcatggttctgcaggctgtacaagaagcatggttggggaggcttcaggaaatcttcattcatggtggaaggtgaaggggaagcaggcacatcttacgtggcctgggcaggaggaagaaagtgggggtgggggtgccacacacttttaaacaactagatctcgtgagagctcactcagtatcatgagaacagcaagggggaaatccgtccccatcatccagtcacctctcaccaggccttacttccaatactggggattacaattcaacatgagattttgatggggacacaaagccaaaccatatcacccagctgggaaaatggattgttaatagtacctgcatacagaattgtggtgggcatgtgattttggcaggtgataagctcttcattagcattcactaccacagtgaacaccaccatcctcctcctcatcatcataattatctatccagaggatcatgtgagatgcttcaaacccctgactaaggcaatctcaaaggataatttgcctcaggtgtcagaattgtttagctgtacttgcctttccttgcaaatataatggcagaaaaagaggaaaatttagacattttgagccttttcgaagcgggaaatcaggtaagatattttcagatagataatttgttttctccttgtgctcttatcacttccttcctctttctctcccacctctgagaaccctggatgagggtagatgaagtagaggagagggtggtgacaatggtggtaaaagaaaaagtaaccaccaaacatgtacagaaccactccagcatttaattaaagcctgcagccctttgtcagccagaagctcctctcatggtgagagaggcagagagccttgtcactgtctctagaattatttgtataattcagcagctgtttccctcagatgcctaccacacgaggttggattataaagacgtatgagtagaatcgccaaggttcagacacttgtgttcactgttgagctgagagccacttaggctgttcttgtacaaatgcattagattatggttaagcagcttatggacataaaaacacattagaactttacagcactctataaattatagtttttgcagcattcacagccacaatgctaggtaattacattcattaatctactagtaagagcacataaagttgcctcccaaaccttactgtatgtgtcagtactcagctgggaaggagagtttttttcctctcctttttccccgtctttccctgttccattaagccttgtgtgggaagatttttgatgttacattgaggtgttccctaaaagaatccaataaacccattttttttttttaatggttaggctctggcaggaggccttgtaggtaatattttcatgttgagctgcacctagtaactatttttgtatgcatttattttctttttggaaatggacagatgtctcatttggaaagccagcaagttaaagcagttgaaaagagattaatgatagaatcagtggtaaatgctttttcaggacttctttttgcctctctctggtagcagttaacatgatggtccttttaattttggatctatcaggagtacaaagtattgctctcttcccatgccaaactttcctaaagtttccatctttccatatggtgataggaaatgcctccccccacagccctgtctcagaactttctcttatttgcatgtctcataaattacagaaggcagatttaggaagaaatgctggaactttatatggtgctagtatttcaaggagcaaattgtactttcttcgcattatttctcaggttaaatagaccaagtggaccaggcgtggtggctcacacctgtaatcccaacactttgggaggccgaggtgggtggatcacatgaggtcaggaatttgagaccagcctgccaacatggtgaaacctcatctctactaaaaatacaaaattagctgggagtggtggtgcacgcctgtaaccccagctactcaggaggctgaggcaggagaatcgcttgaaactgggagacggaagttgtagtgagctgaaatcaggccactgcactccagcctgggcaacaagagcgaaactctgtctcaaaaaaaaaaaaaaaaaaaaaaaaaaagaccaagtgataggctgggcgtgctggctcatgcctgtaatcccagcactttgggaggctgaggtgaaagaattgattgcttgctcaggagtttgagaccagcctgggcaacataatgagaccccatctcaatgtaataaataagtaaataatttttttaaaaagtgaaaagaaaaaataggccaagtaatacagccatcttaaaaataaaaacaaaaatggaatagagaagtatgttaacctgcaaccccaaggcaacactataagtcctgggtcatgctcagaccacattctaggcttctgctttcagttctgttcacatgaatgagaacatgaatgctagagccacgcaggtctgtgttgagtcctggtattgtcttttcatagctatgtgaccttgggaatattaattaatagtaataaaaataattaatttggactgaactcctaatacatcctaggcattacattaactaatttaatcctaatagctgcttcataagttaggtgatattattcgctccattttatatatgagaaaactgaagcttcacagggtattgtagtaattaaatgaggtattataaataaaatatccagtatgttgcttggcacattcaatgacactcattaaacacaatcttgaggatatatggagaatagatcccaccattgttcctccaatgccaaatgtaaccttttagaatgacagtttccctttttaatgacttaccagtcattaattgtatcagtcaggaagaggaattcctcacatttatttgtaatttatttactgcctgtaccaggaagtatcccaagcactttccacaaatttcattaaactttctattcctgtattccaggagaagaaatggaggctcataagggccaaggcatttgttcatgttcgtaaagccagaaggtgggaaagccagttctcggactcagatgtaaccgccaccaataaagagtagggatagcagtgaagtggtctattttcctggaatgaagcttctatggtgggaagtaatctaagcaactgattaaggagccagctttgtgcacttcaaagcagcctcagcttcggggtggagcatagagttccttttttttttttttttctttagcaggcaggaagatattcttattcccaaagaactgagaaatatttgagactatccatagtactcattggtgctgtaaggttagataactgctgagaagaaaactgattgctctgtgtaaatcagtatgctgatgagggaatgataaaactgcagggtagtaccagcgtcagcatcttgtttccaacccagctcttctctctcttgacaaaacagctgtcattttggattaatgttgaaatcaccagaatctgctggtcatcagagcagggccgatgccatctttgggatgaagtgtgctggcaacaagatagaaactggacatgggaaaaaggaaagtctccctcaaacatgctgccatccaaggcccagtttaaaccacaggctcaatttttgctcccaaactgatttcccgactaacccatctgctcatgcacacaccctcccaacctcacacagcaggcctggcctttatcatttcaggtcctgcagagctgttctctctcactgtggtactgatgccagttttaacagccgccatgtgtattgactcctctaccgattacaaatatatacgcgtttgccagtttgtttagtgagtggttttcataggctgtgatggggatttcactttcatgaatataatttgctgagcctgtggtgacatcaataaatccttctgggatggggaatggttgatttccctacatccagatgacatcctccagcccacttccttatgggaccaacagccaatgtcataacacatgcttctttgtgagagcatggaaggaaattgtttaaagtgtgtcatctgtgggcacagtttctaaggtagatacctgtgaggatgtataggcatgctttagacatggacagaatgagttatgtacttagtaactcaaaactctgctgagctcattgtggacagctcttacagataaactaaaatgcagcttcttaaaaaatgagaggacatttgcagaaagcattcttactgctttcagcaaatctatgtgccttatgtttttatatagcagtcattttctcaaatcagacatccctattgcctattagataaacacagaaagcatagattatgagtttaaaagtatcgacagcatttcaagtgctatcagagaacatttaattcagtttaattttgtgataaatctcacgtttaatcctctggttaccctgtaatcatgtctctattgatcttttctgaatgactgcctgcagtttaataaactttgccattaacccagagcttctaaaaggagagattgattccattatcaaatctgatagaaccaataagtacctaaacatcactaaatctatctataggaagctttggcctagagacaagcctgtggcttgtttaagaaactaggtaaaaatctggatatctttgcatgacctaattgcctcacagcatctgattcccttgtgcaaactgacactgcctttcatctttcaagtcaatgtagtagccaactgaaaggacagtctcttttcttgcctcaaccgtaattgtagggtctaatttattctcactgcagatatagcttgaggagtttatttggtctatgtctcaggtcagtgggtatatcttaagcacttttctgtgtctctgaaaacctgcaggatagtttgttttatttttacctatatgatgccaagggaaagaaaattctgtctggataaatcctgaaatagaagactgggggtgaagattgagagagagggaaggcaagtacagagtcatagctgtgtgaacaagctctaagacttggaaaactttccatgaaacccatatatgtttctcatgtagtgataggttatttgcaatatgtgttgaacaggaatttctactttttgtgccgcgagtatttatagctttcatcattattcattaatatttattgagtcacataggcagaacatatggaattcagggtctagagtatatttacagcttcttatttttttaaggtcagaaaggtgtcattccctgccacttttcacctcttaaataaatcggtgaaggttgtcaattttacagaaaagccaaagcttttattttctgtctagatttttattgacaatgtgaatttttcagaaggagttcggctatttgacttaggaggcatagcctttccctaattacacttcggtggggaagtggaggtgcacagaaggatttttataatgagacaatactaaactgtaatttaaaatttccttccaacaaaagaccctaatcttggcacttagaaataaatctgtaatgacgtggtgttaggcagtggaagcaggattagagccaagggactctgggtgtgttgccagttgctgattttctcactttggaaagtcacttgtttacccagccttagtttcctcatgtataaaataaaactgatggtgcctgcttagagagctattagagaattcaatgaggtgattattttaaaagatactgtaaactttttccaatgctgagttgttgtgcagacattaatggttatgaaaaagataaattagtcctcgctttatattcagaaatggtctgacctttcagtaaattatgtttagttcttaaatcaaaacccagttaggacaagagagcttgaagagtacgtatacataagagaagtctcacagagatatttgaaaggctggaaaatgtgctctggaggcaaaccctccactgaattgatgaattctaagttacatctgttgatattttttgtgtgctaaatagcctcccagtatggtaacattagagaggctgaaggaacctaagaggaggaccctacatttataggtattgaggtagattggtctctgcccttgagaagccaatcaaaattaggttgagaaaggatgtagcaattgttcgtggaatactaataggcatatatgcacttgttcatgttgattctctatgtcactgctctgtaagagaaggaatgcctgcacatcttcaataggaagttgacaacagtttctggaaagttggaagaaagttacagaattattcctttagtagtaattattccatagttctctagaaacatgacaaaacctcttgaaaaacttgagtcataaaaggactgcctcacatatatacacacacttcctgatatgctgtgtaaaactgcgtttatattcagagccacataacacaaattttgccagaagttgctttttataccactgaatagctctaaactttaaattgtctttcataaaattgtttcttgtctgctgagtggacagaatgtctctctcttccccacccttcatatcattttgttttcctaaatgggccactctgtgaagtagttctttacttctagccaccacccctgcctctagaacaatgcaaccaaccttaaccaaagtcacatatcaagagttctctgctgcctgttaatgcagatttgacttctttgtgtgtgtgtgtgtgtgtgtgtgtgtgtgtgtgtgtgtgtgtgtgtcagggtctcattctgtcaccgaggctagaatgcattggtgtgatcatggctcactgcaggctcagtcagtcctcctgcctcagcctcctgagtagctgggactacaggcatacgccaccacacccagctaatttaaaaaatatttttctggagactgggtctcactctgttgcccaggctggtcttgaactcctgggcttaagccagtccacctgccttggcctcccaaagtgttggcattaaaggcatgagccaccgtgcatagccagatttgacatcttaaaagccagagctagacatacttattgattgtcttcctggggccaggtgcagtggctcacgcctgtaatcccagcactttgggaagccgaggcgggtgggtcacttgaggtcaggagttggagaccagcctggccaacatggtgaaaccccgtctctactaaaaaatacaaaaaattagccgggcatggtgatgtatgcctgtaatcccagctacatgggaggctgagacaggagaatcatgtgaacccgggaggtggaggttgcagtgagctgagattgtgccattgcactccagcctgggtaatagagcaagacttcatcaaaaaaaaaaaaaaaaaaaaagtaatggaaactcagagaaggttgctgaagggaagctagaaggcctcctccaggacagagaagtaatcattttacacttatcacttacggtaactacaatagaatcagtgagctagttgctgaatacttctagagacattgttcacttaaagtgaaggtgtgatagtatgtgaatacctggggaagagaagaaagcgaaacatttttaggaaagaaaaggaaagtatgtgacttattactaatcaggatcaatttgaagatctgaatagattttcactggctaatcagagttattctgtggaatatctgcaacctctgcaaccacttttgatttttctgtgaatagtgaggtactgagatccagtaaattataatttggccttgatatcaagccatgaaaaagatgtttagaactaacattcattggcctctttcatttttttttctcttggggttaataaggcgatttatgttatttctaggcatctgttcatcccctctttagcatataggggaatagaaatggtttatccgggatatggatgtggtaatgtgtcttagtctgtttttgtgttgctacaaaggaatacctgaggctaggtgcagtggctcatgcctctaatcccaacacttggggaggccaaggcgggaggatcgcttgaggccagagttagagaccaacctgagaaacatagcaagaccttgtctctacaaaaaagtaaaaataaaaacaagaaaaaggaatactagatgctagtaatttataaggaaaggaggtttatttcactcatggttctgcagactgtacaagaagaatggtgctggcatctgcttggcttatggtggagttctcatgtggcttccactcatgatggacggcaaaggggagtcagtgtgtgcagaggtcgcatgatgagagaggaaacaagaggatggggggaggtaccagtctctttttaacaaccagctcgtgtgggaactaacagagtaagaacctctcttagttctattagagttcgacatgagggagggcattaatctatttatgaaggatccaatcccatgacccaaatagctcctcttaggccccacctccaacattggggatatatatatatatatatatatatatatatatgtatggttttttaaattattatttttttggagacagtctcactctgtcacccaggctggagtgcagtggtgcgatctcggctcactgcaacttctacctcctgggttcaagcgattctcctgcctcagcctcccgagtagctgggactacacctccacgcctggctaattttttgtattttagtagagacggggttttaccatattgcccaggctggtctcgaactcctgagctcaggcaatccacctgccttggcctcccaaagtgctaggattacaggcatgagccaccaggcccacccattggggatatttcaacatgagttttggaggggacaaataaactataacagaaataattagataatgtgtttgaaagtcttggatggaagtccgagaggggaagagtgatggagtagtacaattcatagcatggcccaacagcttcagaatgagaggacattcagggcatcctaatttcacaagttcattctcctttaagtttttgtttttagaaatgggctcttgctttgttgcctagggttctcaaactcctgggctcaagcagttgtctagcctcagtctcccaagtagctgggactgcagccatgcactaccaggtccagttctaattcattcttttataaacaggttactgtgtgtcctctactctgttctctgctaggaattctggcatgatgaagtcatagccattgtccttatggaggtaattctgagtattaccaggaagatccagttaccaatattttgatacactgtaataagtacattaattcttttcctatcttttgcatacagtgcttaatcaaaaaatgaataatggttgtttcaacttactttaccatcagcagtgtgcagtggttcccatttttccacaccctcactgacaagtacctcttgtctttttgataatacccgtcctaacaggtgcaagatgacatctcattgtggttttgatttgcatattccagatgactaatgagcacattttcatgtacttgttggctatttgtatgtcttcttcggaaaaatgtctagtcagattttttttaaaaagaacatattacatgtaaaaagaataatggttaattaaagcaagtatcattagaattacacatcctctcaaatgtgtgcgtgtgttactttagtggattagatttaagtgggagaaaaagcaatcgaaatttgagtgttctgcttgtctttcttcagttagcataccaggcttctgcccttggagaggcctgagaattgtgtggtgctagtttctcttctggctgccattacactatcttctgttgtatggttctttttgcctttttggactcgtcctttgtgtacgttattgccctaagccctcactgatgagattttctgcctcagtcatgctgtgctcagctttcagaatgttgttgttacggaggagttaattttttttttaaggtttccttttcgtcatgctgtatttctcagattatctggagggactgtaatccaattttaggaatccttcagggctgagagcctaaactgttttaagcaatagcatctggttgccagggactcaactactttgagcgtgttaaggtctaacggcagccaactctcaattatctgtgggaatgggagactcctgggatgttttcaattcacagagtgtgcaaaaatctcacttaaacggatagtcgtgacctcatcccacagctgagtttaggagagcttctcagtgtgtggttttgttttctttttgttttgttctcttctcacctttgacagtggcactgcagcattgacaggtgccttttatatgttgaatttatctgtacctgatctatttttttaaaccttgtccctctcatctttatttagattccatatgtgtatcattatatacattaagtatgttttaataaactgcctcaattcttttacattttaggagcagtaaaatttatttatattttctttctttgcttattggctaacgtgctcatgggaggggatgtagccaaacagtaatcaggctaccagatagaaagataagaaaactttacaaaaggttagcctctgaataataattgagaactggctgttaaaaatgaaaaaaaaaaaaaaatacgaactctaccttgtcactgaaaatgaggtgaaggccaggcagtgctcctcagtcaagacattcgtgttcacaactgagttgtctccagtggaaatttcatggctactttatggcctaaagccagtgctcccagacgtggtcatcccttggttttaggattctaaaagatgagtttcttttaatgaaaactgaatgtaatctagttgttagggataattatatgccagttgtgcatgacggcaagggcccctggtttttaaaaaccagctttatggaggtataatttacattccagtaaactgcacaaactaacaatatacaatttgatgagttttgacatgtgtatatacccatgaaaccactgccacaatcaagacagcgaacatgttcaccccaaaagtttccttatgtccctttataatcccttcttcctatctctcccaggaagccactagcctgcttgctgttgctatcaattagttcatatttcctaggattttatataaatgggatcatacataatataatcttttccgtctgatttctttcacttggcatacttattttgagacgtattcatgccacctgtatcaggaggttatttctttttattgctgagtagtattccattgattggttacaaccacagtttgtttatccattcatctattgatgtacatttgggttgtttgcagttttagaagcattgcacatctgctaggagcattcatgtgtagctcttcatgtagacatgtactttaatttctcttagggaaatacctaggagtagaacggttggatcatatggtcggtgtacttagaacttttaaagaaactactaaactttcttccaaagtggttgtgctgtttcatattctcaccagtagtgtatgtatgagcatcctctgcatccttgcccactctcggtagggtcattctttcttatttcagccattttatatgtatgtagtggtatctcattgtggttttaagttgtatttccctaatgactactgatgttaactattgttttatgtattcattcactttccagacagatatctttttttttttttttttttttttttttttttttttttgagatggagtatctctctgtcatccaggctggagtgcagtgacacaatctcggctcactgcaacctttgccctctgggttcaagcgattctcctgcctcagcctccgagtagctgggattacaggtgcatgccaccatgcccagctaatttttttgtatttttagtagagacagggtttcacccgttagtcaggatggtctcgatctcctgccttgtgatccatctgccctggcctcccaaagtgctgggattacaggcatgagctgccacacctggccccagatatcttctttagcaaagtatctgaatcttttgcttatttaaaaaattgggttgtttccttttttagttttgagaattttttttttttttttttttaagatggaatcttgctctgtcgcccaggctggagtgcagtggtgcaatctcggctcactgcaacctccacctcctgggttaaagcgattctcctgctcagcctcctgagtagctgggactataggcgcgtaccaccacacctagctaatttttgtattgaccaggctggtctcgaactcccgacctcaggcaatttgcctgccttggcctcctaaagtgctgggattacaggtgtgagccatcacacctggcccaagaatttattaaattaatatattctgtatacaaaacttatcagatacacattttaaaaaatatttttccattctgtggcttatctatttatgtatcttttactctcctggtaactcacagaacagtcactttattttcttgacagtatcttttgaagagcaaaattttaattcttgaagtgtaatttatcaatttattcttttatggattatgcctttggtgtcatagtaagaaatcttagcttaacccaagattacaagagttttctcttagaaattttatggttttaggttttacattcaggtttataatatagtttgtgttagttttttctatttagattgaagtgtggattaaaattttgcatatgattacctattctatcaccatttgtttaaaaaacttatttctctgtagaatagcttttgcctgaaaatcagttgttgatatatgtgtgggtctctttctggactattctgttcctttgatctgtttttctatctttatgccaatatagtgatgcaattttaatgtggtgtgaaagatggcactacagagcacctgacttgctcctcctctaacctactttactataatagttcactgattagcctgtttccctggataagcagcctgagtttaggaattctttcttagatatttccaacagatggcaatgtgtatgcacatagtaggtgttttgatatttgtttttaaaagatgtgaatcttagggattaatgtttgaatgccatcctggatgccttgtacattcctacagatagtagtcttctctactttctaaaaagtttaggctctgaaaatctgttcataaagtccatttgctcaaaagtccaaagttggggactgttgtgaacatatctatctagttactagttttctaatttttcatttcttatcactggagactcattattggtagaatcagtgtttgtaaaaccattcaaaaacaagtacaaatggtatacaataaaccagcaagggacttgacagaccaaaatgacaggacacagccattatgtcattgtgtcattggggacaggcaaagcacttttttctttttctcctggcttgttattttctttaaggtctctaagatcagataactaacagaagaggctcagtttaaattgcaagcccctcacatacatatacatgcatttgggtgcatgcagacacatataccacaaatactttgtaagtgatggactgccctcaggttagtttgcttggaaaaatcaggcggagactttctataacccacttcatgcaaggcagacaaattgtgccctcattttctattgtctctggcttcatctgtaatcagcaaatggagccctgcagcttacatagtgtttcatctgctatttgttactctcccttagtttgcacaacactgaaccatctcattttgaaattcaagagtggcgaggaggcctttggtggaagattgtaatttgggagaagggaaagtcaagagcaagatcgcctattttgaagaaggcggggtgttgaaggaaattgcctttgtcagtctctgagcctctccatatatgtgctactgtgaccctgccctccatcaccagtgacctaaaaatcacataatttcaactattctccaaacctattcacatctgttgtgcatggcttgtacacttaccccctctattgacagccaatatgtctaaatctttttgcctctcagccagcctcttgttggtggctccctggctttcttgccttctttcctgcttcttctatgactgtcaaatgaatgccttaaagcgttttttttttttttttttttttttttaacagatttctttcttatccttctgccctcctgcctttctctcctagtgcttgtgtaagggaggcagttttttttatctttaccctgttagggtctctagctgaggctgagtattaaattgatgtaaaatagattaacagaagaaaagcatatggattttgacacatatataggagcccccacaggaaagtgaagacccaaaaagtggcaaatcttgaatccttatttagtaggttgaacagagtggccgttgtggaaaagtaactaaaataaatgatgtggctaaaggaagataagagttagtaagatctgttggtacaaatttttctggactccccatgtctagaaacgagaaaatttcttctttcctactatagggagatcatctttcacatgagagttttttcccatctcaggtgtttctggtgataatgtttcttttctcctatctcttttgtttctatttttcaagtgcctttagctttaaaataatccttaggcctaaatagcatgttttggggtggcgtgttctgccactcttcatttgctcatgctttccttgcagaatatggactacaatcatcttattttcaaaaaattcttcaggtaattctgatggacagtttctcttgtgaaccactatcctagatcatggtagacgaatgaatcaacaggcctttgaaaattgccattcattgatcccaaaaagtttttttatataccagataatttccctccccatattatagcaatactagagactgcccaggtttccttaaggaagttcttaaattagtgctactggttggttggtggtggaggaaagcattggtgggtgtatatttacaaacaattacacaggcatgtagtcatgtacacaactcttgtgactgttgataagatgattagtttatgatcagtctttgtctttgattcttaatgcttataatggatagtttttgtcatttttctccaagacagtctgaaaaaattaaatagttattttactttataaatggtaagcagtcagtacctgtttatagagggaatgaacaaagagtggtctggtttattcaggatttgtaccaaaaaatctatatagtaatttataaataaaggtagatctttgaaaaaaataaagataatctctagtctctgaaaatataaacctgttacataataaaaagttgttatagactcttcatttcttcttacctcttaagccaccacctctagacacactttgatcctctctctctcttcttccccccccccgagtggaaaatctcaatattaattggagctaagatgattgtactactgctgctaagacttcagcaggtctcttacaagctaatgtcacggcatggggtccatttgctctgtgtagctattctgcagtgcagtgagaattccttgattaatatgctacatgaaaataaaatggatttggaaaaaattatagcatactctcataaatattaattcacatttgtatggaattacacataattttcaatatactttggaagcaccttcagtatgaaagatttggtctccaaagagaatggcataatttttttaaaagcacagtggatacattattaagcatcatttgtttattaatctgatcctctacatgcatatgatgcagggcagtaggtgggttgtgtgacaaagaaaggagctttataccctgtggggagtttttatattacacttagaagtggtacaatttaatcacattatatagaagcagcccatgatggaactcacctggctccctctgctagtgttgccattattcctgagtgtctctttatggcagctattttggttaaatgtgagactaaacacagaacatttttgagctgagcagatgcctggcatagctgactgaggttgtggacactggacaaaggaattcaattcagcagccattcattgaacatttactatgtgttaggcatagcatgcaaggctgtgaaatcaatggccatgtgcgcttgctttgatctcgacttgtcccctgaaacacttttcaccacatcctcattgcctcaggagagctacctctccgatggcagagggttaatcgtctgcagtggtagcagctggaagttaggccagaagctgcttatttgccttgtggactgttatctttgatatcttcttactcttaaggataaggcctttccccttttctggggtttcttgctgtttgctgtgatccttcgtgtataccagcagtgcacactagattccttggtttcctgcttctatcaccctttctggcttgctacactgtatgttagagacagcttagactattttaaagtcagtattgtgctttataggtttggatgttttaactagttgactcctttatttatgtatttattgactaatacattggccacctactatttgcctggtttatgtgaagtacttatgtgaagcactgggattactgagatgaactacttagtccctcccctctttcacattctttcaagagattatgcacccagctgcctcaaggcctttgcacaagctgttctctctgttcagcctttcagatctaggtcaaatagcagtcattttctcagctctaaccctctcctctggactatatcatttcccttagttttagcacccataacctatcctttagcgttgttaactcagtttgcaatgatatatttgtgtgatttgattagtatttgtcctgtaaattctaggctctatgagggtggtgacttttccccacaccattatcatcctaaacataggtcagtgctacattggtacttggcatgtactgggcacacaaaacataattgttgaatgagtgaagacctgagaatagagtactttgtattacaagaaaggtctccctgagtgggcaacactgctaagagtcactgaactagaaaagggaggagtgtgtaagagaggccttttgaggccaaggcaaatcagtgtaaaggcctgcgttagtttgtccaggctgcattagcaaaatgtcataaactgagtagcttataaacaagaaacatttatttctcacagttctggaggctgggaagtccaaggtggaggcaccagcagattctgtgtctggtgagagcttgtttctcatggatggtacctgttctcacatggtagaggggcaaatagactcccttaggccctttataagggcactaatccccttcatgagggttccaccctcatgatccagtcaactcccaaagtcccccatctcctggccaacatggtgaaaccccgtctctactaaaaatacaaaaaaaaaaaaaaacaaaaaaaatggctgggtatggtggcaggcatctgtaaccccagctactcgggaggctgaggcagggaatcgcttgaactggggaggcggaggttacagtgagccaaggtcgtgctgttgcactccaacctgggcaacaagagcgaactctgtctcagaaaaaaaatatattctggggagacacaaacattcagatcataacaaggctcaaggtctcagactaataggaatggctgatttggggagagatgtcagggagtaccatgcatgtaaagttgggagtgctgggatattgcagcagaacagtgagaaaattggatgtgaaagggaggaaagagagcggtattttaaggagaaatgagtaaaaggaaatttctattttggttttgttttatttttaaatgtacatttagatagtaaaaaatttaattgttcatttaaaaataactaaaataatataattggattgtttgaaatacaaaggatacatgtttgaggtaatggataccccatttaccctgatgtgattattacacattgcatgcttgtatcaaaacatcttatgtaagtcataaatatatatgccgactatgtaccccagaaatgaaaaaatttttaaaaagttcatttaggactgcagaaactgaggaagtgtggtaaggcttcatgagggggattttctgtgtaagaggattagatccactagtttccaaataactgagtgccaaaacattttcattttattgcttagtgtgtgcatcatttctcacagggcagaggatatttgcatgtatgtggtttgtttgatgttctgagagcccattttgcacgtggtctcagagttgtagtgacttactccacttctgataatgaataatgtcagtgtccggacactaaaagcccagtctgttggaaccttggtgtgtactgagctgcctggaggcacagaactcttatcaggtcatgtggcctgaaatgcttacctgtagtttctacagatgcagttccccattcaaggacattgatttcccatttcctacccacctcccctcatccccaaccacacacaggaataaattaaaagttgctgttgatcttggtgataatattgttgttacattttgcaaagaaaatggaaataaaggatgcttagaggaacatgtaaaaaaatataatgcattaaggaaacattttaatcatatgaatagacagttctttcttgctggctcacatccacctggacctgataaattcagttgggtgctatttcttttgaattgagcatgcacttagtgctcattttctgaaacataattgatgtaccaacttgggaaatgagtgtattgcacttccttggggaaggtcattgtgtgctggacccagcaccaaatcgaacagaaagctgctatcccagggagcagtgaaatcacttttgatgcatatacttgtgttttgtttagttttctgcccagtaataatagaaaggatatatatatttgtgatggcattaaggattcaggaaaattgagaagccatgtttcttagttttgggtcttctcatatcccactttcctatccctctcccacttagtagtaacaccctttagtatttagcctatattttgggtgtgaccctagatacctttgtaaccaccacttccctttccttctcttcttttctacagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacaggtgaggaagcttgggttcgctctttcctgtggcggcaaaatcccttccttaggtgcttcctccactgtggtttttcgtaacaggtggagaagatatccttggtgggatgctgaagtggttgtccaacaaagctgtgtgcgtgcctttaaaagaatctaaaacccaatctcagctctttctatgaggatttgaaacttcagcatggtgccctttcagtcagatgtgctttatgcaacaaagcttgatgctaagtggtactggtatttagggcagacctgtcttaacagttgtcaagatggactggcttgcaggggagagatctttgcaattaggataaatggaacaggtggatttcatcacatacattgtgcatctcatggttctaaggtgctaaaatgattgcctgtgtgtgagaaatgccttgctaagatttatattttccggggaagctcagatattgtggcatctgggagggcaatggcaaaaaatgaatttgccttttggtgtcttagttgttctccataggctataattcaagactatctttgtgatctgttgattgtatgaacgtctgataatgaggcttactggcctgttaataattaggtttcaatgatccacaagaaagtatggctcttggcatttgggaagcctttctgcctgtggaaatccccacatgagatggattaataatgagatatgaagctgtttatagcagtttttctgcacaaatccagaggcttcagtgcctgtcaagttagttacctgtgtcctgggtgtgttttatttatttttggcaggaccattgggtaggattgactatcactgaagaaagcagaggaaggaattgtggtgtacagagcaggtgctgctaattagaggtggaataggtaatttttggtttgcagatgtttctctgcagaggcagggagatctgggatcaaacaaaacaatggttcccaaaccacacagatcttgagaatcatataatgagagctactaaacctaaatttctggcccctctttaggacctaatgacatttgtagttttagaaagtttcctatttgaaaacagtcagcctggttggaagtcactcttacaaagaatcaagagtgtatttgggtgatggtttttagttaaaagattggaaagatcaaaagcctcaatatgatgtagtgggcagtttggtgtcagaattctgccttatacgtagtgaagcatataatcctggtaaaacatctggggtgatgggtttcagatggacccagaaggcttccaaggtaatgcctaaatctgacaaccagcacagtgtttccaaaggtacacttgtgtcctgaaacgccagactggagttataatagtaattattaacatttacctaatgcatactatgctacattcagtgagggagtttttatagtataacctataatttgtacaacaaccctgcctagtaggtaatatcatggttacttaacagctatggaaacgagggctcaaagagataaagtgacttgtctgaggccttgtcaatgagggaaggagccagggtttagacccagatatctctagttccgtggtttgttctgttttccatatttagatgaagttttatttatttttttcttgatagggagttggggagagggaggaaagcctaagttctataaaaggtgatgttcctgtggtatttgtgactcctaactcatgcctctgtgtgagatatgtgagaaaagtaattaatctcagtggagagagattgcaatgtaaccacccccctctccctcaggcccccgccccagcagggtaagaaggaagccttcttactctgagttaacaccaagctgcggatcctcatccttgaatctttttcttctagacgtgatctgacttttctattctgtgtcctcagaattattctttgtatttctttctacttcttcgagactttcaaggtcctctggtgacagagttttatgatcggaaaagaagactaagacgtaacacatcttaaatttgagtagcttttggtcttaatggccaactctcttgtactaatggtatttgaaatcaaagctatctttgttttaggtaacatatttgaaaagcaagtattttgactctttatgaatcatggagaaggaaagcatgaattgtatctttggccctatgtaaaacttttaaaaacaaggagtattttcttaccttcagtgttgatgccaaaatatgttatccaatcaagtgttatatttctagtaagaaggaatgcagaaggtgataattgagataaggccataatacttctcatttttaatattcttagaatcacttgtgctattatgaaatcccaaacaagtcaccatctggtaacagcccatctggaaaatgaagggcttggacttgaatgtttcttaggctcctccctctgggtcccatagttttttaaatttatgaataacacaaatacagtgttgtaaaggtctgtaaaggagtctgtaggtctgaaggtaatgccgttttggagtcagtctgtaactgataggctctgtgaagacatttatttatttttaatgtttttttttctttaaaattttgttttcatgtaatatgaagacatttaaaggagaagggtaagatgcatttatagtaggagggaggggagtggtccattgtgtgtcagtccagacaactgccatctgttatgtgatcattggtaaaaggtgacacatgagtgtttaatgaccatagtagatgttcaaaaagcttgtctgaagaatactcgtgattgctttcctatcatcctagatgcctgtaaatatcacaattactttatcgcctgcgtttgcctcttatcaggtaaagaaactgaatctgaccatcttagctgggaggggaccttgagatgagagtgagctttgaggagcatttctacattaatggattgtcatttagtgcctgttattgagaactacagatgaaatagggaagaggcgagaacttagtctttatttctgacttggttagaatgaattaggtttgcatcttattaggaaatggtacttcctgagcagacaacttaatgcacagctttcctgtaattatgggaagatgttactccttagtagagaggaaagaataggatttttttttctgagactccgttgaaggcaactgatctttttactcggagggtgcaattataatacttttataggaaagatgtatagttctaaaaccaaactgcttattctttcacttgcctggttgtaaaacccaagttcttgtgatgtttttccatactaccaaaagaaagcttttaaactgacacttatttgttggattatgtttttaagtataaatacatactgccttagaagatgctgaggtggcacctgtcttggcaaatggttgcactttttgatatgagaaatttgaatacttttcttacttcccaaaggggttaaaattatgaagaaatcaataaattacctcttatacaactcttatacaaaatagcgcatgtctttctgacctctgtaaatgaactatttgttcatgatgtaagcacttagacatgatataaaaaaagttttatcatttacttacaaggacatggtactttttttttctcaatggagatttgggggtgggaaaagcaaaagaggttgcacatggcctctccttaaggagctttattctctaattgggagaccaagtcacaatgaaaccactcaggaacacaaggaagtcaggtgtcgctaaaccgataagccaaattataacttcctgagaagcactttgggaaaacttaacccttcccagggcattgagtttaatttcagtatatctgacttctagaccatggagaattcttaaaaaatttaggactttgtagtttaaaacacacagagagcaaaagggttttaaaaatagagtaccaatgatgaaaagttgatgagcattcagagaactctcagatttggctctgactggatttctaaatctccatttagtccattagtctgtcctttctctgtagtatcaactgagccagaggaaataggcttaagtgagctagaaggcatttttaggttatatgaactcttctaacagacaccaagatgaatcatcaaaataaatcctgtggtctccctccttaactgaattttaggtgccaaaaagccattcatcttagggcagaatttcctaaagaaagaggcaacctgttgagattgctttagtcacaggagaacatcattttagaggaaaatggaggaatttgtgaatatttcaggagcctgttagtagactctaaccttgctggtaaggatggcttatgtgggaatgtcttatgtggtttaaaaatctttatacaagttgatctgggtaggtatttctttttaggaataaaaatttgctcttctctctctgaaaatccagtatggtgggagatttgtagttgacattgtaaactgtagacaccaaaagtgtctactgctttctaggaagaagaggaatccatcccagtgccaggcatttaaaattagagtgattactagaactctgcatggttgcatctgcttcatgtattgacattgtaccttggtcttccttggagtaagtgatagtggtgctatagacttaagagcccaggtgactgagccaccctctcttcccacctgtcctgatggaacagtctatcccagcccatgctctttcctgttgagagtgtttgctaccagaggctggtcccttatttcagcacgacttagacttactgcttttgtctgaagagctttctctaaatttgttactagtagaaattaacttgcaaaggaggatttataatggaaaactttgattaaacggatccagttcaagtctcgtttctgaagatctgctaattagttttggatggaaatctaggccaaaaatcacacaggtatttatccagcttgactctagagcctacaggtttctggaaatcagagcatttgagacacgaatgtaatttgggattttactgtcataatgaaaagacatgaactttgctatgtgctctttcatacatacttttgttataatatttagatgtctgctggtaccttgaactagtattaagaatgtcagttaaaccgtttctacctcatacttcaaaatttcaagtttaccatgttaattgggatttcatttgctttcgaaaaattttgtagtcatgtgaaggttacaagctaaggtatcaaataaaattctttatatttttttcctttttatgaatttaagttgcatactactttttccccttgcctaaagtatagaaataagaaaaactgtaaggaaagatggagggaataaaagattggcttatgatctctctttggaatattgattgacttgaataagagtgagatgctagttttaacatcaggtaattgaagaaccccaatctaggcttgtctgtgttcaggaattactcacgtattgtattggaagtattggtttgtaactgggattggtaaacctgacactaatataataatgagttatatgaaaggtgttttgcttttgttttatcttgagcatttggaaacaggtttattcgtgtttttcattttgtgtcttttgactctatactttgttgctgtgagccctgaatgttgggaatagtgagcataaacatcacttaacttcagtgagatacatctttggaatgttatgaccagtaataattttatcctaaatgacatttgtaattttaaataaaaatttagtaaaaattgactatgaaaaggacatagcatatgtattaggattctctggagagcaagtaccagtagaatatatatgtgggtagataagaggggattcattcggggaatttgttcacatgattatgggggctgagaggtcccataacaagccatctgcaagatggagaccctgggattcacagtatggctcagaccaagtctgaaggcctgagactggggtagtcctcaagtccaaagcctagagagcctagagtttagatgatcaagggcaggaaattatatcccagctctaggagagagagagagaccatttcgcctttcctctgtttttgttttatctggacacccggctgattgcatggtgcctgcccacatggagggcagatccttccctacttagttcactgagactcacatgccaatctcctctggaaacaccctcacaaacacacccaaaggtaatgctgtaccagttctctaggtattctttaatccagtcaagttgataccctaaattaaccaacacagcacattaactaccacctcataaaataaaacctgcagagagaaaataagctgaatgggaaaaggaactgcaatgaaaagaatgggccataattcagcttgggtgatcctgatacctacaggagttgttccataaaacagtgaccttttatatttcccaaagtaagaaaattttatatgtgtatttgtgcatgcagaactttattaagggccatttaaatcccatatattgatagaggagttaagaaagataaagtgacaggagtgattctcaactctggctcccataaatttctacaatgtcagtgattgaagaatgagggagcacatctttcctttaataaggcctagccagtacacttttggtagttgatgagggtaggacagaactccctttctttatttgaaactgtgtatttttgtgctgattaaattttacatttttccctcttgtgatgatataaagttatctgcatgtggccagatctcagctaaagaacatgaaataagcctctgtacattctgcattctaatctctgttcacagcaatcttgtatccacacaagtctgtacatgacaggtaatgagtgggaagtgggaggagatgggtgtctgtgtggtttgcactggtggtggtggggaactgagcagatggttgtgatagccacatgctgcgtgattcccgtgggagttgatggtggtgacaggcgactcacaatgtgctatttacagtttgggtttgcagtctttcggtgacatctgaatgctctttagcaactgctttcattactgcctttcgaggagctgttaattgaaaatgaaattgtgggtgggctttaagacaggcagacgcaggcaattctgtgtggtaaatgttgcttgagaactgttggatgtcttcatgcccaatttgtaattcattttctaagactgtaaaagccaaaggtgcatttggagattcagttatgtatatacataggcagagttgaatgtcacaccttgcccaaagggtcaaacatacagttattggtatgggtgctgtggttcacgcctgtaatctcagcactttgggaggctaaggtgggaggattgctttgagcacaggaattcaagaccagcctgggcaatatgatgagaccttgtctctagagaaataaaaaaattagctgggcatggtgacgcatgcctgttgtcccagtttcttgggatgctgaagtgggaggattgcaagggcccaggaagttaaggctgcagtgagccatgttcacgcaactgcaccccagcctgggcaacagagcgaggtcctgtctccaaaaaagaaaaccacacaaaacacctatttgtctggaaaccaacctaggggaatgcttggcaatcccagctgcctgctcatgtcttacctttgtgtagttctctttaaatgtatacaactgtgtgaggttcttatgtaaaatctgctgacatcttgtagtgttctctgtgagtttatcgtaggacttcatcctcctttcttcctttagctcttcataaagttactatgcaggagtaaatggttatttgttctcttgaactttgggatacatttttccttccgtatccaaggaggattctttccaggactccccatggatactaaaagctgtggatgttcaagttccttaaataaaatgttatagtatttttatgtaaccaacacacatcctctcacaaactttaaatcatctctaaattatttataatacctagtacagtgtaaaagctatgcaatttgttattatattgcattgtttaggcaataattacaagacaaagagcctgtgcatgttcagtatataagcaaccattgtaggccacatttttggtctgccattggttggatccatggatacagagggccaactgtatcatattcaagttcttacatataactttgtttcttgtaaacattttcatatgatacaactctgttaaaggcagttggagcccagaggcaaacaagagaagaaggaagagagagggtggattttattggactttgacagtggttgatgatcttgattctcttatggctgcccccagctgcaggattgtgatttgtttcttatcttcagagttgtttgctaaagcattagtagcattactgaaatggtagcttttgtaaatgtttatatgttgaattgttttattgcccatagctttgcacagaaatcttgtgctgaacaaggaatgacctccctcttggaagtgctgttaactctctttttaattaaatatgaatatagatacaatataactgcatttttttagttttcccttgaacatttcagtgaatactatctgggacaaaaccgtgctgaattatacgctttcactactatcactctttgctcttagagagcccccgaggcttggggtgaggagacacaccccttgctgtacttaaccctcagtcccattagacctgctttgccacaggaacccagctgttttaatgcatttgagttgctgttgggtcctaatgatgtttaaaagaacctgtcttggtattctaaatgaactctggagcattgcctattgatgcaagtgttgatgattttatatcaggcagatataactttgttatttactctggggctttttacacctaggggtgtgcatcctcacaccagtgctcacaaagacacacacaggagcagaaaccaaaatagctcacaaatgtgggcaagtcctgtgggggaccaccttatgtctctcaggaggcctgatgagctgtgccatgtggccttctggaacattatacctgcattcattgatcacagctctgcagaagctgccacttctcctatgtgcctgcctgcagtgacgctgatgtagcaggtcattctgtaatcactgtttgcacctgcatttgctcaggaagtgtttgctcatacatcttgaaatcatgtattacaaacctggacaggtcctaattgctggtgatggttctgagaggttgagattggctataattagatggagaagcaattagctacatattctgagtagggaacatacagaataatgtttctcaaagggtggtctttgaacccctatgtcagagcaactgtggatcttttgttaaaatgcagattcccaggtaatcaccttggcatagtccattgggtgggggtcagggtgtggcaacaaggaactggagttccttcagtgactccagtacaggtgctgcaggagccatatttttaaataaactgtacttattttttattttcaattaaaaattgcaatattgttagcaaaacttgggaagaatcataaaattgtaacaacatatcttgcggaaattaattttatcaataattggatcatatttttgttctgtacatttactaattgagttatcttccaaaatgtattggcaagaaagaaatgtttctgccagatgatgtagacattatataacaaaaaatgatgttttcaaaatagctactttttctaggtgtttactagaatggacctgatagaataattgtattctagtattctctccttaggcccactggctcactcaaataatagctgtttataaagatgctaaccggagttttttatttttcatttttttaaagttctaatttcttgttttttcccatctgtagacaatgatgatgagctcttaaggtttatacattttttgaacccttcaaattacaaaagttggtgatatttggtactgggggtcaagtgtgaaagaaatctgaaaatattgcccatatcagtggagactaaaggccatttgttattttcttcattaccagcaaagcttcagtttaataaaaatattataattgaatttacgattttgattccacaaattcaaaaagaaatattttcctttctaaagccaaacagaataaaaattctcataagaatttttgtttaaatagcaaaacctattcttaggatttaacaattgcctgaggtttgtcaacagtaggtagcattctttttttatatattgctatgaggccaaaaatgctattttcctggagattagtgcaaaataatctaccgaatagttgctaatgaaattatcatatgagaaagattattaataatgacttttgattttaaaaaatactatcatcaaattttcctaagaaatgatgatgagaaaagcagttttgaaatacaaagctgggtggtagtgggcctggtgtgcactgctggaaggttgcatggtactttgtgaaacttcagcagcccacttgcataatttatcattacctgtcccctacctctctctacttaattctgaatctgtatttctcagataaacatggcagtaggaaggatagggaaaggtgttgaggggatgtgattatatggatgtttttgaaggggagtatattggtgtcatgggatccttgggatgtcatcttgccagctggaatcctctgtggcaggggtaccttctctctgagtattgctcatgctcactgggcactgggcttgttctgcccagttggcccagcaggctgcacttggctcatgctactggcccagatcccacacctgccaagggcgagccaggcgtagagtggcaaggggtgtgtgggtgagtatattagttcttttccacgctgccaatagacacatacccaagactgggcaatttataaaaaaagaggtttaatggacttacacttccacatggctggggaggcctcacaatcatggcagaaggcaatgagtagcaggtcacatcttacgtggatggtggcaggcaaatagagcatttgtgcagggaaacacctgtttttattttattattttattttttatttctttgagacggagtcttgctatgtcacccaggctggagtgtagtggtgtgatctcagctcactgcaacctctgcctcctggtttaagcgatcctcctgcctcagcctaccaagtagctgggactacaggcacctgccaccacgcccagcgaatttttgtatttttagtagaggcagggtttcactttgttgaccaggctagtcttgaactcctgacctcgtgatccgcccgcctcggcctctcaaagtgctgggattacaggcgtgagccactgcacctggcctgaaactcctgtttttaaaaccatcagatctcttgagagttactcattatcacgagaacagcatgggaaagacccccatgattcatttgcctcccactgggttcttcccatgacatgtgggaattctgggagttacaattcaagatcagatttgggtggggctacagccaagccatatcagtgagtgagcctggggtatggccactgctcacagccaggcatgcctgctgctgcggcagggtgggcagccccaggcaccagaacaggtgctggctccatgcaaggctgtggctggacaagatgtactgcatgtggcttccactgtgggcacccctgtctggatgagggcaacaaggtggcacccagaagcttggagataccaggaaccacagagccccaaagagggtgtcacagccctgcctcagggagcccctaggtctgggctccctaaagggccgcagctcttctctccttctcattaactgcaacgtggcgagcaggggggaaagtgtgtttcagccctgtttgtgttacagctcatcagtgctgccattcaacaggtctcgagttcatgtcccatgcctaggaagaatgaggtacagcagacaactggagtgtgagcaaggcagagaggagctttatttgatccacagaacagctcccaggagacctcaagtgggtaactcctttccacaggcaggtcatccctatgagtgtccagctctcagtggagaggcgagccgcagtggtagctcctttctgcagctggtagtccgatgtctgtttgagcctggctgagtctcgggtttttatgtgcttagaagggaagaagtacatgttgattggtccatgggcaggcctggaaaaagcaccatccgattggccaaatggtcatcaatgaagtcttcactctgggcggcagactccaccgggaactggcaccctggccgctaggcttcaggttgtccctggcttgaaggtggaatttcactggggacctgtccctttctgccctgaaacctgtctgcctcccaccatcaatgtgccatccatggcactcaggctgttgatgccaagggacacctgtaggcccacgctgagccaccttcagtcctaccttggcctccctcttgtgctcatgggtgcccaaaatctggagggggtgctgaggtggcagggggctggcgtgtcaatgccacccgagtgcatgcatgcctggccaggttgtgacagcactcaggcttagcctcaattttcctctgaaatcagagtgggctccaggtatggggagaagccaggtatggggagaggccaggtagcgagagtaggcacttccaagactgctcgggcaggggcacttccccaggcgcctgagagctcagggatgcctgggtctggagccacagctgggcagctgcatgtgtgcccaggagcatgaatctccctctctgccaactcagtggagggtggggctcctgcctgttcctggccccagccggctcctcagagcatacagccccggctgcagccagcatcttggcagcggctgctccagacaggctgccactgccatcactgggaccatgtagggagtatattagggctgccccatggttctccagatagactaaggagacaaattgacatagtacagtattagaaggaaagaatatggagtttaaaaaccgttttcatggtcattctgcccctgctcttctcttccccctttcaaactgagcagacccatatttctcctttcatctctgtccttgagcctaccttcagctctttggctttcattttactccctccttccacccagtgtcttttgctagcttcttgacccagccaggattgcatgggacatcacttagatctgctctcagagtcacaaaatgcctttgcttcctgtttccttgttccttttactgtgctggttcttttcggtaaacttttagatttatcatctctagattagtgcagcattatttagctcattgctattgtactctggtttaaaaaatttcagtgaccatccacagccatctaaataagattgaagcctcttagtataggacattttaggccctgactaatcctgctgcaatgtaccttcccagttgcctttcccactctctgtaaacaccaagctgcaactacaactgctatttggatgaaccctgtgttttctccacattcctgtgcctgtgctttggctattttctttgtttagaatattcttttttgacatatttgtcttccattgactagttcagacccacttcttccttgaagtttttatgatctttttccttgtaagtaattgcattgtcttcccaactcttatgatcctttgtttataacaagggtcaccccagaatttatcagctaatttaggacattactgggaatgaaagggggaaccattaataattaccttggaacaataagcattaatcaggacttcctgaaaaactgggatatatagtcactctgtaattcacttttggcctttttcataccatactctgttttgagttggaggtatacattttcttctttccactgaaatgttgagctcctcgaggacctcactgtgtgacacagcaaggggcctaggcttatgtcacatattgggaaacaacacccttaaaaccactgctatcctttactcgaggatacccttctcatatttatagtttccattcatgtctctttccagtcttttctccatatgctagccagagtgatcttttaaaaatatacatatgatcatattattcccacaagtaaatcctctcaactgcttctcagggtattcagattgaaaatcagactcccatcatctgcagtgcccagttatccagtgctgtttcttcagcttcatgtcatgcttcccttgcttactggctccagctcccgaccttccattccctcccacatgccaagttccttcgtaccctggacaccttatgctatcctctttggaagaaatggttccccctctgttttttgaatgatgagatccttctagtcctttaggcttgaactgaaatgtcatctttcataggggcttttctcgaccatatggtttatttaactcaggatctgccatttgtcttctgtgttttgcactcacctttttaacttcctaacaccacatttataattatagatttttctttctatgtccttccttatgtctgcaccttctgctgcactccaagctctactgaggagagatatcacctccaccacagtgtttgtagcacattgcctggcacacagaaggtggcactcaataattaaagttgagtggtttgaataatttttgcaatggatgacattgctaattccacactcctgttacattccaactttaattggctacaaaaaaaagcacacacacagacacagacacacacacacagacacacacacacacacacacacacacacacacacacacaaacaatccagaccccaatacagtatgactgttgtcttctctctctggggatatgcaatgtaaaataagatactgatgagcgcatgctgcacaccaagcaaaaatttatcccaagcaacccctgcgccctgcgtggaccgtgtctgctgttctcccatggaatctatcagcagtttgtcttcccagggttgtagcctgtcaggatggtagaattgctagtgcagccaggaaaagctgacctaggaaaaccatagccttccatctttttagaggtaatccaaaagagactagacaagcagaaagacggagaggaaagttggtgggagtgaggtgaaattcactgagtactcttttatatgcaaatatttgtgtggggctctacttttttaccatgagtacaaactctttttagtatcaatgcatgaatagcgtgtcttttcactgaaaaattattgtcccacgtgccctcggtttaaaatgttttgatcttagaaaacagtttatttccttttaaagtggcccaattaattcattttccacatatttgctcattgagcaaacatcaactgaacatcgtttgtgtgcaaaccttatacaagaaactctgacataacagggaggatatgtttaatgataactctgcccatgatgtgtttatggcttgctagatccattctgacccacctattgtgaagagttcatggagagctcttaacaacaagtgaggctgaggctggcagattaaatgcagttcaaagggagacaaggttgaacatctcctagagagggaataccttcagagatacatattaaagttctttaaaattgtttctttcttattgtgccatttttgttgacctcccttctgtccttttaagaaacttttgagaaaaatgcattattctaccgaaagcatcggcaaatgttggaaatagtattttgtgtatcagttttcttggctgcttatttttaaaaataaaggcttaaataaggttcgcacatttttcactcaggtgcaatttactgggaattacctggcgcattggttttatgcttaatatttacagattattaaaatctcagtggctttcaaactgcatggaccaagaaaataggtgtattttctagaaatggttttgcttatggacactgacccactttgaaacgacttactcttggaactcttagtacaggaaagtcttatgtttctgtctagaggtggaactgtttatgataaatagaaatagctttccttttctatcatttctgttttcttggaagtagattatttttgatgcaagtagaccttcagaatttgaatagaaatttttatttatttatttatttattgagacggagtctcactctatcaccaaggctggtgtgcagtggtgtgatcttggctcactgtaccctctgccccccgggcttaagtgatccttccacctcagcctcctgagtagctgggactacaggcgcacaccaccacacctagctaattttttgaagagatggggttttgccgtggtgcccaggctggtctcgagctcttgagctcaagcaattctcttgccttggcctcccaaagtgctgggattacaggcgtgagccaccgtgcctggccttttgaataaaaatttagacttcagatttatatagtgagtatactgatgggagattgaacaattacgtgatctcaggagtagattatagagctgtttctaatttactatcaagttatttttttcccaaaagataatttataaactgcttttttgtttgtggaaatcctgtttgttaggaagtgttacaaatggtagtttcccagtgaatttatcaaaatgctgtttattcaataacattcactcctccaaggatactactcactgtcccttgacattcattcattaaatatttattgttcatgtactgctatggacagacataattttgggtgcttatattagtgaacaaaataatgaatacatctgccctagtggaagttacattctcttcatatattaaattctcttagtagtatacagcttccatttaaatgtttaacccagacctttcttctcaacttctagattcataaactcagctccttatcagagttttgctgcctagatcattcacaaacatttcaaactcagcatatctcactttgaaatctataatggtggtccccaaattgctcttcctcctcaatttccttccttactgtgtgcaccatctgctaagcatccaagccataaatctgttcatactagaaacctgcaagtcaaactcctcttcccctcttccccccattcttacatcctatagatttttatcctatgtatttcttatctgaccctctctcttcaatgttttctatccttcctgcgagtgcagtagttcaggttctctttctcttggaggtgtgatgactagcttctcatctgacttctcagcctctaatcttgccactgttaaattctgctcctcaaattcctccattattgtgttcttgacagcatgcaaattgaatcgtgtcatttgtttcaagagttttcattgactttacttataggttaatttcaactttctttatatggtatagaagcccacacatttttttgttttgttttgttttagagaggatctcactctcttgcccaggctggagtgtagtggtgtgatcatagctcactgcagcctccacctcatgggttcaaaatgtccttctgcctcagcctcccaagtagctgggactaaaggcatgtgccaccacacctggctaattgtgtgggtttttttttctttctttctttagagatggaggactcactgtgttttctaggctggtgcccacacattttaatgcctttcagagcattccctttttttttctttttttttttttttggtgcttcctaatcccatgcccctatcacatcagacttaatctattttctataatgtcttccttcacccactcctacaaatctgaattttttttttccttcagtgagtctgatcttagttacatgtgagaaatgtagtcctactaaatcagaaatggactatactacctcttagaataacatctcttgaaagggatcccctatagctttaaggggcctgctggttttttgttaacatgggtgaattgtatagtggtaaaatctgagattttagtgcacccatcacctagtaatgtaggttataactacatattgtagtagttacaatatattgttttttgtccctcactcccctctcactctgccctcttctgagtctccagtgtctgttatactactctgtatgcctttgcatacccatagcttagctcccacttataagtgagaacatagggtatttggttttacattcctgagtcacttcacttagaataatggtcttcatttccaaggacacctttgttgttgttgttgttgttgttgttgttgttgttgttgcgacggagtctcgctctgtcgcccaggctggagtgcagtggcgcgatctcggctcactgcaacctccacctcctgggttcaaacgattcttctgcctcagcctccctagtagctgggactacaggtgcccgccaccacacctggctaatttttgtatttttagtagagacagggtttcaccatgttggccaggatggtcttgatttcctgacctcgtgatccacctgcctcggcctcccaaagtgctgggattacaggcttgagccaccatgcccagccccaaggacacatttttaaactaagaaaatgttcagtttgttagaatttaatgtggcatagggaaaggaaaatgaattttagaggaccagtcttttacaaaagattactgcaaattttggtggtttcgttcaaaaacgtaaaaaagatcaatttcttttttcataatggtagttgctggacccttgtattggtgtggccattggagattacagaagccttttgttactggaaataattttcaggcctcagagttgtaagtcaagaattgcctatactgaaccctttggagtcttttcattgttacgaggtaactttgcttatgtgtgaattaatgcttaggctttcaaagcaagaaaaactagacatgatatgaactttgtcattctgctaagttaatactgaaatgaaaacttttactgatacaaagacatttctgttaccagtaaattgtgtagactttgtgaggattttgagatgtgatttatattggcttattttttaaaaagctggcttaaaaagtgaccacaagtgtgctaaaaggtttatttgaggtaaccacagtattatagttcccctggcataattattccgtattttgtttccatgagtcaaggcacaaagcaaggataatcataatgattgtaggaaacagcgcttagagctgggatcctaggattttaatactaggatcttttacttgttgcagcttccacattcctttttgaaaagctttttttaaacaatattttttagggcacaggcgaactattttagcagaatgaagcagtaatttaagaaaaatctttatattcctgtccatttccacattctttctgaaaggctactcttgggggtagaaatacagctgtggatgaaaagattgaggtaaggaatacttttctcttaaattcttgtagcttgggtcattaactattgtcatatatgtcgacctagttcatggcagccagaggagacaaggtataaaattgactgggttgtgattcagagggggaaacaatggaaaatatattgaacacttttacattactgagaccccttctacacttttttcctctttggttttagactgtataaagtattgtgttggtactgtagatacagcgtgtggctattgatattgatataagaaaatctgttaaggttcctctttcagcagttatggggatcttcattcagagcaataagatcatttctcctaggtgttacatgttggcagactgaagaagacaaagacgtcttgtcttcacattgttttatggccacgactttgaattcatttgatcacttaagaggtatcgcagacactgtagctaattagaaggaagggggcagttttattgtgaatatgttcagtgaagaagatagcagtgtttgtattgcacaggctgtatgaacgtgtattttgttggggagagagagactgagaatctggattcttgggttaaagtttctaccttgctgctggcactttgtccttaaccaagttattgctgctctttgaccctcagtttctgtgattgtaccagaatgcagatgttgtattcttctaacactgtgaagatgttatacatgctggagtacttaaaattccctcttccttaaaattgagaaaaaaaagtagattaaaaaaactaggaactacctggactttgataatattaatattttagataaaccagcactgaagtatgtgatacctacaaagaacaacacctcaagagtttctgctttgtggtaatgactcactttggtaaaattatgctgtgcacatggttattagactactgtagataccagtgggtacattagattgaaaaacgtaaatgaagtggtcttatgtatacaattttttgcagttgccttttgttgggaagagattaatatgagatagtgtaacttttttgtttggggtgggcgggggtgggcatgcctattggtggtgatctgaggattgtaactttagatcttttacattgaaattatagaaatttgattgttatggataattcatggtgaaggaatgtaatgaaattattattattattatttttaatgactaacccatgttcctagatgtattcatttttggcttagctctcctctcctctcctctcctgtcctctctctttctttcttttatttttttttagagagggggtcttgctttgtcactcaggttgaagtgcagtggtacaatctcactgcagtctgaacctcctggctcaagcaatcctcccgtttcagtcccctaagcagctggtactacaggtatgcaccaccatgcccggctgtttttgtattttcgggggaggcagggtttttccatgtttcccaggcttgtctcaaactcctgagctcagagaatctacctgccatggcctcccaaagtgcttggattacaggtgtaagccactgtacctggcctgcttttcagtttttcagtaagtaaattgtgaggcatatatgttgattcttctggctttggaaaatccttccctataccctatttatgtagactgaatgaaattgataagatacagtattttcttcctagactgttcaacactggcgtgaaatggttcttgtgtaggactccttgccctcttccaggtagctctctttattcagtacatgttttacatgcattctctgtgtttcaaacctgagagatgtcagaggaatataagagatggtccctattttccagggcttcacctctgggttaattactttgggacagtttaaagtaaataaactgtaaaaaaatactcttggaaaagttggtgaatgatacgtgcttaatttttcactaatctccctcgtggtttttataatgccatgtgtttttcttgggagggtttccttacagctgtatttgtgatcttgggctagaatttatgagctgccaccatgaaggtctgcctctggctttggcatcagagatggcgagttgtgtggtttgttttcttattgttaatgtgagaatttttcctaatcaaaataaatgcctatgtgtttttcctgactttcttgttggattgactaaggaagttgtgtgaattataaaaatttcttcctgaaatgaaggacaaaatttccaaagcaggatgcattgagattgtctgaagaaatgtatgtcttctggttttagtatttagacttgaagtttttttttttttttttttttttttaaccgtaataactaggaaaagtagaaaagttaaaagaaacaaaaaacatcacggtgggaaatagaaggagaaaaccagacatttatgaaaaccattctggatctcacagatgctattaagattagtaaacgttggccgagcatggtggctcacgcctgtaattccagcactttgagaggcagaggcaggcagatcacctgaggtcagaagtttgagaccagcctggccaacatggtaaaactccccatctctactaaaaaatacaaaaattagccaggcttggtggtgtgtgcctataatcccagctacttgggaggcctaggcaggagaattgcttgaacccaggaggcagtgagccgagatcacaccactgcactgtagcctgtgcaacagagcgagactctgtctttaaaaaaaaaaaaaaaaaaaaaggccgggcatggtaggtcatgcctgtaatcccagcattttgggaggctgaggcaggcagatcacctgagggcaggagtttgagaccagcctgaccattatggagaaaccccgtctctactaaaaatacaaaattagtgggcatggtggcacatgcctgtaatcccagctgcttgggaggctgaggcaggagaatctcttgaacctgggaggcagaggttgcagtgagccgagatcacgccattgcactccagcctgggcaacaagagtgaaactctgtctcaaaaaaagaaaaaagaaaaaaaaattagtaaatgttgactagtctcagggatatttgagctgcactcagtaggctactttgcatttgtaaaattctcacacatcaaattgcatcatctttggctttttgatttcatgcacgcagtctgtgaaaggctaagccaggtatgtggttacatataaacttactaccaactagcgctgtcctttttctactccttaagaggtttattggggcaataaactgttggcattattactcacctagcataagctgatcctttctttgactgtttttaaggaagatgttgttttatctgctaaaacaggtagcacgagattgacttcaccaaagcctcttctaagactttagaaatggcttaagcttcgctgctttcttagcacttttactgtataggccctggtatgtggtattgatacatacagtaagtataaatgtgagaagagaaaccacattttcatgctcttaagtgatccatgctgttttcacttctcagggtgatttttggttgtagccaactcagaaactctcaatttaatttgagattgtgtgaattgctttcctagtctgtacaccagaaagaatgcttctctccttacacatttcgacacttcttagtgaagatcatttacttatagagtgtatgcattatattagcatatggcctgggtaacttcagacttgttaacatagcgtgggaaaggttactgaaagcatgaggaggcagtatattatctctcagttgattttgtacaccattttgaatattttctgtacattccctttcctctagtgttggtttcttatacttatagtaaagggaaactgatgttgatattgttcaaaaaagaaatgaagtgaatttttgtatttttaaagaataaattaacatgctttaaagtgcttaaccagttgttacaatatcagttatcacagattggtatgcgttggtccatgttatgtatttgcctgaatcaaccctaagactggttggcttatttctgccttttcttttccaaaaggtatacttgacatgaagtagactgtgcctgtttgattttaagttttgaatatggtgggaggtatagattaaagttaatttcttttgcatatggatattcaatttttctgaaggcatttttgaaaaagctgtccattctccacctttgcattgcctttgtacttttgtaaacaatcagttgtccatgtatgtgtgagtttatttctatactctctattctgttcctttgatctatttgtctatctttatgcctatactatactgtctttattactgtagcttgctttgtagtaagttttgaagtgagataatgttacatagttttggctttttaagattcttttcactagcgtatgacttttagaatcagcttgtcaggttctataaagaatctggccaagatgttggttgagattatattgatcgtgtgatcaatttggggagaattgacagtttaaaatattgagttttcaactctcgaacaaggtctatctctctatttagatcttacttatttccttcagcaatattttgtacttttcagtatataagcctttcatatattttgtcagatttattcctatgtgtttcatatttttgatgcagtattaaatggtggtgttttttaactttagtttccagttcactatcaatatgtagaaattcactgatttttgtatattcacttgcattctgcaaccttgctaaactcacttattagttctagtagttttttttgtaggtcttactggattttctacatggatgatcatatttttagtgaatagaagcagcttatttctttcctcctaatctgggtatcttctctgtctttttcttgtctgatttctctgtcaggaacttacaggatcatgtttaatagaagagacaagactggacactcctgcccttttcctgattttagggggaaagacagaatcttttgccattaattctgagcttagctatacgtttttcatagtgccctttattaggttgagaatgttccattctaagtttgtcagaattttaatcaagaatgcatgttatattttgtcaaacaccttttttttgtctatcaagatgatcatatgatttttctttttttgtttattaatatagtaatacattgattggtttttaaatgtgaaaccaaaatgctttccttggtaaactctatttagtcatgatatattaacttctaaatagattgttggatttgatttgttaaaaatgttttaaagaatttttacacctgtgttcatgaataaaaattggtctgtagttttcttttgatctatttgtctggttttattatcagagtgatgctggcctcataggaaaggtagggaaatattcccttttcctcagtttcttagaagagtttgtgtagaattgttattatttcttttgtcttttcttttctttctttctttcttttcttttttttttttctttttttgagacagagttttgctcttgttgcccaggctgaagtgcaatggcgcaaactcagctcactgcaacctctgcttcctgggttcaagcgattctcctacctcagcctcctgagtagctgggattataggcatgcgccaccacgcccagctaattttgtatttttagtagagatgaggtttctccctgttggtcaggctggtctcaaactcctgacctcaggtgatccgtctgcctctgcctcccaaagtgctgggattacaggcatgagccaccaggcccggcctgttatttctttcttaaatgataggtagaatttgtcagtgaatccatctgggcctagagttttctttctgtggaaaggttttaaatgaaatattcatgttctttactaaatattgaactatttatgttatccatttcttcttgagtcagctttggtaatttatgtcttttcaaggaattttttcattttatcaaagttgttgaatttattggcataaaattcatataatattccttcattatccttttatatctatagaatctatggcaattctatatctgttgatagcctcctttcctcccctcttctctctctgtcatatcagtatgactgggagtttattaattttattgatcttcttgaagaacaagctttattttcattgatttttctctgttgttttatatttcattgatttccttctttctgcttactttagttttactttgcttatttttctggcttttaaaagtaggagctgagtttgttgatttaagatctttcttctcttctaatatagccttttgatgctataaatttacccccaaatattactttagcagcaccccaaatattctgatctgtggtattttcattttcattcagtttagagtactttctgatttcccttgtgacttctaattgaaacactccaaatattttaggggttttccagggatctttctagtattggtttattacattaaatcagtcaattaattaattaagagacaggatctcaccctgtcatccaggctggagtgcagtggcgtgatcatagctcattgcacccttgaattcctggtttcaagtgatcctctcatatcagcctggcttttaaaaatcttttgtagagatagtgtcttactatgttgcccagcatggtcttgaatccttgctctcaagcagttttccctccttggcctcccaaagtgttgggataacaggtatgagctactgaacctggcctggaattggtttcttatttaactccattgtgatttaagacagacaaacactttaactgggtatggtggtgcgcctatagtcccagctgcttaggagatggaggtaggaggatcacttgagctagtagctgagtttagcctgggcaacatagtgagaccttgtctctctaaaaacaaaaaacaaaacacacctagaaacaacattgcttgtatgacttgtatccttttaaatttattggcacaattttatggcccagaatatggtctttctttgtagatgttccctgagcacttgagaggaacgtaattttcttctgtagttggtaggaatgttctataaatgccagtcagcccaagttggtttatagtgttgctcagttttattatatccttacggattttttgcctgcttgttctatcaagagaggtatattgatgtctctggctataattgtggttttgtttctttgttcctattgtcctgtgctattttgaggctttgttatttggtacataaacatttagggttatgtggtattgattgattgatccctttattattatgagatgaccacctctatccctggtaatagtctttgctctgaaatctatctgtctgtctgtctgtctatctatctatctatctatctatctatctatctatctatctatctgcctgcctacctacctacctatatctgtcagtcatgtatctcactttattatctcttttaattggagtattttccattcaaatgttaggtttgagactttcatgttgccatttgttttttgttagtcgcattttttttccttaccctctttccctgcagccttgagaatgaataaagtatttaagatttcattttatgtcttttgttcccatattagctacaattattttcctcttttttttgtggttgcattagggaaatactatatatacactatatataataaagatatataaatatatataaaatatatataaagatatataagatatatagtatatataagatatatcatgtatatatagtatatacatataaagatatatataaagatatgtaagatatatagcatatataatatatagtatatatctatcatatctttatatatataaagatatataacatatatattatatatatacagtattttccctaaagcaccacgaaaaacaaggaaataaaaaattgtagctaataagggagcaaaagagataaaatgatatgttaaatactttattcgtccacaaggccgcaagaaagagggtaaggaaaaaaatgcaactaatgaaaaacaaatggcaacatgaaagtctcaaacttaacatttgaatggaaaatactccaatatatttatatatatatatatatatacatactatatatatctttaatttacagtggtctaccttcacatgatgttatatcacttcatgaataatacaagaatattatatttactcttctatttacttacatttacgcctttatagcctttatactgtcgatgacatgagttttacttttgtatttgttaaaaaggctacaaaacattgttactatttctgcttaaacagtgaattatcttttaaggatattttaaataattaaaaaaaaaatcttgtatatatccccatgttttcacaggatccttagggtgtcacttcgtcagccagaaacctctgtggccagcgttgcctctgcttcagtttttctcattcctgctgggctcattccacccactctgcccgacaggctgcgctcagcttgtgctaccaacctcggtcctacgccaagggtgagccacatgcagagtggcaaggattgtgtgagcaagtgagcgcagggtctggccactgcacacagccaggcttaacggctgctgcagtggggagggcagctccaggtgcccgcacaggtaccggccccatgtgaggctgtggctggaccagatgtaccacaagtggcttccactgtgggcaccaatgtctctggatgaggggaatgcagtggcacctgaaagtgcagagaccgccaggaaccacagagccccaaagaggggtattaccgggctacctgaagggctgcaggtcttctctccttttcattgcctgtggtggtggggtgttatcccatttgtgttacagctgtcttagtcttgccatctggcaggtcccaagttcttgtctcacatccaggaagaatgggttatgtggacaattgtagggtgatcaaggcagaaaggaactttattgagtgacagaccagctctcagtggagacctgaagtgagtagctcctatctgcaggcaggtagtcccagtgagtccctgagtctggctgagtccagggtttttatgggctcagaatttaggaagtgtgtgctgattggtccatgggcagccatgggtgggcctggaaaaagcaccattctagtggccaaaaggcatcaaggaacttctcactcggggttatggactccactcagaactggcagcccagcccacagacttcatgccatccctgccttgaaggtgggatttcactgcggacccaccctttcctgccttgggacctgtctgcctcctgccgtgatcaacatgctgtccacagtaaggctgtctgtgccaggaggcacctgcaggcctatactgagctgccctcagcagctccagcctccctcctgtgcttacacccaatgtctggaggggcctgaggtagcagggggctggtataccagcatgaccctgagtgtgcacatatgccgctaagtcataacagtgcccagattggccacaactttgctccatgctgcattaggcaccgagagagcagggagaggccagagaagcaggagcaggcacttctgagcctgcagggcttcccgagcccccaagaacacatggatgcttgggtctgtagccacatctaggcagctgcagctgcagctgcacctgggagtgtgggttcctgtcccgccaactctgtaaggtgcagggctcctgctaggatcacctgttcctggcccttgctggttctaagtgaacaggccttccccactgcagcgggtgtcctcgcagtggccaatccagacgggccaccattgccaccatcaatgtggttaccatttcttatgcccttcatttctctgggtagatcctatttacatctgagcgtttttcttttgcctgaaggccttcttttaacatttcttactgagagaatttactgatgatgaaatcattcagcttttgtatgcctgaaaacatcttcactttgcctttgttttcaaaatttttttctgggaatataattttagttggacagttactttttcttttagtaatttaaaagtgttgctctactgttttctcttagtgtttgccatgacaaaatttgtgtcactcttagtttctggtaatgtaacttgtctttttttttgactgcttttaagtgttttctctctagtgctgcttttgagcatttggttacattgtgccttaccctagtttccttcatgtttcttgtgctttaggtttgttgagcttctttgatctaggattcatcatttttatgaagtttggaaattttgggttattatttctttaaggttttttccccttctcttctgctttaccttttcagggactccaattaaccagatactagatagtttgaactcttcctagagtttcctgtgctactttgatttttcttcattcttttttctctttgcatttcagtttggatagttgctgtgtctcaggttcaccagtcttttcttctgctatgtcaaatctgttgttagtcctattcaatgtgtttttcatctccgacagcagtttcatttctaaagatttggttacagtgtttttaaaaatacttacaagtctctatttaactgtttgaacttttggaatacaggtacaatgattgtttcagtgtccttgtttgcaattaacctcagtgccacttctgggttgttttcactttattgattattctactcattatgggtcatgcttttctgcctcattgtgtaactggtgatctttggatgccagacattgtgaattttaccttgttggatgctaggtattttggtatttctataagtcgccttgagctttgttctgggatgcagtaaagttacttagaaaaactttgatcacctggagttttgttattggcatttgttaagggaaatctggaaaagagcttagtctaggccttggttattcctcattacttttgcaagacctttttgagtattcaatctaatcatctgtgaagtatgagttttttagtctctctcatgggaacaggcactgttcagagtcctgtgcgagtcccaagaaatgttctctataattcttttgggtgtttctttccccagccttgagtagcgtccccctgctttcgagccagtctgtactgtgttgcaggtgaaccctctgtagatctccagggctctctctctgtgtaattctcttctctctagtcctctatcctatgaaccccagctgccttgatgtcctcagactcaactctgtctcctcaattcatcgagttggcctggttctgccccagtttcatctcctggtattgcaccctggaaactctccagacaataaggtgggtcagttatagggctctcatttgtttcctgcatctcagagattactgtcattagttacttcatgtctggtatcttgaaaaccattgttcatatatttttctgagtattttttgttgtttcaggcaggagactgtatctagtcactgtttctccatcttgaccagaagtggttctcccatatttcatttaacaacatcatgaaatctctttcagccaagctcaagaccataatttgtccttctctgccttctcttttgacccaatgccttgttctttcagtcttgtcagttcttacttcctagtatatttgacattcttttgtacttaatggtaaaaatctttaggtaaacatcatcattattaacttacactaaaaaatagtaaaatcattggaatggagggaatattgtcagaatagttataagttttggtgccctatcccagtgccatctttaaggtgagtattcagggaatatttcttatacatcttaattcagtgtaaaatttgcatgttttatatgttgatagagcagaattatttcaggatgagtatatttgtttagatcttttaaaaaatgtatctttagggaggtttgtgcttttccagactgagccagaatgctcgtactgcattttggatttacacacacacacacacacacacacacacacacacactacttttttactttccagtttcccctgttacttggtgtgctgcttgaaaccagacttgccattcttacatctccagaacctcataccatgcctggcatagtggcactcaattaaggtctgatgatttgtactgagtaagctatagttttaggcttggagcattgttaaggctttgcatagaatctctgcattatacagaatcttaactgtctctacattacagtataatccacatctgcatctttgcagcttgctattatacatctttggtttgctgtgaaagagctgtcagagaatgagctctttattgcttagaattactagttaactattgttttgccattgatcagaatgtctcctttttctgttctgctgtattcattgtggtattttgttgtaatcagagatagtcttggaggtgcaagacttattggatctccgtttgtgccattgtcgcaacatcactgacttggtgaggatcagtcaggggtttcttccttctgtttttgtcatggcagtcttactttttgaaacatttgtcaccttctctgatcctgcctcctgcttttccccatctgcactctgacctatactgttttagaaggaaaagataataaaggtcagattttataaaactctgttcaagaaatactgcataaagggctcttcaagataaaagactaccccgcttgtcaggcagcctgctaatttgagagtgctgacgacttaccttgatgaggcaatcttcgaattgatgactctttttaattaattgtcttttcattgataaaacagaattgctttgttttccttttactgcccatctcttcctcacaaaatatgtttcctctccgaacacacaaactgtgttttcagaatctcccctgagtctggaggtctggacagtagtgtgtttgtgtgcttgtgtgtgtatatgtgtgcacacacatgcacagcttgtgtgcatggtatctgtgatttctgtgtgtgcttatatttttcactattttggattcatccagttctataaagacatacttgcttgctttgcatggttctggctccctctgcagccccaaatggaaaagtgctttgttgtcttttgttgctgaaaaatccagctctcggccttctttctttgagtagagcatcccagctggtatacaagtatagattggatttcagatttagcaatgcattgtgttttgacaaagcttattgaagatggaagtcatttttcaggagcgctctaagaggtgagaaaatggcaagggagggtggggaggaaagggagaaaatgcagaagaggcagacacaattgcaacattgatttggtaaatagaaagttaatgtagctacaggtattgacagtaaactttggctaagatattggagaattgcagattggaaggctagagctatttcagaatttccagggccattttattggattatacaccttagaaccttaacacacagcttctgttgattagtacagtttggcctccagtgtgagtttggctttgaacactcagtgtgactttggctagggcttggcacctgtggacttcagcttctactttagtaaaatgaatgagttagaacaaataattgttacattcaaatccagatttatgagtgtacgatagtggcttcacattatttgttttaagttaccgttgagaatttggttctcagtaatctagagctactattttagcagaattatacatgggatgcagaatagaagcttttaagcaacagtcaaccagattggtctataataactccaggataaatacaagaagaatttctggacacattttgccccagtgaagtaaaattatttacattcaaggatggatttggaaatgcaggtatttttctgttgatctgcacgttggttacactggtgtgttcagtgtgtaattacacttccatgcagttatttttgtttttgtgttagatttcaataaactattattttttctaacagatcttaaactttaatgcttctttagagtactaatcaaagtactgttacataagtaatggctcatgtgtgcgcacaggtgtctgctctgtgaagtagtccatttcaaattataccacattaaattgtgtctgctttaaagggttaaaataagtacatgtatatatttagatatataagatgacttctatttaatagataattagaatgtttatgtaatagatttatgctttcagagatttcatattcacaaagtaagttttggaaccttgaaacatggataggtcagtgtcatttggtttcttttttcttcgtttaatccttttcaggacttcggctccctgtgagttgttaatgtatagtgtttatgaatccaaataacattcattaactttcttggaaggtcacagttatgttggttctgttcgaaataagtactataaattttttagaataaaaaaggaaagtattacagtgagttttgctatccacttgccactttcctttcccttcctttttttgttttttgttttttgttttttggtagggagggaggtctccctgtgttgtttaggttggtctcaaactcttggcctcaagcagtcctcccacctcagcctcccaaaatgttgggattacaggtgtgagccattgcacttggccctttcccatttttgtgcttgactagtataagtgtcatttttgttttcttgaaacctttgttctttcccatgtgaatacacataggatgacaatagtcacaaaactctttccgtacttagaagactaaaaccagaaattgttgcttgaacatgtaatggataattgttaaaattctgcactggtttgtactgttctcgaatttttatgtaaaggtctagtttagagatttattatttttattgtttagacttaaaaggaaaacagttagctgcggaatctagtttttatcctggagcgaaactcatataaccttgttgattttagtgggaattagaaagttcagactctttttttagaggtctcccaaaattgtttccactctatgttgaaaggaactctaatctacagaagtggaggtgacagtaaggagggcaggggatgctcttcccaaaggagtttctacaatgcagctgagttagagtgcagtagaaagagcgagatctcatagtggcatgttcctgtcacagcatgtgtatagcagtcacagactctgaacccaaagactgtatttctagttggagcagacattgactcctttttctgggctgaaaacagtgaagtgtattggttttggtagcttgggttataagaaacctaaattagtttgaagtggaattatcctgatgaaagggcagttgaaagcccttgacactggacagaggattgtctagtgtctaatcttggctcaaaatgcaccagacataatgagagtcattatgaactgctgatctcctacccctcccctcagcagaccctattagacttgcaaaaatagcaaacactgtgtgtgtttggcatggtgcctgctgtgtagtagaggaagaaagcgtaccttgtttgcaccacaaccagatactggtgcatcatgttacagctctgcttggttctgagctcctctgttcaatctcgtcttgacagatgctgtcgttgccaccccttagcaagacaaatgcagccactctgcaggagttggcttttgcccagctgtgcttgccagggccccaaactgatgtgcgtgtgtacctgtggaaaggtaacaggctgtgggtgtgttatcctctgccattatgtgcattaccttttgagtttttgccattcccgaaggaaaagttacggttttgtttgttcagataaatctgaaccctcaatttctcttactgcttttttcacaacagatgttgttaggcacccactaaagatccccaggaagggtccctgccccatataagctcactttctctgtaggtagaaagaaatgcaaacagtcacataatcacaaccttaatagctatgtgtataaaggactctgggaaaaaaggacggaggggatctttggaggtgcatgccaggagagagttgtctcatacgagctatgaaggttaagtattgcttaggaggtgtagatatatgtgttgccagggtccaaggtgaaaaaggagaagtggtttgaaatgagcttggtgaacctaggtttgggcctggttttgaaggctactggcaatagggaatcatcatagaattttaaactaggtgagtagccttttcaaaatttttttaggaagcattattctggtttcagtctggagaataagattatataaaaagtgctgagagttggaaaagtgccagcctattatgttgggagaaggaagcatggagaggttttagatgtgaccattagttcagatagagtagtgaagggagataggacttaaccaacaggaagagaaattaaagagagtaagaaaggaaggtctaaggttttcagctaatactccccaggcatagtatttatagggaaacagggaaggtagatttcagtttggggcagactggatttaaaatacctgcggaatatgtaggtattaatgagtaaatttcagtgtgaagtttgtacccagagttgagaatagagcaggctgggcacatagggttctgggataattgatgttacaaattagagtctggtttagcggttagagccatgagaccctctaatccaagtttgatgtcccatggcagtttgatgcaggatgggaccaacattatagacctactgttacctgctaaaaaaggcatttagtatatttcactcctgagtccagaaagccatttaccaagagcatatctgaatttgtgcggcagggaataatataacaatgagttctgtgtattcacaatttaggaattaatttcacaagaccacaggttggaaattcttgtcctctaatgggattgagcctttgtggaaagagtgtcacctgtattttcctcatctcagtagatgaagtagttactgtttctttcccacattcagccaatagcatacattttgtagaaagcaactaaagtttttcctccaaagctttaggcctcttctctttcagttcctcttggtaagacctggcctgtattggtcagtctgcctgttctttctacttggcttacaccatctgcccattgggacctacagattttttttgttttgttttgttttgtttttgagacagagtctctctctgtcgcccaggctggagtgcagtggcgtgatctcggctcattgcaagctccacctcctgggttcacgccattctcctgcctcagcctcccgagtagctgggactacaggtgcccgccaccacacccggctaattttttgtatttttggtagagatggggtttcaccctgttagccaggatggtctcgatctcctgacctcgtaatccaccagcctaggcctcccaaagtgctgggattacaggcgtgagccactgtgcctggctgggacatacagatattttttggctgcttataagtttttgttctcctaggggatttctgggacacttaaatatgattatatccatcagtgaatgaacaatccatagagttgacatcagtggtaaatacagtaatgtgagagtctaaaacgtgagccaaagttccatttaaaagatctaaatgcaaattatctcactaaacttgagaattattgatcatctctgtccctttctcctttttctctcccttttctttccgtcgttcctccctctcttttccctttaccctcttctcttcctttccccgctccctgttctctcttctctttcccccttttttcttcccctccatcttactttcccttctctctcttctcatttgatataactgacagatttgagcagaactgtgaggctcttaggagctgtgtgtgatgtggagtggccagatgactttatgtgagtatgcacgagggactgtaaagaggctgtccagaggccagcctccctccaggttgttcctaaccctggagagtcatcatatgttatttctcatctcagactgccacagaattgaggagggagattgaaggcagctcattaaaccactttggccacagataagagtgttaagagattaagaagtagatttatctgggggaggggtttggtcccggatgaagccttttcctgccgtcggaaaccaaagatttccttgtctcttttgttctgatccatggaatggtgtggcttagctgcctctaaatctgttttggcaaggttgtttgtaaggagacatggcagggtctgtctggagggaacagaaaagagagtacatattgaatgtagatgcttgaaactagatcatagtttacctaattgcagaccttgaagaaactcttggggccacttggatgggggtgcttctggaagtttgtctctgggggtatgtgagtatggacctcttccacactgagaagagggcagagcccagtcatcagttttcatgtccctgagtacaatattaggcttctttttattattatcattatttcaactggtaacaatgtttcccctcaggaaatgtctttacctctctgaagagaagaccgtgatgccagctgttagtttgagaaatgctgcagggtcctctcctacctgctgtttctgtgctctttccatgtgttgtggtgaagcccctacctctccagccatggggccttgttcttcatcatttgttcctatcttcagtttgggatgtggcaaggagaggcagagtgcactagagaaatctgatactgtaatgtgctaggagacagcatgatgagaggttttgggtgggaagtccatgctaaacatcttaaatgcttcagaaacttctttacagaattctctgcctttaggattctcctgttcaataaatatatttttcaccactttagaaataatcttcttaaagcccttccttgaactcatgcatctgtaatgactgcccatgaccagcagtactacattgtggaatgcaagacctaattagtctaagcatgaaagaccttttagtttcatcagctaagcccccttgtcctcccaggcattcctctttccaggtgctgtctccttctgcagcttcccgtaggcctcttcccactgctctttctgctcttctataaaactccacatttaatgcctacaccttaccaaactccaggaaacttccttgactcttgcgggctatatggatctctacttattttagtttttgctgttgcaggaggaaagtatgatttttaaaatacaataatccttttgtatgtctacagaagaatgtggtttggtgagttttacatttgatgcatgattgtatccaccattgtgagattataaataaatctcaagacatgaccttgccctgaacccaaaactaaacatgaatgaaactatagaaataactggataacctctggtacatagagggtcggtgttacagggagataagcagtacaccctaacctagggaagtgcaatgagcagagaggggatggagtatgtaggtggagaagtggctaagtgtcttagatagacaaggtggaaccaaagtacatagagcctggaagctgcagaaaagaacgtaggctaagaaacaagatcaattataggtggttgagtaggtgagtaagacagaaatgtgtgaggtgattggaagggactgctacgataagccagctgtgcttacaatggtgaagataaggaatggtgacttgggaagatgtattggagaaaaatgatagggcctgctgactgagcagctcaagctttatgggaactgctgatcatgtttttaactgctatagatatatttgatttaagtaaatcaatttgtaaagatttagatttcataatgatatcttagaccatatttgcacagcaagtgaaacttaaatactcttgtatccctatcacatcatgttatctttaacatgtgtatcaactttcttacctataaatgctggtgacacctcccagttttctaggcttaatttgtagagggctcaacatgtgaacaatgaatttggtgcaccattcaagaagtaaaattcaatcatttttttctcctattcatttctaaggataggaatctttgccttatagaaatattttaaaggagcccccttaaatgtcacactctctttaggcttaaactattcttatttccaaaatgtaacatcagaagttcagaaattctttctacttaggttctctgtgccccacacaacctcacatttttgcctgagtctccccagtcttgctgcaggagctggggtagcttcagcccacttacatcctgccaggggataaacttgataccttttgctttcatgaaacactatctgtgtgaagtgagctctttgatccacagtcttttatgctgaagctaagggaggattaaggaacacctctgagttgatgaatatttgatgaggtttatataatttaaaattacactcttgttaaccctttcactcaatggagagagaagagaaacttgtataatcgtggttcctacttaggcataaggtactgtgtcttctctgggtgcatcctccttatctatgtagagcagagcatgggaacttagtaaatgtcaattgatgattggcattttttacagcttcatagagagaaatatctctttgcttcattataaccatactgagtgagatgctgaagtggaattgggatcacacagtatctgtgtatttgacattgcatgtataatggtgaacaaggcagatattccactcatcataacaacaacagtagtaatcataccaccaggaagcattctttcagtgcttactgtatgcaaggctctattctaaactcttttcatccattttaattcttagaacaaacttataaggtagatgctattattatcatttctattttataggtaacacaacccaggcacaaagagactaactcccacaaggtttcacaacttacaaatagcagagtcaggatttgaacctgggcaggcagttctcagagcctgcgttcctaacttctggctggacccctcatggtgagaagggcagagagttgacaaatcctctgaagtatggtgagttctgtaggagtctgcaacagggcgaattaacctagggaagaggaaggctgggaaggctttcctgagaaaatgtcttttgggatgaaacatgaaggatgagtaggtgctctctaggtgagggctcatggacaaaactattccaacatgtgtagtggccacaggctggacagaataaaataggtgatttggaggaacaacagagagaagcccattaggggtagagaaagtgagagagtgtgtgtcatggagtgatgccacaggggccaaatcatgaagtcctccgtaggtcccacttccaggatgtgggtcatggaaatataaagggctaaggacaaacggagcattcaaggggtagaaccatgggtataacatgatgagatgtaagctttaacgtgtttctcactagtgatgtgtctaagtcatagagggagacagtagaggacaagagtgcagtcaggcagctgatgctgtaatccaggtgaaggaggatggcagcctggaccaaggtagtagaggtaaggatggatagaagcttaggagcttattaggatgcagataataggagttctggatgtgggagatgagggtgagggaggaaccagtaacaatgcctatgttaacagtcagaagaaggttacaatgtaaccagactggaacatgaacaaattatctgcagtggagcttatttgctcaaaagaaggatcctgcaagagaacatggatggcttgtgtcatccaaatatggatggctttgcccagttagagaataattcctgctgagagaatacacatgcacgcaagcatgtacacacgcacacacatttgttgtagagggttataccctcccaagttaaggtaatttcataattgaggtcgaccctctcgatgtggtaccattgataagccccagcactacagttcagctaccaacactgagtttctcattgagtcaaagcgtgggatgatctgacagcgtcagcagcactgcacaacagtgggagggacggatgaatgccacatctataaggaattgccacttggattcaagaggaaaaggggtaattatccacatgggtaacaatttcagtttcatttctcccttgagctaactctattcacctcaaacgtctttcctgtctagagaaccaccaaaagtgtcattctgattaccatttgtaactaggtgttttctgcttaacatttggaactgggtggggtgagataaattccaagaagatgggaagtttttatattgcagtttatactacagcagcagctccagtctgccctacagaccttctagattttttttttttttttggctgtgtgacaggtgcctgtggagtttatattttgatatttgatcaaactttttaaacctgagcttgtagtaaccattatagtcgtcatgcttgagaatgtgtatttgctagtagtatagagttaacctcagtttatgggggcagggattactttgtgaggaattaaatgtggtgtttgaaaaactgggaagtgaagatcttctgcaacacaggagtttctaaaggaaaaacaattgggccagactggatgaactggttagattaaatgctatcttcctgactcagggttattatttttggttgcttattttatttttaattgttgaagatttattgtaccatgctttgctcaggacagtgtgtaaggtatttagggaaagacctgaaagagacaggaagcatgagcccttccatcaggcacctgaataactgatggtggacatattgagaatacgtagaaaatttgtatcttatggtcatattgcacttcagacttttcacaatgcccttgtatctctgttacttgattctagttttcttggctcagcatgcacagttgttttctttacttgtttatggtctgtctctcccacttaaatatcaggtccttgagagcagatacttgttctcagctacagcccagcacctagatcaatacctgacatattgtgggcactcagtaaatcttaggaggataaatgaacaaaaaacctatcttctgaatatcagtgataatcatataaaacaggcttggtatgctaccatttatgtacttctgattttgtgttttgacaggttttcacctaaggtttgtagtagttggttttcctcagagaagtttttgggctatttttctttttaagaaagggtgagtgatgtcattatgaagttgaagctataggactaatcatatacttgccctgcatctatggtgacttttttttctactggaaagaaagcccgctattaaataattattacttccaggtctgagggagactgtccagcatctgcaagagttttgctaggatgcagggctttgttcccccactgggctgtgattccatccatggagtaagctgcattgtggtagcaagtcatcttgacagtggcaagtatagcatatttcaactggtgatttctgcatgatttgcatgaatttctgtatgacaggagtcacaacaaaactgttacgtgacttgtgtctaaagctatcagtcagctggagctgtgaaaatcagtttgcatgtgtcaacaatttaatcttctaatatgcttgccaatagaaaactgacactagaattatttttctgtatttactgactagaaagatatggttatcaagtgcactgattgaaaaatctttaaattccagtctttaaatcgggaccatatgtgtgttctttccctagccaaatctatttgtgcattcacccacacatgtgtatacatatacacacacagtacagttacattgatatgtgtttgcgttatatatgtatgtattcacacagagcatgcatatgcctcatgcatattcatgagctttaaatgtgcttatagattaagatataaggatgttggggaagtttccctatctgttaactgagaataatactactgcctaccttccaagcaccttgtaagaattaaattagttaatataagtaaagttcttagaacaaggcctggaacatagtatgtttcctataaatattagcttttattattttagagtatgtcttcattctgtcagcttcaaatgggcttcaaaatttagcttcagaggcagtatggcaaagcctcagaattattgcataattcatttgatgaatttactgttattctaaaatgcctgcaaacaatttatatgtcatgcaggaaatattggtatttgtatttctaaatcaaagccatttattaaataccttagtcatattgattcctgttatagtaaattacttctctttctatgtcatcattatctcctagggtctatcagggagatattttcagtgaatttgtctttcattatcagactaaaactaacttcactgaaaacatcttcatttgggatttgaaagagaacaaattttccatttactaagaaaaaaataggtgtttgtgtattggtataaaaataggtatgtatgtaagtgatcaaatagaaaataatgcaaagggacatagaagaatttgggaatggaggtaacatacacctagaaaaacagtgacaagggcacatactattttgaagcaggttttagcaggtaatgatggtactcactgtgggaggaaggtgtgaatcatcagtcaaaacgagtgtacaaactggtgatatgaaatgctgcttaacagttgttttaaataattagatttttgttggggataaatagttcattccagacaaaagtactagggactctatagctcatctaacttcatagattaaaatgaaggcccagataattaaagtgaagacctcagagttagttaatggaagtgcaagtttcaaaaccaggctgcgatgtgggggagacagtgtcctccatgacagctctttaacagatggcatagaaactcgacttgtgaccttgaggggctcacttcagctctctaagaataattccagcccagagctacaccatatatagagtctgtagactattcctaataaaatggttttcttgtcttagagaagagaaactcagcacatacctactttgagtcaggtttgggcatgctcgaaaagggggcagcgtttttagatggagactgctggagtagactcagggtctctttcagcatggctgcctgtgtgatttgattcatgtgcactttaaaaacctgttttatctaagtgtaagactgtagaagacatatatatttagggtattgcattgatttttggaaaccatttgtgtagggtacagtatctttgaatttcactatagtaaccgagttacaaaatgggccactgggtctgctgggctgagaaccatcaaactgaatggtcagcaactttgttcatgcttcatctactttttcttttcaatcatttggggacagataatcttttggtcgctttttagactaactttgagattcagaggggcagtgtattcttggctaaaactttttgtacgaggcacactttcttttaaggtttgtgattttacccttacgtatcagatttcatggtatccaaatgcaaacatgtatttaacagttggtagggatgggagagtttgaggacagcaaagcagcctactttgatgaaagggtcagatagattttaggatctgcaccctttcttagcatcctaagcattttgagaagcagttgtatgtaggtaaaaacaaacaaacaaacaacttggtagttggtgtcagctgaactgctttttactgaatctctgctgtactagctgtgtggctctgaggcttacttccctagtctgcaaagtaaaggtaatgatacctgtttcacaatttaaaaaatagatttattgaaatatatttcacataccataaaattccactaatttaaaatatatagttcagtgattttagtatattcacagagatgcagccatcaccacaagcaattttagaacattttatcacccatgaaagaaatcctgaacccaaaagggccatttcctccctaacttccctaactctaggcaaccactgatctactttctgtctgtgtggattcacctgttttggacatttcatataaatggaattatataatatgttgtgttttatgactgccttcattcacttagcataatgttttcaatattcatgttgtagcatgtatcagtacttcattctcctcaccccccagctttatattaaagtataattggcaaaaaagtacatatttaagatgtataatgtgatgatttgatatatgtatatattgtgaaataattagcataatcaggttaattaaacaccttaatccaaatccattgccttgcatagttaccattttttgttgttgttgtttgtttttttgggtttttttttggtgatgggaacactaagaatctactcttctagtaaatatcaggaatacaatacaacattattaacagtaatcaccgtgactgtacattagatcttgagaaagtacttattttcacaaagtttgtaccctttgatcacatcttcccatttcccttgtccttgcccttggcaaccaccattctactctctgtttttatgagttggatttttttgttttgttttgttttcaagatgggctcttactctgtcacccaggctggagtgctgtggctcacggcagccttgacttcctgggctcaagcaatcttcccacctcagcctcctgagtagctgggattataggctcgtgcccaccatgtctggctggctgattttttattcttatttttattagtgacagggtcacactatattggttaggctggtctcaaactccaggcctcaagtgatcctctcatctctgcctcccaaagtgctgggattataggcgtgagctaccacacacagccgaatttgatttttttgaattctacatgtaaatgagatcatacagtgtttgtatttttatgtctgacttctttcacttagcatatgtcttccaggttcacccaagttgttacaaactgcagggtttccaatggtgtgtagtaaaggggatccttgtatcgtgttgataggaatataaattgggacagcattatggagaaccgtgtagaagttcctcaaaaaattaaatatagaactgccgtaggctttatcaaatctgcttctcagtatatatctaaaggaaatgtagtccatgtctcaaatagctatctgcactaccatgttcattatggcattattcataatagtcaagacgtggaaacaaccttaagtgtccattgatggatgaatggataaagaaaatgtgatgtgatacacacacacacacacacacacacacacacacacacacacacacacacacgcacgcacacagagacaccctctgttatatgtgtgtattgtattatggaatattatttagccataaataatgaagttcactaatttttattgccaaatcatactccattttatgaatatatcacattttgtttatccattcatcagttgatgggcatcatatttttgtgacagtgaaataagacgaagtatataaagtgctttatgatgtcttgaatatagaagcaacgtgtgttttgttgtttcttttcgtctggttggtagatttctggtgaattatcagccgcccctcttgccttgtgaggcaaggaaagcagtcttattgagtagaccatctgtctgccagttctctcatgttagtcctcaactcatggaaaatcctggtgggcactcgtttgatactagaattcacactgcttttttcagcagccagaagtgtttgagtgttaccagcagtgcttgttgtcgttacagatgctccgtacaaaactgtaaatgctgggtttaaagggattgagggagggagccattgcggcttacacagatgtcaactaatctagtgttgatcctcattctgaacctgagcattgacaccaatatcaagctgtggggtagttatgttgtgtgcaaggcttggagggaaatagtgctttggcagttcagtgcttgccgacttcacaaaacacagaaaattgctgagggcttatgtgacagaaagttcatgttacacatatgggcatcttggcgagaaaagccactgatcgtctcagtgtaaggatttggaatttcaaaatcctaaatgattactaaatgacaagtaaaatcttgattgagatagatcgttgctaacgtccaaagagattatctaaaagcattgatttttattttgttggctgtggaaataccgtggaattcatttattaaaagtagtatgtctaagtttctacttattttagatactgtaatataaaattataaacaaggcccaattgttgttacccactaggcagatttttttattatccaagtttctgtttcgggccatgaaacaagttaaaatcaaaactttcgctggttgccattttaaagataaatttgttatataggctttctaagcttggttgccttgctccacaaagacaaaacattaataatagcttacatgtattgagcagtgaatctgtgctaggctttgtgttaaccactgtatatttggattatctcattgatctaaggtaggtacggttgttattcccttcttataggttaggaaactgaggctcagagagattaagtaacttgcccaatgttacacagcttgtaagtggcatttctgtttaaagcttcccattttataaagttttgtgtttttaaatatgctttagaattttaagtttttactctgttattatttcgcgaagtcctatgtctacatacacatcaaagcaattctgtggttcttagggaattatttaataaatgaaatagccatagactgtaattacattatgagtggcatcttttagctgtgcccagcggtagcccagttgctaatctttatcccttgagtagtcaagtagataagaagtggataagcaagtggagtggtggccactcaagcaggcctccaccagaataattccaaataacttcacacagtgaattgcaacccactcaatccacttcactggatagcattgctcaaaagatattcttttactcttttatctaccttgttggcaagcatccccaagaggtcttatgcctgtggcctacagatcaaagatattttctcaaatactgggaactttgctgctagttagaattaagcaaataaaaacatacacctccagaatgtaagcaaactagtttaaaacactccagccattgtattacttatgctttaaaagtttccccacaaaacctcattaatcatataaatattttgacaaacagaaaggggacagagcagacttattattttccatcttgtatgaatggctagacttttcatctgtgctcttatcctaacatgtctttaactcttctgtgctaagatttttatttaaaaacaaggaaattgagactcagtgagatgaactgctttatatcactgtggtaagatgtgttaatagcatttgaaaaggaaaagccaaaattttctttcatttatttatttatttatttatttatttatttatttatttatttattttgagacagagtttcactcttgtcacccaggctggagtgcaatggcatgatcttggctcactgcaacctccacctcccgggttcaagtgattctcttgcctcagcctcccaagtagctgggactacaggcatgtgccaccacacctggctaatttttgtaatttttagtagagattgggtttcaccatgttggccaggctggtctcgagctcctgaccttaagtaatccgcctgccttggcctcccaaaatgctagaattacagacatgagccaccacgcccagcctatttcttgatttttattagtcacctagccttattgtaatttgcacttatctaccattagaacatcataaacccaagtgatgaacagaatggatgtaacttagtgcgtgtatgtaatgcatatgatgtaacatacataaagacaaatggaaaatgcctgcaagatagtttccctgttgtctcatgcctcagcagtaatgaaacatatactgagtgcttattgtgggtcagttactgtgttaaatgtttgtcacgaatcatcccatccagttctcacaatcaacctgtcatgtaggtgctatttttgtccacatttttatagataaggtggctgagacttagaaaaagctaacaccacttgcctgtggtcatagagctagcaattagcaaagccattgcttctaaccagtgtgcattttgccttgcacaataaactacattaaaagatttactttagtttttctacctcccaattgaagccactatcagatatatagtctaaacttagatttgattctgtttagaaacacttaatgttcctaatgttatcaggaaatttgctgttcattttttcaagatctgagtagaatgtcacattctccatgaactttccatgatgctcttcttccaaatgtttctgtagcacctggttgtagcctggctcttaggattcccctgtctgtgctctggacttctttagaagcaccttgtctggttcagttactgcctttgtttgtattgctggcacattcctttgtgcttggtgcatagtagataattaatagatatttgttaaattgaactggatgcttaataaatgtttggatctaattatgatcttaactctggtgtgtacttcaggtacttcaggaaggtcattgcagcattagatgactatggagaccctcagtgttttagactgagatgacttgccattcctacaagagatcaattgaatgaataattggggctgatttttccctaagtattgcttagaacatatactgttttttttctcctcaaaaattgccagttatattgccatactggacaaaataaaactgttagctatatatctatatctatacctatataaattttaaaaacgtagcacaaagtttctgcaccatactttgtgagcagctctgtgtattccaaggctcagaaaatcagactttcaaagctaaattttaccaatatatatcccattgaaatttgcatgagcaagcagaaataatgtggatgttggagttaggtaaatgaatcaaatcctggttcagccactttctaggtatgtgattttgggcaagatatttaatttttttcaacatagtttttttatttttaaaatggaaaagttatgcactggcagatttggaggatgaaataatatgttgggagacagtgtgttaagttacttctcaaaaagttctattataattataggttgctaatttttggcatattttcattttaaaacttttattctaatttcattcttaaacagtgtaagcatattcacagtagcttttctgatcaccttatacccaagcactgccacatgacttctggtccagtgttccaagtgaaggccaagtaatgtcaaggtatgctgtatacggattttctaggagtgtgaataaagaagaggaatggagccatccatggatggcaaagtcatgccgttgcaataagtactacatttacatatttagtacagatcccatcttagaaagggtggatttggtcgggtgcggtggcttacgtctgtgtgatttcagcactttgggaggctgaggtgagcagatcgcttgagcccaggagtttgagaccagccaggacaacatagcaagacctgtctctctctttctctctttttttttaaaggctccctgctcatgaggaatggggagagggaagaaagggtggatttggagaaggttatagcagtgagtatggctgtaaatttgcaaggaataactttttttatttccaacagtgattgctttagataaatattttattgtagatttcaatattgttgcaattgtatttgactcagcaaaaatagtttttataatttgtcaacagaacttctttaaaatggcttcctaagttgtttcagctaattatgaggtatggtgatctcaacctccttccaaccactggtccactcttgagtcttcaggcttttttttttgcttcaagagtagcattgtaagtttttagtcttcagagaacaggaagaattctagtttctcagttcttgttctgatcaggattgtattttcttttcgtcagtttgtgctctgaaactgcagggccaggcagagtccatgctacctgataaagcatctggaaccatggaaaactgagggtggatatgatgagcctctctaataccagagatagtggacagaagccatccgttttgcatttggcttttttgaggactcagtaaatccacacagagaattagctaaggctgtttgagaaacagcctgtgggataatgaacacttttatgctttttaaaatgaccacggggagcctcatcagaagaggcgattccaggattccaagatggcagctgggtttttcattgttcctgtgggacttgcactgtgaagtgtgattgtagctgatttttcctttcaacaggaattcattaggggtatccattagctaatgaactattgatataagaaaaaaggtcagttattttagagaggaaaaatgtggctttaactctcgattatttgtgtgttgggtccatttgaaggcttcttcccctggctcaaaatctggaaaactgatttgaaagaccttcagttttatttagaaagaaggaaaaacagattatttcagttactttatgttttgtgatttttactcgatttacctaaagagaaagtgctcagatttaaattctaggtaccttcgttgctaattattttttactgcacttttatggccattttttatttctaaggattgaacccttttttttgtagttttctctcaagggctaatatttatatttttttgcttccaaaaactgttaaagtctgaaagtgtaaatttatatttgtggtgtttactttgtcctttaaatgtttttgtgtacccatactttttgtcataaagatggaaaaatgatattaaattaaccaaatgaaagtaattaatgctgaacattcactaaattattaagatgttaatgtgattccaaatgcagatagttcatgggcagcagcatgtgtcctgggactccccctcaaaggttggcaaggtttgggcaattttgagggagggagttaattcttaagtagtaagctttttcgtttacctctactatttataagctaatatgcaggatcattgtaaattagtgaaaagtgcattccattgaactagtagttgtaatactgggttaaatatctaagttgtgtgactttgggcatgagtttctgcctctgtgggtcttatttttccctgttatcagaactgtagcattggactagatcatgtttccttgtgtgttttttggaaaatgtgacaatatactaggacctacatgaagtcacagtataaacacccaagggacacaacaggcatatcttcctgcctttcatatctattcacttgaggcttttggtaagacattaattttatacttaagcaaacatattaaagactgaaaggaactcatatatcttcatatagtgttaaagatattaacacaaaaatgaaagaaatattgtccatacagcaggccacagatagatatcccttgttttgtgatcagtcttttctgctatggagggcactttggacacatttgaggatcactgcattagatgacaggaaatgtgtttcttcctatgctcaagttgtgtagccatgacatttgaggatatttacattttgaatttccctcctccctcccctaaattagtggcatgttctagagaagggttcatgtgctttatttacataaaacctatctcaatgttgtttgataagaatctgttaagagatcttgtcctaaaaggatggcacttagtgttggaactggagaatggtggggtgtgaggagttaaagtaattccctaagcacactagacacgcctgatgcccctttcaagccagtctgcttccacgtggtgattctttctgattcccattatcactgtgtccccctcacccctgccatttagcctagattctggcagaatggaaatccacgtttctgaatttagtatgatttttttttctttccttctattctcagcaacaataagtactcttgatggcagctgctgtattaagcccaagagcttaaaagattaaagaaaccactaacagcagtaaggaggaagtttaagggcctgtttttctgaaggtttgtgttttcattctgatggttgagtagaaaattacaaacaggttgtgttcggcagctggaatgctctccaacatctggggagacccagccttctgtttatttcccattcattggaagggtggccagccagtagcagaaactgcaggcagagatactagaactctttgggtacataagccgttagaaattctttttttgtagaaatttcttcatagaaataccttgttctctattttttcataagcttgactgagcacttaacttcaggtcagttgctgaggaagaggtctgaaggtaatattagtacccccccaactactttcagctggaaacaagagttgtttgggcccttactgagttcctactttagagtcaagggctggccttcccctgcatctgtctgcatatacctcacagctgagcagataacatatttgtgcagctattcccttatgatttcctctctattagagagaggtggagcctatgacagactgcagagtgtttgctccattcttccccaccccgtagctttactgaggtatagttgataattaaagtatttacatatatttaaggtatatagcttgattatgagatatataagtatacattgtgaatattcaaaatcaaactaatcaatcactccacatagttaccgcttttctttttatagtgagaatacttagtatctaccttcttagcaaattttatttatgccacatagtgactatagttaacaatattatatactcaaacccagttattttaatttttaatttttttagagctaggatctcgctctgttgctcaggttagagtgcagtggtgctatcatagctcactgcaacctcaaactcctgggctcaagcagtcccgccatctcagcctcccaagtagttaggactacaggtatataccgccatgcctggcctaatttttatttttagagatgaagtctagctttgttgcccagactggaatgcagtggcatgatcatagctcactgtaggctcgaactcctgggcttaagtgattctcctgccttggccccccagttgctgcgagaatggtgccttgttctcaaaaccattttgtaaaaagtaatgtgctggccaaataaaacagaacgccagtttgttatttttggacagcttcattattttgtacatgggaaaagagaagttcgaagttttgccttatgcaaggtcataaagctggtcagtggcccaaccaggtttagaacctttatctttggggctatttgagaaattcaagtgatcccagttcaatcattagtggcatttgtggtcttcagtctgcactgagcaagggtttcatgtttggtgtctaatattttaggattattagagctaatctagcctttggagaagccaaatggattttgggggttgtctgtaagaacccatcatgatggctggaacagctcttaagtggaacttctacataaatcaacttgcatttgttctgtaacaccatgtgaattttcctgaatttccaagtaaatatattttgcatattgcttacaaattgcttaggctgtcttcatgaataatgaaagctgtgctgtaggaagctggatattaagaaggggtgtttttaaaaacagtatttcatttcttttgcttatattttctgtagcctcaagggtgtgttcagaggtggtagggagggagggtgctgttaaggtttctcaacacctgtgttcctttacagaccattatctcttctgctatcaaagaggacttgccagttaggtcaggatgcataaacctctggacagtgccttctcctatgcttatctttgctatatgtcttgttgtgtgtttagcttccataacaaggttctctacttctccagtttaagaagaaatcatctgttgtgctgaacctctattcatctcagtagggaaggcaccagcttcaagaggctgagaagagacccagagccagcaaatgagacatggggttttattaggggcttacatacaggggagagagtccagtggtggcagactggacaacatactggcaccgctcagtggcagagggctgggcaggaaaactgcagccgctttgcaaacagcatgcagtttatatagcattttcaattaacaccctccccttaacaactttcacctggcaacttgcatgccaacccaaagtttagggcctcaattccctgtatggcccatgttccgtggcatgggcagggggctcagatgttcctcctagacaaggaatgaatctctggattggccactgtgggactccctagctcgacacacacattcaggtgcatctgccatacagtgtcattttaagggtatgctcaagttattgctctcagaggtgtttaccctactattatcatttgacaataatacctatatgtgacgtacattgtctagtgacagtcctgatttccagtagctcccacaacaacttcataagtatcatagccccactttttaggtaaagaaagcagaggtttggggattgtgtcttccctagtcgacacaccttgacagtgtagaaccagcattcagaggcaaatctcacttaggcctggtgttctttccaacatgcctcagctgctgctttgccttctctttctcccttcacctggcattttgaccacactaattgtgctggcatctcattccagggagtatgggatgagatgccagcactagagtatggctttcaaaacattttttgtcccagctcacagttacaaatacagtttatgtcatcaagtatacatacatatgcacatgctcaaatgcacatacatacctgtgcttacatgtactcatataaaactgaaagtttaattatatatgcagtaaactctaatatttccttttctgttttacactgttaatacatactcacctgtaaccgttattactcactaaattggttttacaatcaagatcacctgcggttgaaacagtgctatagagtggaaatctttacggtgagttatgtgctctctcccctcaaccccttacgagatttttaggataatccatgggagcacgaaaaaaacggttgaaattatattttgatttatttccatcttaaggaagagattaaatgttgctgttacttaatatccgagttgacagtgcagcatcactcgggctgtgaaacagtcagtccagtgctctgtagagtgtggcaggtcctgaaggaagagtgggagttcctaaagtggcacactccttcagcctttcgttgtgtgatgtgctccagtttgtatggctcataaagcatgttagtaggttatattatttacttttggcaaagagaacaagtggttttatttttatttttcttttgagacagggtctcattccattgtccaggctgtaatgcagtggtgtgatcacaactcactgcagcctcaacctcctgggcacaggtgatcctcctacctcagccttccaagtagctggaaatataggtgtggatcaccacgcctgactaagttttttctttttgttctttctttttttttttttttttggagagacggggttttgccaggctggcctcaaactcctgctgaagcaattcgcctgccttggcccccagaagttctggtattacatgtgggagccaccgcaactggcagagagcaagtgatttttaagagtttcatcaaagaaactgtggaatgagagaacataaacacagggcaacagcaggaaaatgacagagttgacttttttgttttaatgagctccttatcaaccgcatcgctgggtacaaacagcgactatatagtcatatctagtagggagtcagacaaaaaattgaagctattttaacaagtgagaacttaggtttatatccatgattgttaatgatttaccttgtcctgaatggatgttgtaccctgagatattagctaatatcattatgttggataaaatattaaaagttgtattcattttatctttgtgtcattccttatgtttatttgtatattttatgatatatgtgatatatctgtgccttatagttacatatatattggggaatatgttagaatttttttgtactgataaagattcctaattaaaaacatttggagaccatttctattctggaggactaagtaattattaatgggtatcttggggtctagatgaagagaaggaaaaggtgaggacacaggaagggagtgaaacagggagggtgtttgtgtacaaattagataacaaccctcccaagtggattcagttccaggggcacatggtttggtgagtggcctgtgccttcgtgcaggttataaaaagtctcccctttctcctggcatagcagctctacactagggcacatggtttggcaaatgggttgtgggctggaattcagcaccctttcagcccttcatccttctgcaagtgtagcctacacaagtaagtatatgtaacagccctggtggtgaggtactgaaaataaataaataaaagggcgaaggacaggcattcatggatgtagtgagcagcaacagctagtcctcactcttttattcattcattcattccttcaccagagtatttatagaacacctgctgtgtgccagccatcttcaacagcaggagttggcaaactatagcccaccggccaatcccgacctggtatctttttttgtaaatcgggttttattggaacatacctgtaccccttggtttatgtatcttctgtggctgcttcttagctataatggcatagttgaataattatgacagagactgtatggcctgcaaaacctaaagtatttactttctggccctttactgaaaacaggcgtgaacctctactctagaatataaatcaggacttgcttctggtgccactgcatgataacttagccatggactgtttggcttctatctcatgttccctacttgcaagaaaatacttccatcagggccaagtggaggtgcagtagagcaggggcagagctaaaagcaacacagctgggcacatttacttcttaggtctctacacaaaccatgtagtgtaaggaggagacaaagggctaggagtccagagactgacactgtgtggccttctctctgggcctgtttcagatagtcactctgcaactacaagatggcactggattagtgattctcagacgtttttctgcaccaaaatcacctaaaaggctggtttaaccgactgctaggctccacctccaaggtgtctgagtcggtaggcctgaggaaggcctgagaatgtacatttttaacaagtcctcaggtaatgcaggtaggcagtatgactggattgtttttgtggttgcctgcctctttttggcattggaaaggggaaagccagagtattccttgaggaatgacatttggagagaaccaaattttagatgcttctgtgatatgtacaccagagctattctggactagattgtaaattctcacatttcacctatgcaaaaggaaatactttctggtctcctattagtaatcagttgtctcaaattttgcccgttacctctggaaattctggaccctcaagtgatcagtcttttaaggcagtgtggaagaacagcacctattatggcagttgatttttcatggtctctaccctgtccttcctaatataactgctattctttaccttcctgtttttcaaaactctcgtattgttcctgttgtgttttttctaaatattttcttggttacaataaagtgctaatatttaaagagcttttgggagcctgctggtgccagaaactattcaagttacttacagaatactctcattcagttctctcaaaaatccttggggaagttttatttttctcattttacaaatgagcagtaattacaaatttggagtcagagaagctaagtaatatgtgatctggacaatttcaatatctatgtatatcaaaaaccaagcttcctaggtctttgacctcctctccagtatccctcaccttcacctgctaagtatccattctcattttggatctcggactttgttatcacctaggattcgcccaggatttcactttctcggatcatgaccttccacatcatactgtcactgcatctcaggagtctgtttcttggaaaagctttacgtctcttatcctttttcttttccaacagaaatacctttctgaactatttctctctcttaaacctcttttaaaatctgcacacttcatactaaattgtattgattatgcttctagttccctagtacataataacctttggaaaaattgttttgtcttactaattgtttctatagaactctgtactgcacctggtgtatagaaggcactccataaataatggtttaactgagctagagaatatatggccagggtctgagtccgagtctgtcttgcttcacagtatggctgctatagtcaggtctgccacagctctaggcctatttttttttaatctgtctggatgaagaaggaattgtttagtaggtgatgtcatttgtgggatgctttgtctatttctgcgtatccagcatgcttttagtgatttttcattttgtcagactgcattttctcttttcaactagagttcaaacaaaataattttagataacatcctaagaacatttggaaacatgacatttcaggtctattttccctctttgccttaaaaaagtatatacagctataattactaattgctgcgctctaagtagagacagatgatacatatgtttgtgacaattttccagagggagagctaagtaaccaggctcatttttccataatgtgaatgttattcacaaactattaccataattgatgcaccaaaccactgtagagtaaataatgtgttgtgtgtgggaagcaagctagtagtcaatgaatattaaagaacaaaacctcattttaaaagagaaactgtaattaaaatcattctgaattcatgctgcacaaccagttaaaataacttggctgccatttatctgtgtaattctgtgtataaagggagtaggtatatgatttgttatatagaagtaagtatttacatgcacatttttatgaaaagacacaatatcgaacttcagaatcagtcgttttccaaaaacatttgttggagagatgaacatgcagagttaatcagtgaaatatatattgacaggaaagatcaccatttccgttatcttatcttttgcttttctaggtgttttatgtctacctggaatgtcgtgtccctttccgtggacctaatcagcttctgtattttctccaaagcttccttttcatcagaagttgttcttgtccacttttaatccctcttactgctttctaggtgctcatcaacttctgtgtgtggtatattgatttgcacttttgggatttgttgttttataagaggaggtcataagtcatttcttgtgtgtatcattagtcttctcaacgagactgcctaggatttcagtctcagattattctatgtgtgtgttgggcgtgtatgtatgtgtatcattccttccggtgtaccttgtggagaatggtttgctgtccatgtgttcgctaactcctcagtatgtattgttggttacctgttttcatgcaccagatactgcattatttttgtaaaatctttacattttgtgtttggctaccagtgtctccacagagtcttgaatgtaactggtaaggatcagatctgttggtgtagagtttttgatggaacactcaatcagcaatctgtagtatggcttatgtaaaatgtataactccctctatctctgataagttctgaagtctaaggggaaagtgcttccctgtctcttgaatttgagtgttttgggtgagtccattttatagatagacaaggtgattgtatcagagcttacttttatattttaaaatggatcatagtgtacctattcttaggaaccttttaggaaaatctctttaacattgatcctgttgttagttgtaatctcagtatattctgataatttcctttgaatatgtaactgttcctttcatactgtgggcatctgttgtcttctctttttatagcaatgaaagtatgaacagattccaatgtgggttcttagctcaaaattctctggctctaatgtcaggccaatttatttagctagtttatacaactggacatatttctataatagaaaaatgactaaatgtttcttaacatattgtttacagagatagagcccatgttgtaaggctatgtaactcttcctctcaaaagaagattattggttttagcatgttttcctccctttaatttaatcttaagcaggtgaacctttttgagggctttttggaaagctctgaggaaaaaaaataagaaaactcatacaacctcaaggaattctaagtatcaaggagcacctctgtgaaggtgattggttcaagcattgaacactattttctatccttccacacatggcagggcattattcatgtatccagctctgtgatagcttgtttttgcttgccctgatgatacgtatggcaagggaggaatattatccaggagtggacactgtagagaggggaaggaaccttggaactgacctttatagaggcggttctcatcctcaactcttcttccttacaagatggcttggtatcccttgagatcattctcccaccttcaaaatcctggatgggcctcttgcctggttcccttaaggactctaaaccacttagcttggagctggtgccatttaattctgttcttggcagtgggccctggcttctttcctgctaggccctgtacctcttaggagcagagaagaggtcagatgcagataatacaggcatgatttctgcctcctgaaatgctcagatgatatgcacttctccgtccccctaaagatttaaggaagtacacatttatcatgggatgtaatgagtaggaaagagcatggggctttctttttctgctgaatagcagattgtaagatagaaacagttttgtttacaattcagctctatctttgtactttgcattgcagttgaagttatttttagctttactgttaagctaaacgtctgagttgtttcatttgcaaattctttctttgagggtcaggggaggcttttgtaaaatgttcaggtctgagagaattttgagttaggtaaaggtgagtgtgtgcatgcatgcatgtatgtgtatgtgtgtgtgtgtgtgtgcacagctcgtgcataaatgcctgtgtgcttgcttgggtagggactaggagggctgaaaaagagagagaaagtcattcttagcagaagaaaagcacgtacaaagggtggaagacgtacggtttttgacagatgaatgaatccttctaaaggttttgtaagagctgtgaccagctctgtttgctgagaaaagggaaagtccttgagcacccatcatacctcttcagactctcttaaaaagcattcagatgttctgccagaggaaatgatgtgttccaactacagctgcagtggagggttctttttgtgcagctgaagcaattcctccacatagattgtcccattttaacagtaaactgtctgtttaaaacaaaacaaaaaaggtgggtgggaaatggaaggagaaggagtttatgccaggaaatgaaaataagttgctgcagaagcctgttttggttgtggtttcagagttaaggataagttattaataataataataagagcccacttgatagtttgttatatctctgtgtgtgtttttatgaacttttaattttccagaaaacattaaagataaattagagaacacactcctgttggaggaggtgaccatcttgcagctaccaaaccatagaatctttcaccacttaacaccttccaaggaaccgggtagacttctggtgtcctctctggtcctcttcccttccttataggatgtcaggctttggacttaatcagaggataattaaggctctatcatagcaggtgaagtttctgagtggaagtctaagaagtgatgtttctataagtgtctttagctgactgagctactaagcagaggttaggaggttgtgatgtaatttaaagtgacattgtggttaccttttatcaagctcaattgtgagcctggagctatgttaactgcttcacagctatgagcctatttaattcttacaggaatcctcattttaagataggtttgattaccctccgtttacagatggggaacttgaggtagagagataagtggttagtttgcaattacacccagcatttggcatggctgggattggaaccaggggccttcagtcttcaaagctcttacatgtaaccactgagtgatgcattgtactctctcctgtaaagtagccttttctccctgctgccactggttcatttccttttccttttttaagatgctttaaaaagaacaaaaaccaataacgtacctcctaaattgaggttgatctccctccttcctatccaataagtaatgttctagactcatgcaaatattagatatttgggagaaaaaatgaatagaacatgtccctcctctctttagctctaagaaaatttgtgtgttcttattaattcctactgttccactatcctaccatattacctgatacatataatacagttacagtcttctcagggagactcttctatgcagtggcatgctggagccaggaaagcttgtaaacccagctcagacatggaccagctgtgagaccttggtgaagtcactttaccctccgggctttacttcttttatcactgtagtgtttgatccaggtcagttcgcagcctggaaggcacagccttttccaggacactaaatagggcacatgtgctacccatttgcgtgcacactatccttaggcatttgttgaagagatggttaataaaatataaactcattaaaaagcattactaaattcttacattttgtgtttctttgatcagtgaatgactgctaaaatttagtacgttatcaatggggaatttgttatctctttttgcataaaaggggtcctcggttttcgtgaagtttaaagtccctccccaggtagaatatccataaagcctatgaatgagtcttaactacttgattacccagattctagctttttggaatctttcattaccttacttttttcccttctcggtgagcttttggacttaggacaaacggggaacgatcacaaggaaatggattgacatctctactctttcacaatctttcctgaagacatgatttttttttgctatcatgtctctaagtacagttggtcagttgtcactctgtcaccttaccttccaaccccataattcctgtgaaaccctggacacctcactctttttgcagaccatgagctcctctggcctcactcctttccttgtccagcttgcagtacttgagtaatcccctcacccctcaccaccttccttattagtacccccagttccctgaagctcttgtcctgcccatttcctcccagcagcatgtcactcatctgccctcatgagcctgtgttccccttacaagaatcacatctctatctgtactgttattatagatcagtgaacttcaacatctgatagctttttcagtgttgcccatcagtgcatttaccgagttgctttttctatccttttggtgatagttccaaatgctccccactgtccccacggctataatgataggaaacattaatacaaaacttggttgtgttggagaaagtgtgctaagaactttacatgcattgtctcatctccgttcttgctaaaggatctaacttttccttccaaccatccagcaactactagcgaggcatcaactgtgtctatgcatggtgccaagccacagactgtagctatgattgatgcagattgggtgcttgctctcaagagacctctaattcagagggagatgcacagaagtaaacaggcagcaataacattgtccgataagtgctaatgaggggagaagttcaatacgctatagatgcccccaacccagacttagggttgaggataaggaaaacttgcaggaagttacagctcagtgccaatctaaaggacgagagactatgagggaggaacataagggcattctggacaaaaagaatacctggctgctggaaagatttcagggaattgagaggggccagtaggaacagagccattcttctcagagaaattagaggtcttatttttggtgtgaattccatagactctcttttctacctcctctgtgatctgtatcctcacttggttactaactggaattagaatcccctgcaatccttcactgtatgcagatctcgtaagacacactttctgtcaatctcagtgtgaagttttactatgcacttgtatagctgctccactgaaatactattagactgttaaggtgagtgtagaggacaatgcttcttcaaaattattacagggaagtttataataatggtgactgacttgaggtaggggtagggtttttcaggagggtctttcagtggtaatcacgcctaaaattttgaatgcttaaatgaagctgctgcttagctcaatgataagtaatagcagcttctttttccatgaggacatttattaaatgatgttttaggtctcagcaaatgttacgccttcagacaccttggctcaggaaagcctgatgtgcctccagtgaaggatttgtaggtccacatcttcgatgcttctgcaacacagagttagggaaatgaaacagtgggtcatacatgctcctgatccattgccaacagcaaagggacttgagcccccacataccttttgacccttctggtcatgataaagccacccactagctataatgctatagtcagcagtagaaataagagggagcacaaagcaactgaatggtaaaatatttcagacctttttggaccactttggaagatggaagctgataacatcatacatccaaattcctctgcattgctgtctctctctttacaggtggggaatagtttacagcaatcagtagaatctacttttgattccaaatgggtcttaattattttgtatttgggaaatattttttacttggcaatagagatgtgccataatattatttaatattttggaaatcactgtttcccatgtgcctgaacatctcgagcacatttaccctgagcgtggcagtgcctgggtgtctcacatccatgtatgctcaaaccatgctccttgatttcacccctttctctctgtttctttcatctcgtaaactgagtgctgatgccatttcacactttttcttggaagtttaatgagttagtagtagtataacaaaaataaaaatattttctttacgtttctgaaaagaaatatgtctataaagcgtcaatcatttttccaagctgttagttcctgctgctgagtactaggagctgttctgtcagcaagaccacgtaagggggaatagtaagagaaagctgtcccaattttctttctctggtacaaaaggttagaagatgttgtttcagctggagaacttaagatggattcttattcactatttgctaaagagactggactgtttttagtgtgataattttctgtaggcgtggagaaaggtcacctcctgatcttgttttggagatcatggggttaaatctgtggcagtgtccttttcctagacacagcctcttgtcaaaataatgtttggccaggtgttaatctgtgtcctgaggggagtgctggaattcattattcatcccgtgggagtaggggtcagaggagaaggttgtccttctgggaggtaccaggggacatagcctgcctcctgcctttactgacatgtgccatttgtgaggagggcagttgaagtccatttgaggaattctcttgtcagccggccaacacagaaacacagagggagtgggagggagggagaggcaggcagcttggcaaggcagtcctggagtgcagtttccggagcaagatcacacacagtgttttaggagctcagggaaggtgtgcaggaacataaaggggaagggggccaggtttgaaagagtggatttttcctattttttccaccttttattcctcctgtctttgaatacttgtcatcctttggaaaactcagcatcggaaagaagcctttgctgacacactgctttttctccagcgctatattgtgggttttttgtttttgctcttttcatttttcttttcctctgagggcaggaggtgagacaatgatcaagtcaagctggttctatgttaagttcaagtatgcagagaaggtaagtcaatatggtttcttttcccaggggaaacctgccacctccctccagtcttgtcatgttgatgggctcctctggccacttggggaagtgaatgaagctgagaagttgtatttgtgaatgtatttcctttggcttaatgatccttggatgaagcacaagctctttgcttgcaatctgacgttgccgctgaccaagtggaagcaatcttcagactctgttccggaggcatgatttagagtttaaagaggggaaataatgaaactacaataacaggaaaggcaggatattctgctttagattgaatagagaattttcaaggtattatttgttacaaaggtagatatatttttggttctgaaacaaattgacagtcacttcctattacctgttggcttagaatttttttcctctttcagttaactaactgcttactcatttgtagtcttacttggttgtagaaagaatccccataaggttgtctgaccatatatgagatgatctctttactgtctgtcaggggattatattttatgaatgaattttggttgtacctaaaattttgatgttaaacagttccactgtattttaacataccatttctggacttttaggggaaaagtgtactttctaatacatcttcacttaccggggctgtttgacatctttttggttccacatccatatgtgtcacttactctgttgggaatttacaggattagaaatgaggtttccaggagaggatatagctcagaggtagagcattggactgcagatcaagaaatgagatttccaggaggatcctaacgtgtgcctcccttttgaaatcttccctccttgatttgattgttgaaaacgttggcatattgattgtagagttaagctgaggctctatagaatggaactgtgatgtggcaagatggaaaattgtgcgactgtctttatactccttatgattatatgcataagcacattaaatatgcctcttccattcacctagtttaaaaaaaaagttagaacattttcaactcctttttactgcattttttttttctgtgtggacttgtttctgctgtgtttttaagacagcaaaattactctttctttacccatgttgaaattacaggatttttatttaaaatatccattttttattttaaactcacttgcattgttaactattaaagctattataagtaaaatattatctattcatgcacaggattgggaaagattgtggtttgggatttttttttctcagtagattactttcctttgagaagccgaccatccattgtttgctgttatgaattttgataactgaaaactgtactctgccttcttatgctttcccttttatcttgaatgttctgtcatgggaacctgaaactcaagagttaaggcacgtaaataaactaatgtgaaaaggggaaaagcatttccagaaatgattgtcataaaaagaaaaagaaggagaacgttaagttaattgcttcatttgaattaccatgctgctattcctttagcaaccaaacaagcagagaatgcttccatatggcaaggcacaagtgtaatgtaaagctaagtaatgtaaggctctatacctaattgaaggatattcgtcttgattttatgaggatagaagaaaaagagaaatctcattcttgttcttggcatggttatggtgctcaagatctcagtgattctctgcagaacttttgttctttcacaatgattcaatttaaaaattttcattggagatttttgttttccaaaactcatcaagatggattgagttttaacctagagagataataagtcttagtgtaaacacagggacagcattgataacaaaacaaactaaaaccatcttttttgtattcctctaaaaagccattcttacaaaggctttttgatttggaatttccctcactatctttaaaaggacaaaaaaagaaattcctctcttgattgtcaactactgaccattttgatttgatataagcttgtaattgttggaaagatatttctgctgtgatgtttgtccaaaactataagaaaatacatcacacaatctcttcaatatccatctcctagtttatcatttaggaagatgatttaatcagtcttcagtagtgagaaagaaaaattaagaatggcaagtaacgcatgaccaaaaacattggcataagagaatactgttcacttgtgatcactggaatcatgatccctttcaaaaattaaaatatataataaaacaaacactgtttttttaaccaccaccacactaacacacatgttcctctgtaagaatttccatctaaattatttatgagttgtctctttcttgaattagattggtgcctagctatctttctttctaaaagagtgcttacttcaattaatttcatcctataccccctttctctttttattctacatattctccctgagcaatttcctttttggtgtgtttttctatgtcctataagtgatgattccaaaagctctatatctagcataatatctttcttgagtttctgaggtatatatttaattggttaggtagatatctgtcctgaagttcaacagattcctcaaatgcagcatttctaaagtatagttaatttcttcttccttaaccaaggattttcttcctcttacatctcctagcacagctaaggcatccctatccagccagtcatctttgttcccaaaggagctgttttagttctgttcttatcatctcccttctggcttattagaggagcctcctaatcgatctccctgccacattcatggtgcttccagtgctccaaaaccctgctagaggtatcttaaaaggtcagtctgagtctgttttgctgcttgttaatggttcccctctcccatctaagcattctcactacatctccctcaacagtgctagcccttgaccttgtatatacataatacaccttattgtaatttcttattcacctgcgtcttctatagtaacatatgatcctagagatacagaattacattgtgtttttgattttgatttttctatccagaatccctgcacgtaatagatatttattccctgttgggtgttgtggctcatccttataatcccagcactttgggaggccaaggcgggagaatcccttgatcccaggagttcaagacaaacctgagcaacatagcaagacctcattatctgcaaaattaaaaattaaaaaattagctggtgtggtagcgtgtgtctgtggtctcagctacttgggaggctgaggtgggaggttcacctgagcctgggaggtcgaggctgcagtgggctatgatcccaccactgcactttagcttgggcgacagagcaagaccctgtctcaaaaaaccatttttcccccctaaatgctactgagtaaatctgtgactttttcccaggagtctggccgacctgagtttgaattctgcttctgccatttactggtagtatatgaccttgggcaatatattgaaactcaattgaattgttttctcatctattaaatgaggagtattatcacctaatgtatttttcagttaaacttcttattttgagataatggtagtacgtaataatagtacaatatgcagttttaagaaataaaatgtaaagatcccatatgccctttacctagtttcctcaatggtaacatattgtaaaaccatagtaaaatatcacaacaaggatattgacatcagtacagtgaaaatacagaacaaccacatcaccaaaagtctctctcctgatggcctttgatagccatgcctctttccttctaccttcacaacccccatcattaactcctgatatgcaatcacttttctccatttttataattttgtcgtctcaagaatgttatataaatggaatcatacaggatgcagctttttggaattttctgtttttactcagcataatgttttagagattcgttcaagttgtatgctattagtttctgagtagtattctatggtatgggtgtaccatagtttatttaatcattcttctgttgatggacatctgagttgttttcctagaagtactatgaacatttgtttataggttttgttgtgaacataagttttcttttctctaggataattgtccaagagtgcagttgctgggtagtatgtatagtatttgcgtggttaatttttaagaagccaccaaactgtcttcctggctgactctactattgcatattctctttagtgcactgtattagcgattccgtttacttgcgcattcaccagcatgcaatgatgttggtggtgtttctggttttttattttagccattctattggtgtgtactgatggtgtccagtgatgggttttaatttgcgtttccctaatggctaataatgttgaacatcttttcatttgcttatttgtcatttgagtatcttcttttgttaaatgtctcttgctctttaaatgtcttttgcccattttctaattggatttaaaaatttttactgttgagtttttcacagttcctaatattttctagacagtaagtctttattgggtatgtggtttgcacatattttcttctaatttatagcttgtctattcatcctctttcagagtcttcctcagagtagaagttttaaactttgatgcagtccagtgtatggatcctttcctttatattcttgcttttattgtcaagtcttaaaactctttgcttatcctttgatcctgaagatttttcttttccttttttcctaaaagctttatatttcatatttaagtccatgatccattttgagataaattttttataagatatgaaacttaggtcaaagtttttctttgtgtgtgtgtgcgtgcatgtgtgtgtgtgtgtgtgtgtgtgtgtgtgcacgttcctgtatatgtccagttgttttagcaccacttatggaaaagactattctttctccattaaattgttcttgtacctttgtccaaaatcagtttactgtacttaaatgggtctgttttgggtttctctattcctcaattgatttaatgtctgttcctctaccaagatcaaaaagtcttgattactgtagctattctttttcaaaattgcttaagataaaatagtacctgtgttttttcatataaattttataataacctcatctgtgtttacagaaaatctttccggtgttttgataagaattgtgttaaaccaggatattggttttgggaattttttttttaagtactttgttgagtctttctcttcatgaagaggtttgtctctccgtttatttagatcttgtttgatctcttttatcattttgtagttttcagcatacaagtcctatatgaattagatttataactatcacttttggggggcacttgaaatggtattgtatttctaatttagattttacatgcatattgttagtatacagaatacaacttattttcaaatgttgttttttgtatcctgtaaccttgataaatggagttattagtttgaggaacttatttgtagttctttgaaattttctgtatagacaattatgtcatttgcaaatgaggacagatttatttcttcctatctgatatctatgctttttaaatttccttttcttggctaattgcactgagtagaacttctcatgcggtgtgaactaagagtggtgagagtgaatatccttgtcttgttcctgatatttggggaaaaatgcattcagtcttttgctgtttagtacaatgttagctgtaggatttttctctatgttctttatcaaattgaagtagttcctttctattcctagttttctgagattttttttatcatgaatggatgtagaattttgccaaatgctttttctgtgttaattgatataattattaggtttttcttttatagcctattaatacggtagagtacattgcttgattttcagatattgaaccattcttgcaagcctggaaaaagttctatttagtcaatgtgtataattctttgtatgtatcgctcaattttatttacttatattttgttaaggacttttgcatctgtacttacgagaaatactggtctgtaattttctttttgtaatggttttattatgaggatattactggctccataaaatgatttaaaagtgttcactccttatttgtttgctggaagagattatgtataattggttttcattcttctttaaacattgtgtggaattctgtagtggaaacccatctgggtctggaaacgtcttttttagatattgttaatttaagaaattaaattttcttaatttaagttattgggctacttaaattactgtttttcatatttggtgggttctggtagtttttctttgtaaggaagtggtccacttcatctaagttgtcaaatttaagtgtgcagaactgttgatagtattctttattgacttcttgatgtctgtatagttatattccttgtttcatccctgatattgataataatgtctgtgtcttttttctgtgtcagtcatactagatgtttgtcaattttattgatttttttcaaagaacaagttttgtgttccattgatttttctctcttgttttcctgttttcaacttatttttttctattctgttatcttaattatttcttccatctgcaagctagaaaaccaggaaagctggagagtgtagttcagtctgactctgaaggcctgagaatgaggggtccagtggcgtaaatctcttttcaagactgaaggcctgagaaccacaagggctgatgttccatctccaagggcaggagatttggatgtcccagctcaaacagagagtaaatttctccttcctctgcctttttgttctgtttgggtctcaatggattgaatgaggtccacgtgcccaaatagggcatcttctttaataagtctaccaattcaaatgctattctcttccagaaacatactcacagacataccaaaaaataatgttttaccagctctttaagttgacacataaatttaacaatcacatgtatctttttttaatttttgctgcctatattgttttatttaaagagagtttcttatggatagcatagagttgattcatttttacaagttactgtatcattgctctttcttctgtcctagtgacttaagatcctttcttttagctatttttttttaaaaatagaacttcctttagccattcttttagggtagttctcccagtaactatttatttatttatttatttttatatgaggttgtcttgattacctgttgcttactgaggaatgtttgcacttgatgtagaattttggttgacagtttcttttgtctttttctttctttcttttctttttctttcaagccattgaaaaatgttgttctctttcttctggccttcagggtttctcatgagacatccactatccttcttttgtctagatgtcatgacttctttctccctggctgcttccagatttttttgctatctttagcaaagtttaactatgatgtgtcttggtgtgggtatctttgagcttattctgttttgtattatcatagctttttgaatctgtaggtgttgtttttgccaaatttgagaattttcacccatcatttcttcatgtacttttaaagccctattttccttttcctctctctctgggactctgaagacacaattgttagatctttggttataatcccacagatacctgatactctgttttttgttgttgttttgtttgtttgttttgtttttcagtctctttttttctcttttgtttagatgagtaattttagttgttctttcagttcactgattctttactctcctccacctggtcttgagcccatccgttgaatttttttaattgttttttttttatttttatttttttgaggtggagtctgctcggtcccccaggctggagtacagtggcatgatctcggctcactgcaacctctgcctcctgggttcaagcaattctcgggtctcagcctcccaagtagctgggattacatgcgtgcgctaccatgcccagctaatttttgtatttttagtagagacagggtttcaccatgttggccaggctggtcttgaactcctgacctcaggtgatccgcccaccaaagtgctctgattacaggcttgaaccatctcgcccagctgatttttaaaaaaaatgcattttactctggtaaagatgtatttaatgaaatttaccatgttaacggttattaagtatacagttcaatactgttaaatatattcacattgctgtgaaacacatatccagaagttttccatcttgcaaatctgaaactctttacccattgaacaactccattttccttgctcctctcagcccctggtagccaccagtctactttctgtttctctgaatttgactactgtggataccttatgaatatggaatatacagtatttatctttttggcactggcttatttcacttcataatatcctcaagtttcatccatgttgtagcatgtgacaagattccttcctttctaaggctatataatattccattgtatgaatatacggcatactgtttgtccattcatccattggacatttgagttgcttccacctcttggctattgtgaatagtgatgctataagaccctgcttttagttctttttggtatgtatgtagaagtgggattgttggatcatatggtagttctgtgttaaattttttgaggaacctccatagtgttttctatagcagttgcaccattttacaatcccaccattagtgcacaagtgttctaatttctccacatcctcttcaatacttgttctctgtttttcttgatagtagcaatctcaatagatctgaggggataatgcatttctctaatgattagtgatgttgagaatctttgttggctacctgtgtattatctttggagaaatttctattcaaactttttttcattttttaatcagttatttgtttttcattgtttggttgcagaagttctttacatattctggattttaaccttttttcgggcatatggtttggaaacattttttcccattccataggtttctttttcactctgttgattgtgtcctttgatgaacaaaagtttttaagtttgatgtagttccatctgtctgtttttgcttttgttacctgtgcttttgttgtcacatccaagaaagattgtcaaatccaatgtcatgaagcttttcctcaatgttttcttctagcagttttgtgattttatacttttatgtcttacatttaggtctttatccatgttgagttaatttttgtatatggtgtaaagggtccagttttattcttttgcatgtgagcgtccagttttcccacaccatttgttgaataaactatctttctccattgaacggctttgacacctttgtcaaagattgtttaaccatgtatgtgaaggtttatttctgggcttgatattatattccattggtctgtttatctgtcttcgtgccagtaccacactgttttggttaccacagttttgtaatatattttgaaatcagaaagtttaagtcctttaactttgttctttttctaaattgtttggtgatttggagtcctttgagattacatatgaattttaggatgcatttttctatttctgctaaaattgccattgggattttgatagagattgtatttatggatcatttgtggtactatggacattttaacaacagtaggtataacaatattaaagcccatggtcaaccacaaacatggaatgcctttccatttatttgtagctcttttatttcagcagtgttttgtattttgggagcagtgttggaagtctggactccagtacttgtctttacagtttccctcttttctgattctttggctaaagacaacaaacttttctaggggcttgttttggtatgtgtcattgacattactgggtttctgttttttcaactccaaatctgatgacatcatatatcatatcggatatatgagacctataaaatgaaaactcctggagaactcaccaccatgtcatttttgggggcccccaggttttaagccagtacgtcatcttcttttcacttttcagagtctgtttatatttattttatgtataatgttgagggattttagttgtacttagtgtggataatagggaaaagtatgtctactccattttcttggaagcagaagttccctaagatgcttttaaaacagtggttaaataacataatgttgagagtatttgcatggtgcaaggcctgagtgctcaatagagggtgataattgccttttattatcttcatctttctcctatttgaagtatcagtcacactttgctatagaggcagctccagtttaagtttaccttgctttagataaattgtattatcactaacacatacatttgcatcttcataccctttattgcaattccatcaagatgtagattccagaaacaacattgtcttttcagtatttttctttttccaggcaattttgacaatgcatttttgtaataagactggaattactaattctggttttattgaaaaactgttagccatttcagccagaagaagatcatggaggaaacaataaattttcttcatgagctattcaatccaacgagatactgaattaagtgcaggaaatcagtacactttttgtttgataagaagtgttcctctgaaaaaccattcttagatcattataaatattattggttggatgcagtggctcatgcctgtaatcccagcactttgggaggccaaggcaggatgattgcttgagctcaggagtttgacaccagcctaggcaacatggtgaaaccctgtctttataaaaaataaaaaaataaaaatttagctgggtgtagtggtatgtgtctatggtcccagctaattgggaggctaaagtgggaggatctcatgagctcaggagattgaggctgcaatgagccatgattgcacctctgtattccagcctggacggacagggcaagaccctgtctgtctcaaagaaacaacacacacacacacacacacacacacacacacacacacacacgcacacacgcacacacacacgcacacacacccattaccagtcttcctgggaattttattctatatctgtctataagtttaaagttatgtactctagcttagcctttaacttcagagttaatttgaaatttatttaaaaactatttttggaaatttacataatcatgatgactgcatgtaaactgttagtaatattttatagagtttccttgggttttctgttagaatgaagtaataaatttgtgtcagaaaactatttgggaaatttagaagaaatttaagctaaggaacataagctgtggagcatggccctaagaatccttttattctcatttgataaacagtagaatccagacagggaagaaccttattttctctgcctttgctagttggtggaggaaaacttgctgtttgagacaagtaggacttgatctttctatcctgtacttttttcatcatcctcaaagagggcttatttcagtggatagaccattcatagttttgacagctcaaataacccttaaggatgagcaacaactgaaaagttccaagggctttatttccaatggaaggatttcaattacagtcattttttcaagttagtacaaggaggtaaatggaatcacagtttcaaatgttaaatttgaagactacaccattaccagtgtattttggaaataaaagatgcagccaatctaaatcaaagacatgattccagattacctcataagagtatgaggaagactacaggcagcaattgagccacttgatatggaagagtatgcagtgcatcaaatgtgactttcattaagccgtgttacccttgtttgctactgagggcaggaggcatccttttcaacagcctgtaatagcttcttgttgaaaggctgcctgctatacagatgcagcagcagagagagaaaagagggatacagattcacatattcgccttgttttttaaatgccatttttgccatttttggagttggtttccagtgcttagaatagctgtaagtatatagtagttatttactgtatgtttttgtgtgagtaagtaagagaaggaattaatgaattaggctttataaactggaagtttttgttgtgcacacattaagctaagcttctatcccttctcttctccacatggtaccaccagacttttccccacttcaccccctcatctaccattttttgttttgtgtttttgtttgtttgttttttgagatggagtctctcactctgtcgcccaggctggaatgcagtgatgccactgggttccagtgatcctccagcctcagcctcctgagcagctgggattacaggcacctgccaccatgcccagctaattacatcaaccttttaaaacttatttttctctctagaatttgtttgtgtgcacttaaagagtaagtgggaggatctcaagacagtacagaaagagttggacatctagttcagttttgcagagggagtgcagagaaacttccttggagttatataattgatttttggaacctcatttgtaggatagttgtgtggagaaaggcattcaaattgcattcactgtacttcttaggccaaggtagatctggttatgtacatacttgttatttggtagaatactgcttatgttggcattatcttttccatactacatttatgaactggaaacagttaaagcttgaaactgttaaaaaaaaaaagtgtacgcttacattgtatgtattagaagtcatatgattacacatcctcatcctctcaccagtcctttcatgtagagcagcggtttgcatctttggctatacattggaactaccttgggaattaaaaaaaaaattgatgtccaagtatcaactctggagattctgattcagttgatctgggatgaagccttggcgtcaatttttttaaaaagatccccaggagtttacaatgtgcagtgagggctcgttttagaatggtatattgatttgtgttccaattgttctttcttgcataaatcacatctgtaattcattgaccacagttgtctatgaggcttattaaaaatggtataacaacttacacatacatgaataattggaatgcagaatcattttaacttccctttcccagtctttctatagtcagtttgtatttaattcaacaattgttttttgagaggcccacatttattaaatgtttatcttgtccagcttaatttctctagaaacaaaatctcaccttcattttgtacttatcactggtttacatgtggtaaataaaattagcagaaacaggtttgggtatggtccactgtggtacacgggtgtcttatagagatgagtattcattggctatgaaatgttcagtaagttttacaaaggaaacgaagatcatcagttgatctagctggtcagttggggtcagttaaaagagcattattgtaaaagatttgtggtttgcctgattttagatcagttaacattcacccatgagaaggtaggatgtatgtcatttttattttataagtgaatatgtaactgtatttttttattttgtatttaaatttttattcaatatttcaaattaattaatttctaatgttaatacctaatatacatagatataatcaatatgatcactgttatctctagagtgaagacagtttcttgccaacaatttttatatcccattataaccatccagatgagttcattatgggctttcagtacacactatcagcgcttaagagtcttgagttcattctggtctttgattatcacatgtcttgaaatacacaccacattagatttgtaaataaattgtagaaaaatcttaagactgaaatttagatattaacaaacattatttcctcttgagatatgctaacagacatcagagcattagtaggtcactaaagagtgaagatgagtcagacccatcaaaatacatatactcgttctaccacttgatatgtacacacttcgagttggtaatttattcccagttgtttgtgacggttgcatttgtgcttatcttctcttagtttcacaagggtagctaatcatgagtttttgtctgtttttgctgaactttacctactgtcttattaatcttgtttatatcagtgtgagtttcttaaggacaaggactcgtaggcaccaacacagaaagcaattttaggaatatactgtctgaattaaatgtattaaatcagtcaacaaataggaaccttttgagaaatggtcctgaaaacatttttgtttgctttttttcctagagaggaaataaacgggtttataagctgctgagtgcaagtatcatggtctgtgccttttcttcttgactgctctgctatattctctttcagaaagctgagtagctcagcacagtgaatactaaagggaatgcattccttctctctcaggggactgaagcagtgtttaacaccactgtaaaatcctcagctgtggctttctctggtgtagaatttgtctaagaaagattaaaagaacaaggaaagctttgtgtgctgtttctctttcttttcttcacccctcctgctccaggctatcctgaggggggaaaaaaaacgtggagtattttccttggacctctggagtatgcatgttatgtatgtgtgagtcttagagaaaaataaaggcaaatgcaaggcatgcctgctagtgggagtcatcacccatgggtgaaatgaagaaaactacatgagtgcgtttgcgtttatacggccactttttccattgaatgacccaaacaagatgccagtgacaaagcattggtcctacatgtgataaaacagcggcctggccatttgcttaattggtggagaactcaggtgtgttactcttggcagaggtgaaagccttcatagagaattagaaggggtataatttgggcactgtactcagaatctttcttggtatattgtttaagagcttcattgcagtgactgccattcagcaagaaataagagatgacttttaaatatttggccagattttatagtggcaaggacagagttttagagctgaagagccatttagttcaatcccatcaatctgcaaatgtgaacagtaagcccagaatcacatttagtgttagtggccagaagggagaccttggctatgaacatttaccctaccggaaactaatggcgtaaccagatttgaaccttttcttccattctgtactaggttgtcttttctttgttaggaaaagcctattataaacggaacattgacatgaattttaatttttgcatattttcttacaacatttgcccttactgcattttataactaattgtatatacttttatattttcctttttgtactcatgattctaatgtttctatgtggcatttctcacaatctctgtggggttttattataatttgctaaattattcccttgtttgggggcatttatataaactttttttttttttgccatgaaagagaaagccacagcaaacaatgtatatatgtagctctttattctctcaagttattgtttttgttctcatcatctgagttattgggggtgacttcattacagcagtggaaaacacatggtaacctgccagcatcagaaggtgtcgctttgtactgtgtgtgtgtgtgtgtgtgaaggttatgtgggtatgactgtgtaggaaagaaaaaaagtgctactctttgtagatcaaacaattgatgagtcttaatgtaggattacgtgttgcctgttaaattgctatttctgctgagaaagataaaggcatttttattagtgtagttgattagctttattaatgttggacaaaatcaatgttatgaaaatgaaatctatagttttggggtaaaataaaatttaataggtaggtgacccattcatacacttatgtgaagtaatttttgaaatgataacatgcatgaaaatttactatctatactaaatgtatattcaaagatattcttcctctagggttctagttataaacccttataaacccttataaaatactatgattcacatatacaacttataaaatactgtgattcatcagacagctctagtttcattttatctattgactctgatttaaattatcactcttttttatgcaggaatatgtggtaacaagttatatggtaagaaatttaaatgtaaagattttgacctaacgttgattcagattgtagagctgtcagttgaaaagggaaacttcatgtttagaaatttgagttctgctgggcgcagtggctcacgcttgtaatcccagcactttgggaggccaaggcgggcggatcacgaggtcaggagatcgagaccacggtgaaaccccgtctctactaaaaatacaaaaaaaattagccgggcatggtggcaggcgcctgtagtcccagctacttgggaggctgaggcaggagaatggcgtgaactcaggaggtggagcttgcagtgagccaagatcacgccactgcactccagcctgggcgacagagtgagactctgtctcaaaaaaaaaaaaaaaaaaaaattgagttctaaaatgtttgtgaaaaatttgataggttctttaataaatgtttatttccaacaaaaattttcctggtggaggagttattaggaccagtgagcatgcatttttttttaccgtcttgattgtattatcatattagcttcaagaaatgtttgtttcacgttacttatctttgtttgtcaatgaggtcagacactttcccccacgctgagaacagtatccactgcctctgaggtggatagtctctagaaatcctttccctgtcctggagcagtttgcctgaaagtgccatagttggtagcaaattcccttccactcctcttcctgcctgttaacactttctggaaacccaggtccccatgtgctttagcactctctgtaatcatttgtgggcctctgcagatgagcagtctgggagctgtggatgaggggctgggcaacttctgtcatgtgccattgctgtgagatcttttcttcaccagaatctgggggtgatttagaataatggttagttagtgacatgaagttttggaaagttttttgttgacatttttaagaagaagaaaaactgatgatgaactaaaataaagctgttctttcagccatgtctctgaaaccattgagaaggtttccaggtacattttgggcagtaaagaagatgtggactgggcattcctgtaatcccagcgctgtgggagcctgaggcaggaggatcacttgaacccaggaggtctaggccacagtgagctatggtcatgccactgcactctagcctgagcaacagaggaagactctctaaaaaaaaaaaaaaaaaaaagaaaggaaaagaaaacgtgccctgtttttctgttgttgagccttatttattttccttgctctcagcagctctgtggttccatcacttggctgccttcacggtgcctctgactagttttggaaatagaagtggtggtacaaacaacggggtggagttgcaggatacattgtggtgatatagtcttttcattctctatatttcagccaatatgatcttttcaaaacacaggttacattatagcattctcctgcttaagatcctctagggcttcttattacgctaagaataaaatccaaatacttggtcatggcctatgaagccgtatgtggctccctgcccacttccattcccactgtccatctaggtcctcaggattcccttatcaaactttcttcagttgctctaccacacatccccatgtggtgggttccattctgtactgtagctcttaactcaaacattagctctttagtgtggtcttatcttaccaaccatctaagtttgccccctttacttttttttttttttgagacagggtcttgctctgtggcccaggctgaagtacaatgaagaatatgattcactgcagcctcgagctcctcggttcaagtgatcctccagcctcggcttcccgagtagctaagactacaggcacgtgccaccatgcttagctaattcttaaaaaaagttttttttgtagagtcagggtcttactatgttgcccaggctggtcctgaacttctgggcttaagcgatcctcccgcctcgacctctcaaagtgctgggattttaggcatgagccaccgtgcccagccgctttacttatgtcttactctgttattgtttcctctgtatcttcttaataccacttataaacatctgaaattacccctttgtaaatgtatttgcttatttattattattttcttctgacttctttcattgaatgaaagtaagttccatgagagcaggaccttagggatgttattaactgttacatccccagcacctagtgctatgcctagcagtgagtaagaacattaatatttgttgaatgaatgcttgaatggccaaaacaagcccctgttatgtggcaggagctgtgctagcagtaaaaaatttagataagttgaattcagtctctgcaaacaatgttttccataatctggaattgttgtttggaattctttacagaaattcacatccaggctcacttggaaaaataatcttgctgattgtaatttttctcgttatggttgttcttggcagtaaagtcagtttccaggtgagaatgttactgctcttggccaaaggccactgtaaactttccagtattcctgagggtcttcaggccttactccttgaataagacagtgctccttgcttgaagaactaagttttctgagagtagaagggaacaatagaaagtgtacacatcagcattaccagtttattgttttctggacagttatccaaatttgcttaaggacttaattattaccagatcaaataatgttcccctcactttttagtctagtatatgctgtatgctaccctgtctgtgattctgatttcaaagtgagaaacaaattagcaagcagttgtttggtgaattttaaatgcagtggtgacccttgcccaatctttcataaaaattattttatatttaatgagttatatcttggggttccacaaatagtaggttcgatatttaggattaggtgcataatacctggagttaagctttgcagagctggaatttggactgtgtgtcttggccagaccctggaagcacaaggacaatgttgagatgaaaagattgagaatttaaaatctgtaagaatttaaagccattttacatcacaccataatttctcttcgctggattaagacatttcacagctatttataaaggagtgatttgctactataatttaattcacttgacaatcgtaggacattggatccatagttatgtcaagctagattagatgcaaaattggtaggaagacttttgtagattaaagacatatgacagtgaaatgcagaatttgagcttctattgaatcctagttcgagggaaatgctgtgaaggtcatttggggacaactggggaaatctgaaagttggactgcattagatagtattgaataaatattaaataacctcttgagtgtgttaatgatattgtaattatggaggacaatatgttccctttcttgttctttttgctttctgatagggtcttgctatatttcccaggcttttatagagcagtggtgtcatcatagctcactgcattcttgaactcctgggctcaagggtcctcctgcctcagtgtctctgtagccgggactacaggtgtgcgccactatgccctgtaaatttttttaaaatattttaatagagaccaggtcttgtgatgttgcccatgctggtctcaaatttctgtcctcaagtgatacccctgccttggcttcccaaagtgctaggattacagggatgagccaccatgtccggactttaaaaacattgttttccaatacgtcatgactattttgactatttgattggttttaaaatatctagttcattttcatgttgttccagatgaattcacttttatattgtatcagttgatgccatttcaaacttgaaaggtaaaagtagtcactgttcttcaaaccaaaatgactactaagaggtgtgcgtgtgtatgtcaggggaggtggagggaaattgtggatatgaatgaaaataatgagtgtaactttgatcacacagataatacatctacagcctttactaaagctgcctttacagtttctggcttcagagatgtggtaagtgcctcttgaaaggttgatatattacttttaacaacataaaaatgatatttgccttttttagagtctcttttttgttcactcagatttaaatgtatcatctaacagtcttctctttgtgcccatgttcttccatgagacacttagaatgtctaaaaagatgagtttggtattgttctagccttccctttgtttttaagggggactttgagtctatcaagagtgtgtgtgtcagctaagattgtatagctggctggtgcaggagctggaatttaatgttgtttttttctggcctctcagtacatcacattgtcacttaagtgagatggcaagcatttcaggtgctcttacatatatctgcaagcatggataacatttaatgccagctctcataattatgcatcacttgttgaattatttattgtacataccctactataaattgtaaactcctcaagggcaggatttttgtctgttttatgcattgcttttttttgtggtatgtagaactctgtctggaaggtgataggcactcaacaaatatttattgaatgaatgagtgaatcaaaatagaatgaactaggaatagattaatggctgctcactttgcaggatttcagggaaataattggtcagctttaacaacacatccccctctaactagctgatctaaactgaaaaattagacactggcttcctgtttaatttcccgtactcgtgggagtgataatacattaagctcacttaggtcagtgatttgacaacttagagtgaatgatttcaacaacccctttcctaggagcactttttgttgggggcagggaggacgggtggagtgctactaagttgaagaaaagtacagatggaaaggggcaggaaaaaagaaagacaaggagatgcaaagacaaactttgagcgtatcatgattttgagcaggacaactttgctggtatgtgggttaagaaatactttggaataaatggcatggtctgatctgtcaaacttgttcatggtcctgtggtcccaagaatctgtaccatgtaatttgtaactccagatagtcaagacttgaatttggtaactcttgtaattcttggtattgtgtatggatgctcatgtacagtttcaggagagtaagctgttgttcccatcttatgtgtggcttattatatcatgagttattactgtttgtcagttattcctgggtaacgctgttaagaaaatgctggcacttcaaggggtttgaggaaatgttgaggatcagatttatttaatatgtgcaaaattctagattaggtagaaagttgttgaaatcatggatctaaagtgaaaaattgagctttttagagcacctattagagatcagacaatttctagtgtagagcctgacacataagagttacgtaataaatatttggtgtgtgggatgagagggaaggagagaggaggaatgttgtgagcagctactcattgaagttgtgaatgcagccaagctgatggttccatagattgtttttctctatgttgaggctttaaatggtatccttaatttactgctacctttcagatgaatgcaactggacatcaagtagactaggggaagaagagtacatctgttttccctagagaacagggaccccccgccccgggccatggaactggtacctgtccatagcccattgggaactgggccacagagcaggaggtgagcagcaggctaacaaacattaaggcctgagctcctgtcagatcagcggcggcattagactctcataggagtgctaactctattgtgaactgtgcgtttgagggatctaggttgcctgcttccatgagaatctaatgcctgatgatctgaggtggaacaggtgcatcccaacaccatcgccctcccatccccaggtctgtgggaaaaattgtgttccatgaaaccggtgcctgatgccaaaatggttggggaccgctgacatacaagaagagtaattcaaaaaacagaaatagcaatacaaagttgcagtctgaatttgtgcatgctattttacctcttggtgcctcaatttccttatctgtaaaatagggttactaatgtatatttcattgggttttttgggtaggagtaaatgaggtaattggtaaaaaggagtttagatacagcatctactgaaatatcagccagtagaagtattttgcggtcaatttgttttgtatgtgcccagagggaagggaaatatgcttaccaattttgttcattgttaccgtctgtatagaattttgactatttgattggttttaaaatatctagttcattttcatgttgttccagatgaattcgcttttatattgtatcaggtgaggccatttcacacttgaaaggtaaaagtagtcactgttcttcaaaccaaaatgactactaagaggtgtgcgtgtgtgtttgtgtgtgtgtatgtcaggggaggtggagggaaaatgtggatacaaatgaaaatatgagtgtaactttgatcatacagataatatatctacagcctttactaaagctgcctttacatagtttctggcttcagagatgtagtaaatatccactggaatgttagctcttaaagctggtggtcatatttatataggttgggtatcccttatctgaagtgcttttgacagaagtgttttgggtttgggataattttggattttggaatatctgcattatacttataagttgagcatcccaaatatgaaatgctgcagtgagcatttctttggagtgtcatgttggtgttcaaaaactgtttggattttggagcattttggattttcgattttcagatttgtgttcctcaatctctgtggtttaaggctgagagaatagatctaatcagcagtcagtagagctcattagtagaggagagaggagagttttcttttaagaaggctatggggtcttgtgaagagacgagatagcttgtatttaattcacctgacagtcattagctagtaaaaatgaaagagagtctgggaactggaacagagagctggaaattcagctccttccaggcagatctgccttgaaattccggggaaatcagaacaggaacctcttcatttcttcatttcccttcactgcgtagtagtttattttgtgcttttggtaaaatgattcaaggtccaggagacatcctgaggtgatgcagtgtaggaaagcatttcagaaaggtaagatggaagacagatctgggcacagcaatgtgaattggacatttcgttcatcctttgggcttcctagaattagctgtgatccataggactgtcctgtccatcctggtgttctctcagaatcaggagcagctcactgtgcgaaaacccatctgaggaaaacaagaatgagctgatggtcactgtatcccaaattgacacactagttaggtagcccttgggtgtgaacttccttaaaatatttaaggaaagagactgctgttaacatactcagggaacaattatatgttgtttaccacatgacaagagaagaaataaacgttagacatatttctgggagcttagataagttgaaatatggaggaattaaatgctatatggtatgataatataaatcatttgaaagttgaaagttttgttagagctaagaaaggccttgaaaccatccgatctcaatcctgtaccttaaaaattgggaaactgaagctgaaagatgggcagtgatttctcccaaagttttgttgcaaaatacagggcttgtcttgatatcggaatactttctattctaagacattttttttgtctttaagataaccagatatgtatctgagggtagaacatacctcctctgtactatacctttgaagtttttgtttatatatatggtttgtgcatacttatgtaagtgttgccctcaaaatggaaaagattcaattaggcaagaatatcaggtgttgaagtcattttatccaagagctatgaagtctcatattagtcagttgggcatatcgtcttcatgacctttttgctagtgttcccatctgttgtatcattgctgattgtgtccatgtgagacggaaaaggagcattggactcttagcctaggaaccatataacaactataatttaaagcagatgttattaacctagcataaaagatgtgagaagtctgaagtgttagagccagagaaaaggtgagattaaactcaaatcttctgaatctaaaagccttgttccttccaaaataaagataagcatatccttctactggaaactttacagactggcaagagtaagaataaaaagagcaggtgatatatgattgattgtgccattattgatagttactgatctgttgcatagtaatggagagcttgattggatggtgatcctccctgtgtgcctcctgagtgtatttggaacatcatccaggaaggccttttaaagaagacaatacttggagaaggttttgaatgtttgaaaagaagcatgggccaggtgtagtggctcatgtccataatcccagcactttgggaagccgaggattataggagtttaccagtcctccagtgggaggatcccttgaggccaggagtttgagaccagcctgggcaacgtagcaagacttcgtctctacagaaaaatgaaaacataagccagacatggtggtgtgcgcctgtagtcccagctacttaggaggctgtggcgagaggatcgcttgagcccaggagttgaaggctgcagtaagctgtgatcgcaccactgcactccagcctgggttacaaagtgagacccatctcagaaggagaagaaaagaaatgtggtttcactagagttatggaatcaggttaaaagacagtattacctttaatgtaaattggtggcacatctctgcatcttagcctcaactcagaatattattggtttaagagtcagagagcttaggggtaaaaggctctaaaagcctctgaatttcaggaggttggtactttcagcggtctgtctccatctctcagcactacttcctctatgggcttcttgtggttcagagacaaagacgatgactgttctgcctgctcagcagtcctgggagagagcaaggctcatcgtttctgtgtccaacaacaatcttgcagcttccactttacagtcctcctttggttatgtggctattcttgactgattgactggatatatgtatagtcatcccactataccctttagtggggcgactctcatggccctctcagcattcccgaaactgctgggaccctgaggcaggtggggttaattcttcaaaagagacttcagctactgttaccaaagagtgaataaaagggctgaggtggcaaaaacaataatgggtttttgaatatatgttactaggctaggcacagtggctcataattccagcactttgggaggccaaggaggaaggattacttgagcccaggactttgaggccagcctgggcaacacagtaagaccttttaaacaaaaattagccaggtatagtggtgtgtacctgtggtaccagctacttaggaggctgaggtaggaggatcgcttgagcctgtgatgtacagtctacagtgagccgtgatcatattactgcactttagcctgggcaatagtgagaccctgtcttcctgtctctctgtctctgtctctgtctgtctgtctctctccctctctctctctgtatatatataatcccagtatgtttttatttctttctacagataggggaaggtgatctatttgaaagtctaatgcagaataaagtagtagtagttatcccctggcagagtaaaaagataagcaaaacttgggacgtcaacttacagcaagagctgtatggaagagaacagtgtggtgtgtagagagaaatcataaagctggctgctttgggccccaagaaagtctcgcttgtgatggttgtatacatggccgtgtggagcttcagatataagaaaagaattaagagatatgtattaataaggctgggcatggtgcatgtgcctgttgtcccagctacttgggaggctgagtcaggaggatcgcttgagcccagaagtttgaggttacgatgagctatgattgtaccattgcaccccagcctgggcaatagagtgagacattttttccatcagctcagtgtattaaattggttttctaagttaaaggttcacaacttcattatcgttactatgcagaattgcacttggtcctgaaatctgtctgaatttctgaataatagtttcttgtcctcaacttgtgtggtctcaggttttaaaacaaactaaggttgttactgccaatttctaaccactgttgcatttgtagtaattgagtgccagtggttggaggtttagagaaggtttaagattaactgattccaaaaatatctgtgtgtgtgtttgtgtgtgtttccatgttgtctgtgtgaatatgttagaataggaatagcatatgttttgattaggcatttttctttgttcaacatacactttggaaaacctagagaatttcagtgggattatagtatataatgactatattctgataaaatcgtggagtcttaacatttcgggtaacagattatctgctatttactggtatgttgattcgtggacagatgcttctctgtcttcaggtaggctccccaggtacactttcttgcagtcccttctaccaggtagacatgcaagaattaacaataaatgccacacatgtgtgttttctcttttttctgcttgtgagaggtgtttaaactttgtggaaatttattagaaaagatccattgtttggtagttctgatagcatcaactcgccctttatctttcatgatgcattgagacttccattactttgtagcgcctgactgctagaattgttcccagagttcaggggcttccaaatgacaatgggctgtaccgggctttgtggccttaataagccctctgttactggaattttaaatattggcatacctatcagagtctggccgtgtgtcaggagaatgttggctttagagccaccactgatggatcacatgtttttttctcaagagagcaaacaagcactttttgtttaggcttactaatgtttggcaaagaaatatagctgtaattatatatcctcgttcttgttactctctccccatctaaattttactctccctacccctaactttatataaaagcaactagggttggatctgaaataaatgtcatgaatgaataataatttctttcatttacacagtaattcaacctgttgaatgctgacttaatgctttactacactctaatttgactggaagatttggccttcgtgaatgcaaagaagaggtaaaaaatagaaattaaataccgactgactatgaaggaggacatttttcagaagggttctccctccttctatttctcatcttcttgtgtttgccccctgctttctgtgatacttaatacttaggagttgttccacaaatcattctttactttgtgtacccagcagtatcccagcagcaggattctccagggacaaggcctaggtctgccactgagggtagtctgcttccttcatcagaattgccgctgctggccttctggaccattagagttctttctggttgttatccacttttcattccttctcaacccatagaattccaggtggtgagtcagtttttctgtatgatcatgcttgacaccccaaaatctacctgaaagtttgacagatgcatggaagccaggagcattttaggaagctgtactgctcttctgagattttctgcctacttactgtctgagcattcaacctgtctctctcaaattttctctttctctaaggtgggtccagtaatgcgagtcggcagcccactttgctgttcttggaagcgaagtactttccaatagaagtcagttttaatcttctttcaccgtgaggaatgaatgaccattttaataaataattcattcctacagttcactccgtaaggagcttctaagctccctccatgatggtttctgatcctgccagggtactgctattttatctgtcaaatgtgggttgttagaggtactgtgtcataagaggcagtgcagttcggaaccctggaacccccttcataaatttgcaaaacacagtgcatggggcctgctatggcaaggtatgctacatggagcctcagctgtctgctccctctcttctgtcagcacagctagcagtcagagacaaatggctaaccctctttgagtctcttggagtaaagcctggttgtgttctgcgtggattgcatcctgtgcagattgtggatagcaagggcttccttgcaggcctgttgggagcattgattgagatcatgggtgtagaaagcctggactatagccagagtcaataattattagttctttatcttgagacaaagggaagtgttaaaatatttttatatcaaggaatctcctacaaacactgtcctccccactgcccactgccagtatttacatgaattaattttctccttatcttcttactctcgcccacccgcttccctttccttccgttccaaagttatactacacttattcaggatagaaatttcctttataaaaagttgtaaaaacttcaaagtgcctgttgtagtatatatctttaataaatactcccctgctatatttgttaaactataattatgagcatacatttcataaaaataaagcccatttactcataaactgtatgtttacatgaaaaaatacacattttataacccactccagacctactaaatctgggcgttagaatctcaatcttgggttttccaacctggctcctttttcgaaataacctggaacacttaaaaaaaaaaaaaaaaaagcaaactccaggctcaatcccagatgatttacatcagcatattttcagggttggccctgggcatcatttgtttaagcttctctggtgattataaatgtgcagccagggttgagatttaacggtctatcctaagtgcttcttaaggtctgaaactataactattaagtgagctggcttaatttatttaatctttgcagcaaccttatgaggcacagctggcattatccctattttcagatgagaaattatagaggcttggagaagtgtgaggtaataataccaagaatgagagttacttgttctcctatgtcttataatcaaatagtatatatagtattaacatctacttggggatgcaataccttttcacgtgatggtcacaatctatgtattacacattggttttggcatgaaattaaactgaccatctcaatatgccttggaaccaagtgtttgtgtgctgaatccttttgaaatatagacacctggtgtgttagtccatttgtgttcctataaacgaatacctgagactgggtaatttataaagaaaggaagtttatttggctcacagttctgcatgctatacaagcatagcaccagcatctgcttgccttctcgtgaaggcctcaggaagtgtttactaatggcagaagggaagggggatccaatgtgtcagaaggagcaagagagatgccaggctcttttaaacaaccagctctcacgtgtgaactcacagagggataactcactcattccccctggagaacaccaagccattcatgaagggcccacccccatggcccaaacacctccctatgcccagcttcaacattggttgtcatatttcaacatgagatttggagaggacaaaacatccaaatcgtattacctgcaggttgacattataaattcattttgttaaactcagtggaaatgagaatcaggttgaaactcggggtttattactgacttataaacccaggtgtgctttgaatgcattggaaagcaggagcaatttaacattctgtgatttttagaggtttggcagtgaaaccctttggtatttatttaataaatcctgccttcacagtcatggattctttttgaatacacccaatttctcctgcttcccaactcttttttcaagtgactttgttaccaggtaccgttgttgcagaggagtgatttgattattctttctctgtagaaatggtgatgatgtggggcaaatctacctcaaactgtaaactatactcactttttccacagatggggtcttgttatgttgcctaggctagacttgaattcctggacccgggtgaccctcctgcctcagcctcccaagtagctgggactacaggcacatgccaccacacacccagctatattcacattaaaaaaaaaaaatcatctgtaattctaagagctccctgtgtggagccttccaagtggcccacctgtgtgggaaagctgccctgcaatatgggcccaaaaattttccttggttttcatgtatctgagcaagttgcttaaaggtgcctggttctgtgtgtttgagattatttattccatttttactaatagtttagagaaccatgattgtgcatacatgcacctgtttgtttagtaaatatttattgagctcctaacatatgtcatgcattgttgtaagtagtattgaagttacagcatccaaaccaaatagacaaaatctctgcattcgtgaagctttatttaatggggaatatagaaaaaagtataaacacataaatcttaaaagtattttggaaggtgagggatactatttagaaaaagaaaacatgtaaagaagaaatcccccttaccatatttggggaatggtaaaatttttaataaggtggttagggtagacctcactgagaagatgacgttaagcaaatggttgctggaggtaagggtgtaagctatgtggatgtctaggaagaacactgcagacagaaagcactgccagtgtcaagttcctggagtgtttgaggctttagcgaggaggtctgagtgctatgtgatatgtttactacctacctataagagttttatggatttggagaagttttctctgcaatatgaatatatagtctcacaaatgaggataaagtttatagcaaattatcatggatttgattatgtcatggcacttgaaggaaagagagggtgggctgtgaaactcccttaaaaataacccatttttgaactcgacataaattttcagggtcctataattttcttatcaggagtgtctcacactgattgctaggtgtagaaaaatgtatgttgcctgaatctgaaggcatggattgtaggcctggttataccacagttacttgtgggactttaggaaacatgcttcatctggtcctgcttctgtttctgctatcttacaatgaagataattttccccctactttttaaacttatttgcagtgaagactagataaaaaaggatatgactaacacattaaattctgaagtaccacataaatatgacttatttttgcaaaatttaagagcacagaatgttggttatcaaagagtgtttaaaatgacctttctctgttttttgtaagtgttgtttgagagcacagtgatgaccacttaattcctttcctggagcaagacatgtttcttgtgggtttgatttgtacattatcactgaaaaacttcatcagtgacaacaacaaaaaagcccaaaaggaacctaatgaaaatagtagtgaagttttacacattacatagttacccccctgccacacacacacacaaagaacgaaaaaaagaaaagaacttggtgaaatatggtactttatattttaaaaggcctaaatcttgcttgtggaagtgggctttagaaagtttgcagcttttgagttatggagaggtggtggaagatggattatctggaactggatggaaagttgttctaccaggagtggctcataatgcacttggcaaaccgaagtagctgtggtggatgtttgaggtgtgtgcacatgtgcattttgtgtatccctacacagcttaattcgactggatgcagttttctgaattcacctgtttcttgcaggtgaaagtgcacacaaacatgcaagattcacattgtgctcaaagtgttcctgctatgtcaagcacattgaaacaaatttatgttttcaaagtaagctttataacagagctgtctgtacaggggatgattcagtccgatacagtcagggaaccgtacatagaatagaatgactagagtataatctgcaaaggatggaatggcagaagtagtcagaagaggtatgcaatggttggatcaaaaagagctttgtatccagcgtcacagggcctcaaattgtactgtaatcatatgtcttttacctgttctctggcatttaaatattcttgtaaagagctaagccattactgataaaatgtctgttgtgtacagttgtacaaattaaattcagtcacaaaactgaaagaacagcagtgggacatctatcctagtgaaagttagaatacacttttgtggtctttaataacagagttgattgtttaccttctcctttggttagaagactggtatggggattgtttggaatgaagaggtaggagagagaaataattcaattctgtattctcccatcatctttatatttgaactgagaaatgtgtgtttctatcattcattcaaattattaaacaaaaacagagatcaaaataataagaacagatgattaaagagagtcccatctgccccatatccaacctttctctcttcaacctcatttctactcagattagcagatggcaccagttttgggccatggtctctcattttctgattacaaggggttgttcttttgcccgcctcctttaaaacaacaacagaaaaattggtaatgactgactgtatgcccattggccggggcaccaattcctgaggactagacagaagcttggcattcaacccagccttctgccaggatggttctgcctggcagcaaaaagcctggttgaattaagcttgggcttttagatcctagaagtcttgtctattggtggctggaaaaatagctagtactagcagagcctaaaaatatcagagaaaaaaaagcagaggctcttagaagttgcttttcctttttgtttctttctcagacagagtctcattctgttacccaggctggagtgcagaggtgtgatctcagctcactgcagccttgacctctagggcttaagtgatctttccactttagtctctcgagtacctgggactacaggtgtgtgccaccacgcctatctaatttttgtagttttagtagagatggggaatcatcatgttgtccaggctggtctcgaacacgtgagctcaagcgattctccctccttggcctcccaaaatgctgggattacaggtgcgagacaccacacggccaagtttttttctgataaagactataaagggaaggtagggaaaggtgattattgccaatggtggttggtatagtgctgagtgatacagaatgcaggattcatgaattctaattttgcatgtgacctctctgtaaaggaaaatgaccctctaactaaatgggaaagtaaggtttcacagatgagatagaagttcaaggtgaaagaacagtctataaggtaatacctgcctgtctgcagagaatggattcaaggctcctgatgcaattgaattatagcctcattgtcatatttttttttttttttttttgagactgagtttcactctgccaccaggctggaatgcagtggcctgatctctgttcactgcaacctctgccttccaggctgaagtgattctcctgcctcagcctcctgagtagctgggattacaagcacgcaccaccacgcctggctaatttttgtatttcaagtacagatgaggtttcaccgtattggtcaggctggtctcaaactcctgacctcaggtgatctgcctaccttggcctcccaaagtgctgagattacaggcgtgagccaccacacccggccttcattgtcatctttgagttaaatgcattttggctttaataaaaacaatatgagtaaattctgaacctataatttgagtcccaatagtatttcctaacaagtgatataagtaaacactgagaaaagagtatagtgcttacagaatgacagcatgaattcagcaattcctgtttagcaagaggtctgggccaataacttggggatgtcatagacagaatgcatttggctttcagcaaaatttttggtctgctctcccataatctctttgtgaacaagtagaaaaatataggcggggtggcattatgattatcagtattcataattaattttataactttttccagtggtgattaaattttatttcactctagagatgactttctaagattatcataaataatctatccttggctctatcttatccagatttttgtcttagactaggatgaagatacaattttaaatggtaccaaaacttcttgggtcataaatatggtagatgggaggaacaggacacatatagattttaactcttttggcagtggcgaaaataagatttgctaggactaaaagtgtgattatgtttgaaaatccaactgtgaaaatagagaattgatagagatgagacttacgatttttagacgacacttacagtgagtcagcagcatgtagttagctggcaataaagctaatggtattttcaagtaccttataaaatatgttttatgtaccggactgtactttgtatttggggaagaggggatagaaacattgaaggtaagatttgcccagagtcacagatactgttaatgttcacattcttcacattttatttgtacatcactcttagtctttaaaatcaaaatacctaaatagctgtgaaaattcagtggattaaaagctactttgggaaagacagtaaaactttattcaaatagggattttcatataatgttaattttttgaaaaatcaacaattttaagaaaaaaataggatatatgaaaaactagatagttaagttgaagtttgagcatctttcaaagagtagggaagtttacatattgcatattatacatttaaaaatcagttccagacatatttttgttcattcatatatatgaatatattatatatgactatattatatatattcatatatattatatgaatatattatatatgaatatattatatatgaatatattatatatgaatatattatatatgaatatattatatatgaatatataatatattatatatgtgaatatatatattatatatgaatatattatatatgaatatatataacatatgaatatataatatgtatgaatatgttatatatgaatatattatatatgtgaatatatataacatatgaatatatataatatatatgaatatgttatatatgaatatgttatatatgaatatatataatatatatgaatatgttatatatgaatatatataatatatatgaatatgttatatatgtatatataatatatatgaatatgttatatatgtatatataatatatatgaatatgttatatatgtatatataatatatatgaatatgttatatatgaatgtgttatatatgagtatctataatatatatgaatgtgttatatatgaatatatataatatatatgaatgtgttatatatgaatatatataatatatatgaatgtgttatatatgaatatatataatatatatgaatgtgttatatatgaatatatataatatatatgaatgtgttatatatgaatatatataatatatgaatgtgttatatatgaatatataatatatgaatgtgttatatatgaatatatatataatatatgaatgtgttatatatgaatatatatattatatatgaatgtgttatatatgaatatatatattatatatgaatgtgttatatatgaatatatatattatatatgaatgtgttatatatgaatatatatattatatatgaatgtgttatatatgaatatatatattatatatgaatgtgttatatgtgaatatatatattatatatgaatgtgttatatgtgaatatatataatatatatgaatgtgttatatgtgaatatatataatatatatgaatgtgttatatgtgaatatatataatatgaatgtgttatatgtgaatatatattatatatatgaatgtgttatatgtgaatatatattatatatatgaatgtgttatatgtgaatatattatatatatgaatgtgttatatatgaatatattatatgtgactatatattatatatataatatatatatgaatatatattcatatatatattatgtatgaatatatattcatatatatattatatatatgaatatatatgtgaatatataatatattatatatatatatatataaaatgccataagccatagagattcagaactaataaaaggcaagttgcttgctcattaaaagctaataaactagaaggaactacaaaaagttttaaggttaagggatgcaaaattgattagcaaaggcagatcagaaagagtttctgactcatgcttcattggtgagaacagcaaggaagaactgggaatgagaatcattgagttttggccgacttagaggcagagtgttttaaaactgctttttggggccgggtgcagtagttcatgagctgggggaaaaaaaattacttcattttcccacctcagtttcagtttcctcatctataaaatgagataacaacagcgtggagtctacacatgaattaatgactttatttatttatttatttatttatttatttagagaccgagtttcgctctcgttgcccaggctggagtgcaatgacatggtctcggttcactgcaacttctgcctcccgggtttgagtaattctcctgcctcagcctcccaagtagctgggattacaggcacctaccaccatgcctggctaatttttgtatttttagtagagatgggatttcaccatgttggccaggctggtctcgaactcctgacctcgggtgattcactcgcctcagcttcccaaagtgccaggattagaggtgcgagccaccgcgtctgactttgaaatattttttttttaagattacacagctaaatggaattctctaggaagcacatccagctgctgaacctgtgatatttttttcttatggaacgttgattgaacagcttccatgggtgacctggtttggatttccgtagggccttgcttataatgctgaatacactgttagtttttacttttgtgtcacaaaagtaaaggttcatagttagatctaagccccttgggggacaggaactgtgttctattcatactttgaattgctagtgtctggcatgtagtagtgattaatatattttttaaaatgaatgtcaagtattatgacaggcactggtacagaaagatcaagaagaaatgacctcttcccttgtgagaggctcactattgtgatagaccaacctctgaacagaggaattaccatctagggggctgttataacaggcatgtgctgttcgagttcaggggaaagatgcacttgctcaaagagggaagtttgggaggtgtacgggaaggaggaacccacctggatcttaaaggctgagctggctgctgaagaagagaggggcacttgggcctggtcaccagctgtgcaaaatcaacaagggcaaggaagtggctgatgaagcctgaaacagggagattcccaaatgtgatctgtgacctcaaaattgaaaattttagttagtgtaattttagtatattttatgtgcatgttccaaagttttttgaaaattggttttatatgtttagcatatggggcaattctaaattagtatatttgattaacgttgtatgctagtcctttgaaattctgcagttggattgtgtatatattgtgtataatgttacctcttttccgacttcatgaacctaacatttaaagtggaaacaaatgcacgcatgtgttagtgtttagtgcagcaagaaagcacggcccaccacttccaagaagtgagtcgttgcatagggtgccccgtcctcagaacattgctcattgttcattttttattcctcagctccttagttctactcaaagtctaatattagtttaactaccaaatggcagaaaccagagtacgttgtacatttttcttgaaggatacaactggaaaaaattttgcagaggctcatgtgatgctattttccttccgtggtgacacttagaattcgtttcacattgcctttgagagaaacgaggaggggggagaagcctgtatttgatagttttgtatgttcctctaaagaaagagagtgcttgaaaaaagaaaggcaggctttcagatgttgtctgaacaaagctacggaaatgtgagacgagagcagcatctggagattttcaaacactggaacatgggctgcacgtttcttttgctgttggaggagtgaaaagctgtttcctgtcatttcccatcttgtcacttccagaaccaacatcttgctacttcttgcaccagctgctgctgctgttgttttttttaccccctccacagacagatggtaaaagagctttgataatcctcgcccaacttccccagttctaaagaagtttgcggtgtggtacctttatacaatgatcacatgccctgatacctactgtagcctgttaatagagttgggaacagagcagaaggatgtgctgcagacttttaatgtctatggcattctttgtcatgtctcatgggaaatgctgtgcacaagccccatctctgtggatgcttcgatttagcttctgaggttatatttagaaaagaggaagttgtggggagtacctttgcttccataagaatttgagatttctgatcaagatttctctgtacattgaatccaggatgggagttgctcttgatattcttgttcgtatccctaggttttcgcaaagcagaattaggcatattggatataccatcttttcacagggctgtttatccttaattactttttttacacctatttcttccaatatttttcttgcattacctagtgcaaacaggaacttagaagttaatgcagaaaatgccgtatgcataggaaagatatttgatgcagacaaccttggttttgttttaagttttattacctttattattacaaactaaaaatgataacctcaatgagggagcttagcctttctgtccccccctaaatcatggttgctttcctaagtataaaagtaacatactcattgtagaaaactttgaaagtagaaaatctattacagaaaatacaaagtcatccataattccttaataaccactcttacatttggtatatttccttgtagcttttttttagagttatgtgtgcctgtatttctcttgtatacttataaacttacattaatattgtggccattttccagaatggatctggtggtagtagtagtggtgatgataatggcataacctaaaatttattgaacatttattatgtgatagtcactatggtacgtgctttacatatattacacatttcatttctcacatcagttctataaagtaaggattatttatttttattttagacatgagaaaagtgaggctgagaaacatcaagtaattttcccaaggtcacacagtgcgcaataggtgaagctgggatttgaacccagatagtctgtcttcaaagctcatgctgtttgtcatttgctcatctatgtttaaaaggtctgaatattttttaaattattgatacatatagcctaagattttctatttattcagacttttcagtcatgagagtacttactgcgctctcaccatcttcacatatcatcaaatatgttttacctttataggtgtttggggtgaatgattgctcagtttttacattggcctttcttgattactagattgattgggcattttccatgtgttattgatcatttttatttaatctataaattgtttatgttctgtgtggctgcttttgttcaacagttaatttttttgtatacaaaatcatcatgtgttaagtatattaactctatgttgtgtttgtttaaaacatgtctccttctgttaacttgcttccttatatttgaagaaaattgtatgaatgttttaaatatgtacatattcatattttttctttataattctctcccacaaatcagttatttagcctatgttttcctttattttatggtttttactatttataacaatttttaaaatcaaatctgaaatttattttaatatatagcatgctatgagactttgaatttattttattgatgggtaatactttttgtttttgttttgctacttcctttaaaaaatattatgcattatatattccactcttctgtggtggcattctttattatatatttgtttattttgtctaccagcgtctcttcaagcaatctttctgtgtcagtggcctgtgtatgggtatgcctacagacattttatggatagtaaatttgtaaaatgtgcaagaagttttttgtcttaaaagcacccagactcagcatcagaaggcccatatccaaacctcagtataacctcatgattgacttgtgacatgaccgcatgtaggcttaaatgctgtcaggaaaattaaaggaagtaaaacgtgaattgagaaatttggagatttctgaaaattttgaaaattgagattttgctgttaatatcacagccgtatcactaaaatttccacaatcctttgaatttgtgaaatctatataaacatgatttaaagtacttatgatattgtcctttttttcatattacccaaagtatggaatttgtggcaaataaataaccaggtatatatggcccatatagatatggtttttatcctgcacttcttttgagatagctgggggctttactagagagaagaaataaaacaagataactttggcaagtatagatgaagtttgagaggtgtcttatttcattttgtgttgctataaaagaatacctgagagtggctcatggttttggaggctggaaattataagagtatggtgctggcatctggtgggggcttttttgctgcttcattccatgggagaaggtggaaaagcaagagagcatgagagcaagaggaagcagaactcactttaataacaacccactctcgcaataaccaacccaactccagtgtgaatgacgttaattcactcatgaaggcagtgaccccacgatctaatcacctcctgtttggccctacttcccaatagtgttgcattggggattcagtttccaacacacaaactttggggacatggttaaaccatagtaagagggaagtttaacatttgtttaacgttggtatcgaaaggaactatttacgttgcagccccgaaaagactacaaataatattggttaaaatagaagtgggctgtattcttttgccattgcagcaagccttagtagtgacctagattcaaaatgttactttgattttatttaaagcactgaagtattgcatttttcctcgtggttttatgcacctactaagtgcagctaccaatgacaaagatcttctataataaaaatgatgtttccttatttttgggtcttttttcaatctgaaaaatgtttctttaatcggattctcataataaccctatgcagccatataatctatggtattattatctccactttgtatatcaggaaaatgagactcatgctaaaatacttgcccaaggtcatatgacttgaaatggtgggactagcctctggcttagctctagtgagacctaaaataatactcttttggtttggtgagttccatcctttctttttttaaagaatttgcatatctaccttatccacttttaaaatgtttaaagaatttatttcaggtgcctgtccagagtgacacatgtcaaaatgttttttaaacagataagtactattcaaatacaaggctttatctttcttactgcctggggtaagatacctgtcttccctgtcccaagttatatgatgcttatttaaaaagttacctgtgagccttgcttattaaagtatgcctcagctatgtcatgaggatatttttttttaattaattttttttgagacagggtctcattctgttgcccaaactggagtgcagtagtgtggtcacagctcactgcagccctgacctcctgggctcaagtgatcctcccacctcagcctcccaagtggctagtactacagtcgtgtgccaccacatccagataactttctatttttggtagagactggggtctcactcttttgtccaagttgatctcaaactcctggtcttaagcaatcctcctgcttcggcctcccaaagtgctgggattgtcagcataaggcactacgcctggctgaggacatttttaaaggtgtatacttcaccatattctcttttcctctacatgaagtttagcaatgttcaagatggtggccactccatcccccttgatgactgagtgactgtgatgagccgagcacctgctgactcacaacagccatagagacataagagtgtgaacaagaaataagcctttgttatttttagccatggagattttgcagttgatactacagcattatgtagcctatcctgaatgaggtaggatcataataatatgtttgttatgcatcacacaagtttttgggttgtttcaatctaaagatctgaaattatacccaaactagatattctccagtatcaccaaacaggatctatccattctacagtgctcaccagattgcttctgtcatacttcacctggacatctgtggattctggatattagaaattggaaggaaaagcttgtaaggggatctcagtgcccagggtcaaagcttcattgttgggcagccaaggaagagatttgcttgacttacttgagtaatttttgacacatacttgatttggtcatcaggcataaaggatggccagattactagtaacttattggagatacacttttaaaataggagttaaggctacttatgtgttgatctgaaattaagaaaagggcaagatttctccctgtggcctgattttcaaccatgactaaataaagcctgaggggagccactgaggatggaaaaggtcactcagtcttttttgctgatgaaaaaatcgagttgtctagctctggattgacatccagcactgacatgctttaggaaacaaatcttttgatggcaaaactctcactagcctcacctctcctctcctttcctctctcctctcctctcctctcctctcctctcctctcctctcctctcctctccctcatttttcccttttctactctcccacttctaccctcatttacttatttctcaatttagctcatcagggctttttgttacaaaaaaatggtgtgtaagttacttagctgtaacttggaaactgttttcccatgaatagatgacagaattactacatgccaaattatcccagaataggtggcttaaccaattgtataattaagttactttaataattaccaagagggtcctgagccccatggaaaccttcactgcttggaggatgtataaatggaaggtgggcagcatgagtcttttggactggtggccggaacaagcagttcttagctttttttaaaatcatctttcatatttcagagcaattctttgcataatccagattgcttctgtcatccttcacttgatcatctgtggattctgagcttcagggtggccatgcgacctttcagcccttgctgtggaaggtggagctcctaccatctctgcctgtgttggggctagacgaagtttccctctgactgcctcaatcttttcactgtcatgtgtcctgggagcctcctacacagtggagaggagggagtatgagtctcaggaaccattgagttttttcactgtgaggtgggacaggcctaaatttctccccttaggcctgccattcactgagggtgtgcagtcatcatgctaagttctctttcttgctccattttcatcttcactcaccccttactttctgcaaagcgttgatggtgttgggttctgacagttaccagttggggcatttgtgatctgtggagaaggcagagatagttaatgagtaggcacatttgctaacctccttggacaggaataagttcaaaggggtggacaagcaggattggctggaggaggcaggtctccacattgttctctcttgcccctgggccctggcgtccagggtaatttttgtctgcctttgtggttcatatttttagctctctgtaagaggcccccttggtaaatatgtcagttcattgttaaacctagacatgagtttgacatctattttgtgaaacaaaccatgtaaaaatatgggtctttatggtgttcagtgttccaaagtcaggaattttttagtttcttttgtcttcacttcttgttattctctcacttgctttacttcttccagccttttccttttccacctcatctcctgcttcttatttcctcatctctttttccttaccattttttcctcttccatttctcccttgatcttttcattatattcaattcatttcattcattgaatggtgttagaagaggctttgtctttgcagtcagaaggctcaggtgaagcttcatatttcaaagcacactatgctgacactaagaaaacatcttgcccgggcacttcagttgaagaaaactatatgatgtgatcagtatgtgatgatggcttttcagatcagatagctgggttgtatttataatttatttctcttatcagtgaaaaagataaatgataatgtagtaacaggattttctagagtttgggttgtagagaaataagtgctcatgaataggaccgcatatgtgtgcatgtatgtgtgttttgggggtatggagaaagaggaggaaaagaatattttatagagaaaatttccatatggttaccttttataggatctagcacatttcaatgaaaacacactttgctggaagaattcaattctctgtaaagtttggtgcagcaaggggtgaaaatgtggggacacagctggaaacttatttgtgctgcaggcttgcagctgtacctacctgtgatgcgatgaatactatttgattgttaatgtctttctgttactgaaagcttgcttcctttcctaaagctgatggtaacaatttactgactgtctaaaccttgaggactaacttgggctgggaaaaataaatcctgtctcctgaaatttacatcttattaaaactcaaagcagccagcagagatgagaaggatctccagcctgggagctggaggtgggaattctgctcaagtcaagatcgcttttagctttcctacattctcctgtgaagaaccattggattgaatgatggtggcaaaactggtgtgacttcattcagtttatctctatcccatttcccctctccacatttgactgtcagtctactaatgagacccagttatggtccttggaaggggaaatggaaggtggacatagctgtgggggatgaaatggaggagtttttaatatcttagcttgcaaatttactgtctgccatagctgaagaccatctagtaccctctttaacttttgccactttggagtttcctctctaccgttacttattcagcaggtttttgtttttgttttttgagacggagtctctctctgtcaccaggctggagtgcagtggcgcgaactcggctcactgcaacctccgcctcccgggttcaagcgattcccctgcctcagcctcccaagtagctgggactacaggcacgtatcaccacgcccggctaatgttttgtattttagtaatgatggattttcaccatgttggccaggatggtctcgatctcctgacctcgtgatccacccacctcggcctcccaaagtgctgggattacaggcgtgagccaccgcgcccggcctcatcagttattttttaattggctgtgttttctttccctgtaaacacacttgttcagaaggaaatataatatcactataatgagcagaaggcaagtatcacatgccataagaaagtaactataaaaatgagtgtaatacaattaaaatattatgaggctctagttagatactgttccctatggaagattccgaacttgaggcctgcactcacttctgtctcaagtagaaagggagcttaaagaggcatacactttacatctaaggaagcactaagtgaggcattgttcttaactaattagacagattaaaaaggaaaggccaaaccatgccattgtcttagctcttgttttctttgattttgaagatggaaaaagagataacacttaaaaataaagcttgcctactcagacataattaaggtattgtcattcttttttgtctgtcctggttctcattgcaatattttgttcactgctcaatgagtatttattaaattaatgaagatttcaatgttaatgtctagtttcatttgcccttcctctaaaggctgtattctttttttgctcttgctctctgtgattttttggtagttctcttttatgtgcttactcacacatgagtgctttctctaacacactggtcctgtgttttgcttctttgtgtgcattcacgtagacatgcacacctcttcaaatgacacatgcctgtaggcaggataacaggttgagttgtcttgttaattaggcattctttttctggggctggtacaggatgtttgagaatactgtcccccagaatactcatctggtacactggaactgccatggactagttttccagggcttatacatacaagtggcttccaaaaaagcattttcagacaagctgcttgttatgtgaatgtgtttttctttttagtcaaccacaatatatgcagcacaaagctgttgccattttcttggaatgagaaaattatgagcataatgtttcttttacatctctgaaaaacgctaatatccagctgttgtggtggttgcagttgtcagttgctttttgtaacccgacaacactgtctcaaggatgaagagaggaaatttggtgactagtctttcctgctcactctcctgaaagtcctattaatttgcttttttaaaaacaacagccaagtatctcagttggagaaggcaaagtcttattggtccttatattctgtgcttggattagtatccacagtaaaccacacacattttgttccttgcttaacgtgagccaggtgttatactttaaagacataatctcacttagtcctcacaaaaactcagtgaatacatactatcattagcaccatttttacagatgccaaaacaaaaaattgaggttaaataattgcacaaaatctggcagccattaaatgactgagctggaatttaaaagcagatgtgtctaaattctgagcttacatttgtaaccactgtatataatgtagtataataacttccccaataattgacagagtactttactcagaggctttacaaggacaataaaagaattagttgagataacacaacccatgttgtgagaagattgtctttttgattcacagttcatgcaaagaaataatatacagcagactgtgaataatacacaaacgaaatgaaatttcattcttgaatgaattatctgtatctccttttaagaaaaattggtaaagcatttaactggtcatggctcagggaaatgtctctattctgtttctgtctgaattttattctttaaatattcactttttttttttttttagcatccagtggccacctagttgttgttgttgttgttgttgttttttccccctgtgcttatgcttgtgccttgcagggctgcatttctgcttgctgtgaattctcagttcacagctgcagttgttcaaactttaaatttaaaattcagtctatgtttctagtaattgctgctgggaaactgaaacaggactacttggtttcagagtgaggctgttgcttcatattggaagaaaggtttcattagcttggaaagcaaatctcgggatatcaagaaaacaacaaaggctgtaaattaatgcagaactcaccctaaaaagggtcaatgatgaaagaagggagaaagaagagacaggagtttcagtggtcaagggaatattttcttcatgataacagtgacctgaattggacagaaagcagaagggagtgtgtcattttaagaaggtcagtttgacagaccgcaatattccaggtttctattattatatataattgacattgttagctaagggatggattttcactatttccttctgtagtacctcagtcccttttaagtaattttttttttcctgacttcaccaccaggatcgtgtgatggtttaggaggagatttgggggatagagaggtgattctgaagataaacccactttggctgcctctgtggtctaaagccagtttggagagcgcactacagaaacagggaattcacaggggatgagtcagagagagggactggagcagtttgtcttgtttcacttgctcttatcacacagttcactcctttctgctcatacattgtgtagtccaccatggagagaaagggagaaggttgcacaatgccttgacagatttttttttttttttttgaaacggagtcttactctgtttcctgggctggagtgcagtagctcgatctcagcttactgcaacctccacctccccagctcaagcagttctcctgtctcagcctccctagtagctgggattacaggcatgtgccaccacgcctggctaatttttgtatttttagtagagacagggtttcaccatgttggccaggctggtctcgaactcctgacctcaagtgatccacctgccttggccttccaaggtgctgggattacaggcgtgagccactgtgcctggcctccttgacagactttttaatgattgtagggatagagaatggtatacaagtaaatatactactactgtttttgaactggcacagtgatgaagactaagccagtaatgctatgaaacttcaagtattaaatttctaaatatttggcattaggcaccaatctaagttacagtttaatgcttttcatcacttgtaacattaccaaatcagaggaatgaaataatatttatccaaataaaagatgtgttaacttcgccaaagtgaatgcacatttttctttgatttccccataatacatctttctttttcggggaagacagaggttgggaatgggagggagggagattattgtgaatctcagattatattgatcagaaccaagtttagcttgttctggtatgtaaattagagatttgtagttaagtgaaattgattttgctgagactaaattaatcacagtccttaatcactgtaacctttaaacattgcagtcttggccacagctgcagggcagagcagtgctcctccgagctttatgctgtcatttcatgaaaggctgaatgcccgtgacttgtgcaaacaagaattcccatgtacaggcttcagagctggttccctgccctgcaggggatcagctggagcatctcccacagggccaagaggctgctgtggcctcttcaacccaagaagatgttctgctcagacacaaatattttcagtcttcctccagacatcatcaaactagccatcactgcgaaatgctcacaggaaagtagttgttagaattaaaatcagaaacaaccagttatattgtgatagttttttctttaattgtatatgtttatgtatatttataaatatatttatatttatagatttcttttatatatttatattatatttatatatatatgttttactgatcacattttgaactatttggaagggtgatgttgacaattttgaaagatagtgaggcatggagaggttaattgactcttcagaactaatcctgagagcctagaaggagggtcaagaatagaaactgggtttggtttggttttgatggtcatttcagttctttggtttccgtttcatgaagcatcccagaatcaaaccatcattaagcctgccatagaaatgcaaattactttcccactttagttggcatatttgaaaatagttttgtgtgattttttttagccccttttgtagtctattcatgaagtttatacatgtaggactcttttttttttaacgcctttaactaccaatcctccatttttcctttaacttttctatattcgctgacttttatgttcagttgaaggaattcatacacattcagtataataaagtgcagctggatcaatcatttaaaaaaatcagtgaacatctgtatttcacaaaatcacactttatcaggactgaagggtataccaggatctaacgatcaacttcaaccactcagttttgtaaatgaagaaaccaagagtagttaggtgaaatagctttctcaaggtaatttactatagccattctgaggctgcaccctagctaatttgattcctgtttaacactcttctctatgacattgactgttttctctgtaaaagagatcccggttatacaactatttcacaatccgattccttataaaaaagcaagtagtgctcaataaatttgacttaagttgtactttataagctaatgtaaaaggagatttaccataatctgccgtggtgagttgcttatagtaggagaaagaatatcttaaaacttactttacaaaaaataacagatgctggtgaggttgctgagaaaaaggaatgcttatacaatgttggtaggaatgtaaattaattcaaccattgtgaaagacagtatgtcaatttttcaaagacctaaaaacagaaataacagtcaactcagcagttccattactgggtatatacccaaaggaatataaattgttctatcataaagatacatgtctgtgtatgttcattgcagtactactcacagtatcaaaggcatggaatcaacctaaatgcccatcaatggtagactggataaataaaatgtcatacatatataccatggaatactctgcagccacaaaaaagaatgaggtcatgtcctttgcaggaacatggataggagctgtaggctattatccttagccaattaatgcaggaacagaaaaccaaatactgcatgttcccacttttaagtggaaactaaatgatgagaacacatggttacatagaggggaacaatacacactggggccttttggagggtggaaggtgggaggatgaagaggttctggaaaaataactaatgggtactaggcttaatacctgggtgatgaaataatctatacaacaaacccccatgacacaagtttacctatgtaagagacctccacatagacccctgaacttaaaagctaaattaaaaaacaaaaacaaaaaaccaaaatacttactttaaaaacaatttctgtggttgtccttctcttttttattgtatattggtttgtgtaggtccatttaatttgtttacttttcgtagtaggaatacaattgtcagtgacatctagtagattgaacataggctctgaagctgaagcctcaggtccatctttggccctgacactagccctgttacctttgtcattttacttaacagctctctgccctaaaccataacacctaccccatagagttgttgagacagttaaataagttaatgaaaagtcaggctcttagaatagtgctgggcatatatgaatgttcattggatattatctaatattgtggtcattatcagttgatttcttcttaatttaaaaaattttcgtatgtgatttcatgtggttttagggaatgataaatgtaatttagactttttattccattgggtctgttacagcttttttctcaatgaaactgatttggttacctcagttctaatgctggctttgcctctgctttttgatcacatttagaatacagcactcagttctgggtatgtccaagatagataggggagaaaggtaaaagagaatattaatgcaacttgattgtgcagctgttctttccacaaatatttattgaatgactgctgtttgtcacatgttgatgcatagggacacggtgcacacctgagattccattcctgtagacaggacatttgcctgcttcctggcacttatacctctccccaaattgacaccaagcattattttagaaaggcatttagtagaatgcaatatcagcaaatgaaaattgtagagttgtatcttgaagaaacttgaccccaccccccactctcacctgcatccccacatagagccaggacatctcttaagacccaccttcctgggtttgctcatagttggcacttaaaacattctattgcagttacctatttttgatggactctgcaagagagagactgtcagttcacaagggcactgatgtttggttcttcattttatttacagtatgctatacaaagggataggtttttgttgttttgaatatatcttgagtactcctttggaaggatagagtccaaaggcatcttacctgagccagaattcataggggtggttccctaccgtttcttctttcctgtacacactcaccaccctcaaatttccgctcagtagaggatgctttaggaccttttttcttctttctttctttcttccttttctttttttcctttttctttttgaggtagggcctcactctgttgcccatgtagtggcacaatcatagctcactgcagccttgatctcccaggctcaagtgattctcccaccttagcctcccaagtagctaggattactggctaattttttcagttttatttttggcagagacaaggtcttgccattctgcctaggctagtcttgaactcctgagctcaagtgattctcccaccttgatctcccaaagtgttgggattataggcatgagccaccatgcccagcctagaaacttttcttttcttttcttttctttttttttgagatagagttttgagcccaggctggagtgcaatggcgtgatctcagctcaccgcaacctccgcctcctggattcaagcgattctcctgcctcagcctcccgagtagctgggattacaggcatgcgccaccacacctggctaattttgtatttttagtagagacggggtttctgtatgttggtcaggctggtctcgaactcctgacctcaggtgatccgcccgccttggcctcccaaagtgctgggattacaggcgtgagccaccatgcctggtcagaaccttttcttgactccacttaagctcttccatttgaactttcttttaattatctggattttaactttatcagaattagtctgccggtaatcctgtttttagctagaaggttaggctttgagaagtgtgaagctggatgggagggaaggaggccagcaaagggaaagggactagctgggttgaagaggccccatctgctattccagatggggcatcctgaattcatcactcctaaaactttgctctatgtgttttctaggctgcagcatccagacagcagcacacccttcacatgttcactgtagtaaaataacgtggaaagggtagaggtatctggcagataagagaggttatttcgtaaggctgtgatgcccagcacataggtctgtacatcacctccttcctgctgctcctcaatctgcctttctttggtcactgccccctgctagtatttaattctgttgaatttgttcaaattgacttgtttaagaaggttacccaaatctgcatacagccttcagcattgctttgaatctcctttaggaaaggaaatgtagattcaaatacacaggtttatctctctgacctttagctaattattagattgagataaatgtgtgtaagtgacaaattgcctttaatgacatttaatctgcatcctgacattaatgtctggtttagtgtcccagttccatagaggcaaagagcatggacttttgtcttaatttgacctatttaaaaggtgtttgtggtgagagtcaacctgtgattaacttaatagcatgttttacatgaaaagcaatcaaatattgatgtaagaagaggctactagatgacatattttccagtctgtcataattggcaaaaacatcagagaaaggagagagttgttagtaactaaaactgaatgaaagcctcatagctgccccaaatccaatactggtgagcacattgatagtatctgaagaaaggaggctcttcttgttgtttattgtcacagaggccattcactgaactttggtgggtgttagactaatagatttttttttttttttgagacagagtcttgctctgttgcccaagctggagtgctgtggtgcgatcttgcctcactgcaacctgtccctcttgggttcaagccattctcctgccttagcccccaagtagctgggattaacaggtgcacaccaccatgccaggctaatttttgtatttttagtagagaaagggttttaccatgttggccaggctggtctcaaactcctggtttcaagcagtctgcccccattggccttccagagtgcagggattacagacatgagccactgcacctggcctaaactaatagattttcacacctttttgattcactaaaggacatcataggggcttattaaataagtgagctatttttagggagtgagaggtctgggaagtggcattcttggtggatttgttgtgtgctagtcaggtgctaggtgctttgctttttgcattctcatttaactcctaactacaaaaacatttgtacaggcaaccctctaactcgtgataccatctttttgaattaaattaatttttttttttaaataaggtcttgctttctcgcccaggccggagtgcagtggcatgatcacagctcactgtaacctcaaacttctggggtcaggcagtcttcttgctttagtctctagaatagctggaactacaggcacacgccaccatacctggctaaattttttgtagagacggggtcttgctgtgttgcctaggcttgtctcaaactcctggcctcaagtgatctttctgcctcagcctcccaaagtgttggaattacatgtgtgagccactgtgcccagcctctaattggtgacttctcaattaactttgacataagtgtgtgttttataagatcattatcaccgataataaatgcagcttaatttctaatcaattggccaaacagggaaatttgagttgagtgagatcattaacaactttctttagcgctttaagagctaagtgatagcttttccagttctttaaacattacaaactgccgttcctggtgaatgtcattttctcaaattcattttcagagactggaatgggtctgtgctactctatataattttgtgctgagcggatggtatattgatgggaggaagtaggagagtagtgatggaagggcacaggcattggagtctgtctcccaggtgactctgtaagtttttcaactttcctatgccttgatttcctcatctgtaaagtgaggataatgagttaatgaatgtaaagcacttagaagggtgcctgtagtaaggacttacaactgttttatttattgtttttggagtttggttggaggattcaaagcaacattcattaaactaaacactcactaaattcactaaaatggtttccaagtgaaataataaatatagcaaaggagtctctcctctgctatggagtagctgagttgagtgcatctgggtgtccattctgctgcaaatccaggccaagcaaatacagtttctgtgcaattaaatggttgttgactggcaaagaaaaaaaatgtaaaccatagtttttccttctaccctgtaatctgtggtgtctttatgcattaccttaagagcaacttcagtgacttgattagagggaggtttataaactgcttggaggcaaagcaccgaactcttgactggcacacagcaggtccacaaggaaagccacttcccagggtaagaaagcacacacaaattattcagggacaaatgtaatggttacaagggtgtcatagaaacagatcagaatacttttatactactgcctggcttcttgttcccccattccccattataattctggattcttaagtttattttaatgacaaacatttttgcctgtctttaagtaaaagaacagaaaagaagttacttaaaatgcagtcctaattatgtcctaatgcaattttgatgcagcaatatgctttcaaacaagcaggtactgggtggcagattgacacaagtatttagtgaattgagaacaacatgtgttacatgaaattataatcaaattacaaacaatggaatggattgttgcttttaaaatcctctgaatgttggttaacttcatagggcagtgctgtgactatttccattaattacggagtagttatactgggacttgaccaagctcttttaatagttccatctgatttatgtttttctcttctctatttttcttttctgtctctttatttctttttgtcactatttttgttgacctgtatgtgtgtttttttctctttctgtatcagttcaagttctccagagaaataaaaccaataggaggagtgtgtgtgtataaatctaaagagatttattttaaggaattggcttacttgattgtggggggctggcgagtctgaaatctgtagggcaagcagtaggttggaaatttggcaagagttattgcagtcttgaggcaaaatctcttctttgtgataccttatttttgctctgaaggccttcagttgaatggataagacccacccacattatagaggataacctcctttacttgaagttaactgattgtagaagttaaccacatctagaaaatacctttatggaaacatctaaattcatgtttgattaattaactggctgcctgctattgccttgccaagttgatgcataaaattaatcataacattgtctcattcctttttccctcactgtgtgtttctgtctctcatctcacatgcacacaaatgaggttatgggacagcattagtgttaatgaatttcaggtaacaggataatgatcattatagcatctaccagtaattggatacctattatgtgctgagtcttgtatttgatgctttgtatttctgatctcatgtaatcctcttgacaattccatggattggacagaattaattttattttatgggtgaggaaactgaggcttaaagagctgctagcttttatttagccatgtagagctcaaggttcaaactctaatctgcctttcctgcagatatactctcttctgtatctgcttgtttctctaatattcccccatcactgtcatcactggctatttttcagtgtttcacttggatgaaaaacatatctacatactttttttgtttccttttttttttttttttttaaagacaaggtctcgctctgtcaccaaggctggaacgcagtggctggatcttggctcactgcaacctctgcctcccaggttcaagtgattctcctgcctcagcctctcaagtagctgggattacaggcatgcactaccatgcctggctaagtttgttttgtatttttagtagggacagagtttcactttgttggacaggctggtcttgaactcctgatctctggtgatcagcccgccttggcctcccaaagtgctgggattacaggcgtgagctgccatgcctggcctgcatacttttttttactaagcttttttttttttttttttaataggatgctgaaggagctgaggcagtgctgaaggatgttaaaagcacacacagtggagagcttattgttgttccaaggcctaattggagatctaggttggcatttcctacagctttcaaagtgtacaactaaaagactatcctaagaagatgagatagtttctgaactaggcacgaaaagctgtaaggagtgtcacctcccagtgccctctggcctatttttctcactgatggattgctttgttatctgctgccagaccccttaatgtgctggctcagccttcacagggattagtcacagaagatgggcgctgcagctgcaggtctggctccagaggctttgggtggtacctactactacttacttagcccttagccagatattccctagaagggaaaacgctccttagtttcactgaggatctggcctcatgagcagacactagttctaataatactctttaccttctttgtagctcccagccattgtcttctaccttcccttgcctagctttagtcactgccagcagctatttctaggctgttggcactttgaagtggaattgggcagacagaggtgagagcaggctgtgagttccctctctggaggttggctccttacagcacacatgggaggcagtgctgaaggatgttaaaaagcacacacagaggaagagcttacttgttgttccaaggcctaattggagatctaggttggcatttcctatagcttggcatggaacgatttgaatgtttgtggatggtgcttgcctcataccttgccaactcaaattttgggcagatcagcttctgtgagttttgtctcgacaagttgggaaagtttcctaactttagatgactgtgtgaatctttgaggagcttgatagttagcaggtgagggctgctattttgaaggaaatagacattaatatattcttctttaatatatctgaatgggtatacatatgtgctcctttgtttcttgtaaatgggcagtacaggagggagaaactgaaggagaggacttggtcaggagataaacccccacagatgccaagatgttggcttgttgaagcttattcgtggttagttttactgtgatactatgtgcagatggttcctaagttataatggtttgacttatgattttttagttttatgatagttttggtgcaaaatcatttttttttttacgtttagtacagtatccaataaagtgtgacatattcagtactttattataaaataggctttatgttagattattttgcccatctgtaggctaatgtaagtgttctgagcccatttaaggtatgctcggctaaggtcaggtgtatcagatgcttttttgacttttgatattttcaactaacaatgggcttattgggatataaccccatgataagtctaggagcatctgtatttgtctgtgaattacttagggactcttttgatgtcttcgttttggaaactctctgttgttggtttttgttattttagccttgtcgggttttcctcatactggtctaactgctagtatcttttattggcccctctttcttggatatcctttacatgtttatatttgttagtgtttcttccttgacttgtctcacttctcgtgtttccttgggtttgcctccattactaagtcttcatccagcccctatgtcattggttctcaaagtgtggtccccagaccagcagcagcagcatcacctgggaacttgctggaaatgcctgaactaaacttaagacactatataaaacaggaaaaggcattttacattttgatacacattgtcaaaaacattgtactggtttcatggtatgcattataaggcataaagtagatcaagcctatgttcctaatgcatacatttctattgacctcagagagtgaactatcatataatagaaataggattatcattagtttaatgaatgagaaagactcttcatgtttgttctttacctaatctatgcagtttaaacctagatcgacctcagggaaatatgggaaattgtgttctcttctggcttgtttaagtacaaggaactcagacccactctaatttgctttaagtgtttttttttgtttgttttgaacagtaagaaactatttagggtggagaactttatttcagtaaggcctcatgtgaagtggaattaagacagtcataatgtccttttgtggcttgatcttgatgaggtgataggcttctgcacacattcatcaactgttcatattctttcccgctctgtccgccccccccaccctcatcttgcttgcacacacgtgcatacttttgcatgctctctgactctctctcttcttccctctccttcctgccaacacagctgtattcatcttcatttctttttcacctggcttcctccctctctgctctgtgtcttttcaggtccctcccaagtttagttcacgcattactcattctatgaacctcttaaacttcgtgcattctatcttttatccctattactatgtcaccctggcagtttcataatgcagatttctgagtaggagtcccagtgggacagaacctggccacttgatggcaggtccagtgtcctggtcgattcccttagaaagtgctgtgcagaggactgttactttttcttatagatcattctatgttttaagtattaaatgaagcctcagctccagcatagcgtttctgacaggctgactcacttcacatttaatgattgtatccagcatcttgtctctactctccagcaatgcagctccttcttctggtgtcgtcacttctatggacatatcctgtggatgttcccatccacctgagcccaaaacctctgtgcttgtttgttcctcctcctccttagccctcacatctcttcaatatttttctctctctttactattacttaatgctactgccatattgcttcttgactagattttaataatcttctgatttcaatctgttactttgtctcagtcagaataacctacttcccctttcacatgaaatacttatctaccctgaggaatatccctcaaggctctctattgcctgcgaattgagaatagactcctctgctgaagattcacggtcttcagcagtatgccccctacttggttcttttactccaaacactgtactctagctacataggactactgagtaatactcctcaaaggctccctctcttgggtacttgtaaagtgccctttagctgtgtagcagagaataggacaggagtgcacactctggggctagactgacgggctggaatctcagcccagcttgaaaactttgagcatttgttattttatctttctgtgcctcatttttctcaactgtaaaatggaaacagtgatagtatctgccttgtgggttgttttaagagttaaatatggagcactcagagcagtgccagacacacagcaaatcctcaggtctttccagggatacttttttttttttttttttttaatattctccattagacgtgatgtttctgtctctgcgatgtggtaattttttctgttttttatttttaagggtacctatcacagtctgcttcccccttttcagattatttgtggatttcagatgttcacctgtttttctttgagctccttgagtatggagatggtattttattgaaacttatattatgacatacggagctcaataaacatttgttgaattggattatatccaaaagatgcttctgctaaaatactgtagtaacttccatctgtcccatgaatgttcgtgttctgagacaataatgtaattcttaaaactaggttttaaaccttaaaagtgaaagaaagtgaatactttgcggttgtcatatagatgtactgctactcaagtatagtaagtatattggtgaaatatttagaaaaaaacaactagttgtgaatctgaatcagagatcagcaaactttttgctacagagggaaaaatattaaatatgttcaactttgctggtcatattatctgtgttggatctgtttaccacagcaatcgtaatatgaaaaatatgtaaatggttgagttccagtaaaactttatttacaaaaacaggtggactataatttaccaacctctggcctgtgtcattactgtgcaaaccacacatcattttagaagctgtttgttgcaaaagctccaggtgctgccacatccaaagatacacacctgcatgtcttctcattaggtataaggaaacctttccagaaaatctcagcagattactcacaagttcagtggcccaaagttgtatcacattctcacacttcaaaccagttactgatgatggaatgagactaccatgattggcccaaatacaccaggaatcacaggtgttgttgtggataaggcctccctatctgcatcacgtgaccatgttgatgagggcatttccttgtgaagtgaaaaccattgaattgtacaatgaatgtgatacagcatgggctgccacagtccagttgtcacctactcttctgttgttcttctgaacatcatcataatgtcacatttgacaggtgtgaggtttctttgttaaagctcagacttattttaaattaatattcttatcacatgaatagacccgtggtaatgatgtaatgaccttggaggggcaggccagttttccgctgtgaagcataaagtttcccatatgacatccttgggctactcattttggtattctcagatatgcaaaacagagaaaacaacaggcttcccacttcagaattcaccatatacccttctccttcttgaaagggagaaaccaattagacaaggactagccttctcttatacttaataaaggcaggtgagttgagcctcttagtatttgtcatacactatggattaaaccagtttatggcccatgtcattgtacccaaaactctggtgtataatagtaaaacgttcatagttttcaaattagacttagagcttcttggtctcactttagaatattttgacagccctttggctttcacagaaagacctagtccctcaggggtcttgaactgagctaattatcctagtcatatcctgtagaacgggatcccactatggcttgtctgagactgcattgttgtcttgggttgtatgggaccatgagacaaacggctgtactgtttttccacttggcttttctgtggtgtaaaactatcttttaggagccacaaaatgctattcttttacttgttgaaagattttaagaaagaaagaaagggagggagggaggactgtaagggaaaagagaccattaacatgacatgtttcctgtcgctctccaatctgagtctaaccccagatgactgtattcccattgttttattgtgagggcatttgtgagggccttccccttggttgtgtcttggtttacagtctatagaattggattagacaatgttaattcaattaatgactgtactgaaagtttgtcttagtgtgcagtgaaaacaggagagcagcctctaataatctatggatttaatgactgcaactttgaagagtgttaagctaaagtgaagttcagaatggcttgttaactgggtttattagctgttgaccttccctttcagcataatagtggcagtcagaccgaagagagcactaacgtcctgattagcatttatctaaagataggctgctgcctgttacacagtaaattagttcaatcagccataaagagcttgagaaacattttctgctttataaaaagaattagatgttagaacagttcatctggcatagctcagtgaagatggattgagcccctgaacgtgctcatttgaggaaggcgctttgaggatattgagtaattgaacagattttcctacaagattgatcaggggccctagatttcctgcacaattgagtgatgctctaatttttgccttctaataagagcagtacatctgctcctgtttctgtgtattcatcgagtgaaactgaaaatcaatttatttagcacctactatgcactctatgtcccttacgaaataaaagcaataggatctactgatcacagtctatttgattgaagagatgaaaactacactaaaacttgaaattcaccacttccactaccactgcttcttttcttctgaaaagaagaaactgtagaatgaaagctgctacttttggtatatttcttgagatcatcttatgaagtgaagcacattttcccacagaaacagtatagtagtcggggttaacgtttctgactaaagtcttggcaccaactaagttcttctcatagtgggtcataaaagcaaaaaggcaaaaattataaacctttctaaatcatttaaaaacttaaattatgatccaggtccttaaaaaaaggacataaatgtactgtacaattgaattttatgaggtgccccaatgtactataaagtatacatagagcatataaaattctaactccgctgtatcataaatttgacctcactgaaatgaataggctcactgtatggcaagcattaatgaaacgtttaattaacattcccttcacttgcatttttagaattttaaagggcttcctggggactatttcaatggctgaggtttttgcaaaacaaaagaacaaaaccttctcataaaaactgatctcttttgctcaataactcctccaatagagacatttaatttaattagactgatgaacctgaatttgaattttatacccaaacctatgatcatccttaaaaaaaataaaacaaaaaatatggtattgagacagttaagcacttgatgacttcatgaaggcttcctgtggaccctttaagccactgtgtatacacatatcatttatgtccttgcagttttcccaagctaaaagccacagggatatgagtactttgtgagggacagtggtgcagtgttagaatggatgagctgtagggctgtgggcttcagaccctttcatagctccctgtaaggtatcctcctcctctaaccttccctgtaattatgctatgttggtttactttattgcctggtcactccaggagaagtccccagggagtcatacttgaatgaacagatagaggcagagtaaaaaaaaaaaaagacattatgctaagtgaaagaaaagtcattcacaaatgactgcatatggtgtgactatatttgtattaaatatccagaataggcaaatctgtagagatggaaagttggaaagtagattagtagttgtctaggggtgaaacatgagagggatagggagtaactgctgataggtacagagtttctttctggggtggtaaaaatataaaattagattgtggtaatagttgcacaactatctgaatataataaaaaccattgagttgtgtattttaaatggttgagttgtatgtatgcaaattacatcttaataaagctattatttttttaaaaaggtattaagtttcctcaagttaaatgaaatgaccaaaaggggaaaggttttaagcagtgagcactccttgtaatgtatgtgtatagtgagtatgcatatgtttgtaaaagtataatgtgtgtgatccaactatgagccatatggtgctagtcatgatgtgtatacatgaattctagaaaaagaggaagaacctttaagtgagagaatgccatgcattgggaagcagtgtggggcaagatctgtgtggctctagggtggcaaatttagtttgagcttgtgaatccttgcagagattggcaaatatcagatactccttggcagagaaagcagtagagtcaaaattgagaagatttaaggaagcagagactaataaggagagaatgttgaaacctgttatttgtagttagaagtgtagatgtatacaaaatagaaaaaaacaaaaagaatcttctgcattatatcaggaggaacttattggtgttttaggaccattaagatggagaacacagctcactcatatgtgggagctacaaagttgagctcatagaagtagaatataactgtggttattcaaagttgggagacgtggaggggcggggaggatagggagaattggtaagggatacaaaattgcagctagataggaggaataagttctgttggtctgtagcatattagggtgaacaccgttaatcttttattgtatattttttaaaagctagaagagaggattttgaatattcccagcataaggaaatgataaatgttagaggtgatgggtatgctaattatcctgatttgatcattatacattatgtacatgtatcagaatatcatgccatagcccataaatatggttgctacatgtcaactaaaaagaaaatttttaaaagatggaagacaaaagtaaaagataaatgtagatattcttttaactgtttggtgcttacctggtgtcctctgaaaaatcagagtcgtgggagatgaataacatttccagagagcactagatgaggagttagaaaagctggtttatcattcctactctgtctcttcccatgttacattaaataagtaactctgtgatgctttcttcctcccttgagttgtccttcttaccctgagaggatggcacaaggatcaaatgagctgacatatacctattgcattgcacctactagaatgtaacaaatgtttgtcagactgagggaggaaggaaggaaggaaggaaggagtagagtgatatcacatgcaaggaattggatttactgacttattcctctggccaagtgtgtcaacattatgattgcaataagaacttttgcattaatactatttatacttatgggtattattgctgcatttggtaattctacggtaaatttggaggtgcttctagtatcactgtcttgttctaccaatagtcttgtatttattgacagtttggtggttgttacaaatgacaggattgcaaatagaaatcaagctccaaagatggatggattagcttccttgttatgaccgtgttaaggttaccactcagaacaaacattggtagttgagcacgtcttgagtgtgagtgtcatactcagaacaattctaattttttaaaaattacttttttagaggctgtctcactctatcatcaggctggagtgcagtggcataattacagctcagtacagcctggaatttttgggcccaagcgatcctctcaccttagctttccatgtagctgggactatagtcacgtgccattacgcctggctcaattctacttttgatgaagtttttgacatattgacattgggtttgacatgtcattccaatataatatgatactgtagcattcaacaattctcttcccagaggagactatagaaaacagaacatttgcatttcccattttgtactttatgccacccactaaagaattccaaagtcatgcagaatgcctttgatgatgtgagctgcatgtgaatttcttattgcttgacttttaaatcccctttgttatctaggtccattacttataagctgtgtcacattaggcaagtgacatgcctctctaagtttccacttcctaatctggaaaggggggaaataatgagattggccctgtggcatcaggattaggcaaagtacttggcataacaccagtctcacagaatgcagtttttcttgagctgttgggtcagtgatgcctgaaagaggaggagtggaggttctgaggcattgctgtttttatcacgtttgatttgttttctttttgtctagacttgccatattatagcttcatcaggattttaaagacgattgtgaattatattttcaaaagttgtatggactcttgtactttagtataagcagcacaaaattaggcttaagaaacttagattttaatgttagctatgagaccttaggtcactggtgcgtgttcctctcatgaaataagagaatggaaccagctggttctttattcttcccggttccaagatgatgtggtcatagagtcttcattgcataatttcttgttcctcctcatttcttcttaccacactcttgtctttaatctctgacacctttctacccatctccttcaatgctccttctattcatcctttcatacgtcctaaaaattgttatgtcaactatgaggcaagcagtatattaggagctagatatgtaatgttgaaaaatatagacatggttcctgcagtaacagaatttacagtttaatggaagaagtacagataacacaagtaatacttacaaaatgtggtaagtgctatgaaagagcaggacagactgctttgaatgggggaaggggggatccctggcagtttaaatgacttttctcaaagcaggctgccaaaaggtagcggcgccggccagaggtggtttgagaggcaaagcagcaccacagacaggggtccaaggcaagaaaacgctgagctgctctcaggtgctggaaagccagtgtggcttgaagcgtgctaagagtgagactggaaatgcatgccaagtttgaggccgagttcaggattttgtattccatgataagtgtaatgggaaatctatgagaacttttaagtaacaacaatatgggaatcatacttgacttggctagaacaattaaaagctgatctcttttagaaagtacagttttgttttacattaatcttaacacagaatagtgtattacacctaaagtgaatactcttttaggctgggtaggggctgtcccgtggtttaatattgtttctatcataggagaagccttggtttcctagtttcccaccttgtttctcctctctctgccccactgggattctagctgcttcttcactgcatttgctcacctcttcttctccacagtcctttggtccttgaaatgctgtaagagcagaaataacagctatccagagaccttcagatagcagatgtgccttgggcctgtgggtctgtggctctggagggctaggaattacagaagagttaaaagagaaggcctctgccagcaggaattccgaagacaccaaaactgatgtcactggctgtgcaggcactgagctaattcttttgccaatcagttaaatcacctaccaagagtgttcattgtaagtaacactttcttgccatttggtggggatgtagagggacaaaggatgcaaaaggcaacaggttctttccttgtaaaactgtaatctaattctgtaaacaagccatgtacctttggaaggtcattttgaactcagtcctggtaaatatttgacaggtgttttaaaaaaataattatatttatacaatctataatggaatattatgcagcttttcacaaggaggaactcctgccatctgccacaacgtgggtgagcctggaggacattatgctaagtaaaataagtcagacatgaaaaaaaaattgcatgatttcacatatgtagaatctaaaaaataggataaaaatacagagagagaataaaacagtggttactaggattgggtttggaggaaggaaatgtggagatttgagtcaatggatacaaagtagcagatatataggatgaagaagtctgaatatctgtacaacatgaggactatagtgaatcacaatgtactgtattcaggatttttgctgagtgagtaggttatagctgctcttgccacaggcaggaaaagtaagtaactgtgagatcatggatatgttcacttgttttcctatagtaaccttttactatatatatgtacctgataacaacatcatgttgtacaccttaaatatccacaataaaatgtattaataattttatttaaaaatattttaaaatgtggacaattaaaaattttttatataattttttggtagttataatgctctgttcttttacaaattgtgagctggatactcactactcttcttttagcccaaattgagaacatctggaggcatttttatgtgatgactaaaaatacggtaattgagttagactgtatgggtctgtaccctgctctgccacttcctggacatgtctcagttttctcatctgtgtaatgatgatagtagcgtccacttcttgttgttattataggattaaataatatattacatgtaaaatgttgagtataaaacctggcagatattaagcacctaataaatgttaggtattaaaaatatataaagtatgacttctgctttcgagaacttaacctataaatatcctttgataccccgccccccgccctttccaccttgatttcatttacacaagagccaagtgaaagagtagtgagagatgaaactaggaaagcaggaatgaggcagtgggtagagaaggatatgtcctgaccaatggcattgacagagtggttttgacaggtgagtgtggaaatggactgcggtgagggagagtggaggtagtgttgagaacccgtaggctctggcagcaatgtggagcttacttgcagcatagcctcccttcaacttggaaaccaagcatttcaaagtacctgggaactttcttcatcacatccttccagcatttacattgtttacaaatgaaggagggaatagagtatattttattttctgataactttctgggtttccaaagagagaactgtaaaactttgataaacacatccataagagttgctgcccacacggtttcaaaactggatctcttgagctgggcataactggtcataggcagagaaacgttgactggtgatttataccttataccctctcattaaacactcttacctaactacgcaaattaggcttttaaaaatagattatttttattgtttaaatgtagaagaatatatctcagagttataggaaatttgcatgggtacatgtttataataaaaatcctgccaccatttatcataaatggccttggtttaggagtttacacagtagagagctcaaaccactggctttgctatgaaatagacccaattcaagctccatctcttaaaaagccatgtgagtttgggaaagtggcatcactttcctgagccctgggtttctaattattattattattatttttgaaacggagtctcaccctgtcgcgctggagtgcgatctcagctcacggtaacctctgcctcccgggttcaaacaattctcctgtctcagcctcccaggtaactgggactacaggtgcccaccatcatgcccggctagtttttgtatttttagtagagacggagtttcactgtgttggtcaggctggtctcgagcttgtggcctcaggtgatccacctgccttggcctcccaaaatgctgggattacaggtgtgagtcaccacacctggccaggtttcttatttttcaagaggagttataagacccacaaaccttacaattattgtaaaaattggtaataatatatatgaaaagtccccagcacagtgactcctgcctggtaagcaacccacgaattttacctattgtcagcattgtttagatcacctttatttaacttagttataatggggcttaattacaaaggggatccatattctaaaagcaaatactgaaacaaatttttacaattcactaccggttcttcagattaaggtcttctgatcatggttcagtttgggtttttgttgttgttgttgttgttttttctccccaagatgcagtcttgctctgttgcccaggctcaagtgcagtggcgcgatcttggctcactgcaacctctgccccctgggttccagcagttctcctgcctcagcctccctagtagctgggattacaggcgcctgactaatttttgtatttttagtagagatggggttttgccatgttggccaggctggtctccaactcctgacctcaggtgatccctgccttggccttccaaattgctgggattacaggtgtgaatcattgcacccggcctgagctactgcgcttgggccatggttcttaatagtaaaattatttaacgagatttttcccagttcttactggtaaaaatgtcctgtggtttaaaaacgttcaaattaatttgttgtatatttcacatgacagtgatacgagggataattgattatttgaggtattgatttgacctaattcagcataataatttactgattttcattcagtgcatgctaagtactaaatccagtcttgctgggtacagagaaacatacattcattcaaacatcatctcttctctcaaggagctcacagtagaacctatttaaatttaggcagtggggagcatgaggctgcagagaaacaaacatccaactttatgaaaagacaaaattatggagacagaaaaaatgatcagtggttgctaggagttggggagagggaggaatggataggcagagtggagaggatttttagggcagtgactctgtattacagtgggtacatataattttacgtacgaccaaacccatagaatgtacagcaccaagagtaaaccctaatgtaaactatgaaagttgtgataatgatgtgtcagtctagactcatccattgtaactatgtaccagtcctgtggggaatgctgatagggagattgtccatgtgtagggacaggaagtacatgggaactctgtactttctgcccagtttttctatgaacctaaaactgctctgaaaaaagtattaattttaaaaagtggtcttactgctttggagcacaagtaaatcatactaagaagacgatgtttaaattaatatactacagatacagtttgctttactgaaatgcagtatatgatgttcaaaacatatatctttaagtaatagccattttacaaaggaattgcatgtttttacagggaggtttcactggcctattagggcatgttggcttggtggtacagctaagatctaattccttctgccaccaaggagctttgtgaccgtgggaccacccaggaacctctctggctgtattctctgcagaaagacttaggacaacaacatggcatgctgtgtggacatgatttgctttgttgggcaaactggtgggattggtggggtggatactctctaatggaggttaaaggtcctgaagccactgcaggttaccctggggcgccatttctgtgctctggattaattctttgctcagctgttaaatgtctgtgtctggaagtggagatacacaagatgggttggtccccatggctttttatacctcaacaattatttcatccagtagatatctatactaacttgattgtaaacattaagtttacatgggatttctttaacacatccattttctaagaaagtgatccatgtgtaagtatagagtgaccaatgagaaaatagggtaattcccacacacccttccaaactttacaaggagtgaaataatataaattagcttcctctagtgataaaactgcaagaattttcaggcaaaagaaaaacagtttagtagcaccatctacaggctactgaagaggaaaacttcctatgtggcttttaaatgcaaggagtttgtggaaaagggaatacaaaaacttcatactctcttaaaaaaatattatccataaaatatactaattttagtatttttgttcttctttaccatgcattcaattcattttacaatatgtctctagttatcctgaactagtggaatatagacttgattatgtgttttcattaggatccctgtttcatccccatgcttacaaatttctctccctctctgtactaatgataagaatgaactgtgaaattcacatgaattccagtagtttcattgatagtaattcacagtataagacttgaagcacaaagcctgccagcaagggatgtttcatcttagcttatctgtatactcaaaggatttattgcatcatttacttccattatgggaggaaaaataaaagcagacactcttgggtatgtatgtatatgtgtttgccttttttaaaacaatgaagttgatttattaccttctgggtttaaaatcttatctgagccttttctgcccctaagattctgtgattctataatcagaaatagcttggggaatggataattattttgtaaaggaatctagaaaacttgtctttgaatatgataacagtgaaggtaatattttcattcccagataccccagttttattatctttttttgctagttttattttgttttcttataaactattatcaattttggtaacctggaaaattttattggattctccaaataactggattataaagtatttatggaattatcagagttgtaattttctgttagaaatggcttattaaaattaacttaatggcctccttgtaagttgttggtggagttgctgtttcattcattcattcatttcattgtgtgtgttattggaaagtgggtaagagttactggaatgcctagataataagttttcagtaaagcattacacattgcaagaagccaatctgcacccccacccaccccccaaaaaaaaattgagcataaattataattattagaacaatcttacttgaacagcattatttcttggaggaaaagaggaatagaggagatacatattgaaatagtttgctaaactaaagaggaattcaaaggataaaaaaattgataatgagattttcaaggttcctgttgaaacagatgaggcagagcctatcaaaactggagccaggagtgataatggtttttaagtttgtgtagcttaattgctgatggtttaggttgatggaaaacttagtaatactgtttccaattttttcctcattattttaaatgtgtaaaaaaattgtgcattaaatactggaacctttctctgaaaaaaagtaaagcaagttctagtatgaatagaggtttaaagtaaggcactgcctcgtcgtcctatagctaatatttttccctgtttttcttgcaccagatggcactgtttagttctatttcacaatcttattctggaactttcttcgggagaatctgttttagcccagggtcaccagtgacacctctctattctgcatgaagtctttatgaatgcttgtaaaaggtcactgactcagacatgaagctgtttatttgaggtcttgtggttctttccagttgcacatttgctgtgaggtgagcctaataaaccagctgatagaaacctacatgcttcttatagagttcagccagtattttgcttggagacatattgcaacaatatgatttcagcattctcacggcccagtctaattatctgacacattttggaattattttatatgtaaaagtagagctataagcagaagggcacactcactaaaaaaaaaaaaaaaaccttgcagagcttaaaatgtttcatgacagtctgttgaactatagatttatcaaattaacttgcaaaaataaaatttaaagaacctttcctgactattcccaaggctgacttggaaggaaattatcaatgacctctgatgtcattatgcataaatggggcaggtccatagccaagctcgcctctttgctgcacataacaataaaacatccttttggaagatagaattagctttatttaataaaaatgccagggtcatattgtaagacttatctctgtgagctttgccctcccctcccctcctctcccttgaataatacagaaacgttggacataattatgacacagatttcataaggctgcttctccttttacaattatattttatgaagaacagacaatgttttctttgcaaattttgaagctccttcattttctgaatgcattggatttggtactaaatgctctctcccgtttgcatttccttctctccctccctccttgcctccttccctcccttccttccttccttccttccttccttccttccttccttccttccttccttccttccttttttttttttttttatttttggtcagtgtttcactcttgttgcccaggctggagtgcaatggcgcaatcttggcttaccacaacctccacctcctgagttcaagcaattctcctgcctcagcctcccgagtagctgggattacagacatgcgccaccacgtgcgtctaattttgtattttcagtagagacagggtttctctatgttggtcaggctgctctcggactcccgatctcaggtgatccgcccatctcagcctcccaaagtgctgggattacaggcgtgagccactgggcccggcctcccctttgcatttcactgctctatgtattctcttggtggtgatatgagttgaagggtgggagtaggggtggagagccctctctagactggagctatgagtgcataagtgaaatctcattatttccatctttaaaagaaggagtattggcgtgtggtgtttttagccagccctccctcctttcctctcatgcccatccacaggccattgactggaaggcacaacagctcccagcacagcccctcctcctgccgctggagaggtgttgggactggtgtgctggtttccaggtgcaggtcctccaggctgagccacagctctctgtagaagtaagcatgagacaggctgcttccataaatcaagccctgaattttattacagtgtttatgtaacctcagtttatgtgctataattctttgctgtgttgcctagagtaattcccaaagaggatgtttgttctttttccctggaaattttctagcataggccttttgttttgacattctccttccccccaccctctgccttttttgggatggcctggggatgggtatcactaacagtcaattgctttttactgagtaaataatataatccagcgtgtgttagattctgtttgtactagatgttattcctactcttaagtgggagaaaaaatctcaaattaatttttacattttcaagattatagggtggtagggttaatgtgtacttaattgatgagtaaatgaaatataagtgaaaacaaatgcctttgctatccatgggagacccgttccttttcatagcctccgccaccatcacagatctcatgttgatagagtcagattgaccgctgagagagaaaatacagactggaaattttgggtgatttagacttttaactgaagaaaatgtcagggtaagatgaccagattcaactgtattccatgtagacaactatgtcaagagagaaatgttttctggttggaaatgaagacaatttgacttaaccggagcatgtttttaaagaaacccatagcatgttttttttttttttaacttagctctttttttcgaaccttatgtttggccctacagagaaattaggtgatgagactggacctactgaaagtgttaccggacctattctgcttggacacgctagacttgtgaactgctgactggtatatttcagttagtacagttaatgttttatcatcactgccattagaaggtattacatagatgtgatctttttcattgtagtttaaagaagatagttaatcctggggcaaagtttatgaaggaagtgtgtgaacagagcaatctttttagatttactttaactacaaaactggatatttgttttaaagctgtgctgtttaggattgtagacactagccacatgcaactgttgcgcatttgaaatatgaccagttctaattgaggtgtgctgtaagtctagaatacacacttgattttggagcttgagtatgaaagcaagaatttataggtcctctttaatcatttaaattaattacacattgtaataattatattttagatacattgggttacataaactgtatcatcaaaattaattttatacctatttttaccttgcttttactttttaaaatgtgactcctagaaaaaccttaaaattgcaaatgtgactcacatttgcaactcacattattttattatattatattttattttattttatttattttcaagatggagtcttgctctgtcacccaggctagagtgcagtggtgcaatctcggctcactgcaacctctgcctcccaggttcaaacagttctcctgccccagcctcccgagtagctgggattacaggcgcatgccaccatgctcagctaattttctaccttttttttttttttttttttttaagtagagatagggtttcaccatgtttgccaggctggtatcaaactcctgacctcatgatccgcctgcctcggcctcccaaagagctggattacaggcatgagccactgcgcctggccttgcaactcacattattattggccagtgctgttttaaagttctgttgtccaatgaagggaataacagatgagtacactcagtaaaaccttcaaagttatacgtttaaaggaatattctatgcttcctgataaaatattaataaccaaaattagcaacaatatatagatgaaattattgcctcaagatttatgaggaaatattgactggaatactgtctattaaaatattcctctttacttgtcaagtctacctctcagtatcttaaaggaaagttctcatctaatagggtgtagaggttaagagcatgaactctaggttggaatcccagcttggttgtttactgtctgtataataggaagtaagttatttagcttccctgtgcatcagcttccctacatgtaaaatggatacaccttaatatcttcttcatattaaataaaacaaagtgtataaagcacatgctaggattcgcacatactacataagtactatgtaagtgctagctattatagtgatagatgttattgttcttatcttgttaaaatacgtacaactttttgatagattattcgaacctggactctattctcaagcaaatggaagctgttggctttcagtaattagtctgaattttgttgaaactcagaaacaactggcagtaattaaaaatgggaaagtaaatgagcaaagaagggagctcatttattggaacatatgatgagaacattccataaagtaaaacttgtagtaattgtcgattaaaccaattttctacctgatataaattcagtagtactatatttctttttatcatgtttctttgtcaccaggtatattggtctgcaattttgagtctttggaagttatttttgtgtttattatgctctgataaagagatgatgacctcttaatcttgtgtccaagagtggtggtgctatattgtcctagaattgtttgaattttagagcaatgtgtatgtgtgcatttaaacccaagtttaataagtcattccattgtgttcttaatagggctagataacctgagaaccagttggttttttattgtgccgaataaaatttgtaatctggtttagactctgtacagcactgtaggtataacaagtcttttatgcagttcgggggtgatctgtgatataagtttgttatggtggaattgatgtttgtgatgggatgtctagatgaaattaccccatggaatataatcttttttgagtagaggatggtatttaagaaatatgtcttcaaaactcttatacaggccagtactgcctctttagatgtaaaagtttataattttaattgcaggaccttcttttacttggcttttaaaagttattcacttagtcaaaatttattgaacacctatagtattccaggcagaatgctaaccctcacggagctcacaggggatacacactaagggatatatattgtagtacagcacagtgctgtattaaatagcaattgcagagacactttccctattttttatgtttttactgccactttgcctttataacatgaggtgattttagcatagagctgaaccaaatgttgggatattaaaaagctgaagcaaagttcataaagagcatgacttgggcttggactttgcattttacaaggtgtgcagtgtgagcttacagaggctttgacagcagggagtgagtggagcgttgggctttgttatttggagagatcactcttagtattggtattgggacatagatggtataataacaaggagagactgtaagaaactttgcagtatctaatcaagatatggggagaaacttacactaaagagtgtgtgctaggtgaagaagaggtaggattttaaggaaattctccaagttttaagtgcagaagtgtgggaggaaaaaatgtaagatgatgatggttctggcttgattttccagagtagagtagagtagccttcaagatttgatacaacgcttgacataggacatcttaaaggggagctcttagacttcaaggagaatatggtaaatattaagtacactattgggagcatgggtctgctgtatgggagagtgtcttggctagaggcttacttgaggtagtcatgatctaaaggtgatagctgaaggcatgggaggtagatggtataaaataataagcctctccactgtgcttctgggggatttccaaacaccttagcatgccttacaaggccctttagggtttttttctgtactttgttagtctcctttacaaaagttaatgctgttctctctcatgcaacatgcattcctcgtgtctccagctgtttgctgttctcctcacttcccgggctcttctgtatctccattacatcacacatgctgtttcctgtgtttgcaaggcatggctcctctttgtccccttaacaagctctggatttttctttaacacccagttcctgaacctccatggcccagctaatagctccatccttgaacccataagattttgtacatatttctattagtacttatatctcacttagagtaattatcacttgcctttcactcattctgtatagactgtgaactcctaaaggaaagagaagtaactttagtcatttttacatccccaacctcaaaatggcacttggcaaatagatgctcagagaatgtgttttgattgaattaattcatttgtgtgtgagctgcaggtgtcacattagtggcttttggatgtgtccagaagtatacctattatacgttgaaattttgcaaatcatcatatttgcaaaggttaaatgtaaacaggagaaaggtgagacctgaggtccttgtcaaaactgtttttcttactgtaatatcaatgtgtattgtttgtggaaaagttgattgataaataaaagaagaaaatttaaaatatccatagtctgaccacccagtgatatcttggcttaaattgtacgtacccaaaatagcaaaaataggatctatctgtgtatattgtccttgacttttttaaaaaacttactatctgtgcatcattaaatattagtaagtagtcatgttttgtggggttttcttttagtttgagatgaggctggtcttgaactcctgggttcaagcagtgttcctgtctcagcctccaggtagctgggactataggtacacaccaccaccatcctcagtagtcatttttgagtgggctagttaaatagacgacactcccatcatgcattatttaaccagttccttgctgttggacttataggctgacttataggctgtttcaaatttttaatttatatagtcacatttcaatgaacaatccagtagtgttgtcatattcatttttatttagaatacttcggtgaaaggaagtatatatcttactttttccaactctattagcaaatcatctcttggacatttttttttttggagacagaatctcactcttgcccaggctggagtgcagtggcatgatctcggctcactgcaacctccacttcccaggttcaagtgattctcctgcctcagcttcctaagtagctgagattacaggtacctgccaccacgcctggctaatttttgtgtttttagtagggacagagtttcactatgttggtcaggctggtctcaaactcctgacctgaagtgatcctcttgccttggcctcccaaagtgctgggattacaggcgcccagccagtctcttggaaaagtcttaacaatttttattatcaccaactgaattcttctcatcatatttttaggttttaaattgtctggaacttaaaaatatatgaagataggccagccacagtggttcatatctgtaatcccagcactttgagaggctgaggcaggaggatcacttgaagccaggaggttgagactagcctgggcagcatagcaagaccctgtgtctacaaaacccaacaaacgtgtgtgtttgtgtgtgtgtatgtgtgtaaaacatatatatgaagatatgatatatgaagatacattacgaagataattcaaatatatatatgaagatacataggaagataatttagcttgctgcaacagaaattccaaatttagggctaaagaaattatcaaactgaagcctttttgtaaatttaagtagttttgttgattttagaagtagacttttctggccaggcgcggtggctcatgcctctaatctcagcactttggaaggctgaggcaggcagatcacctaaggtcaggagttcaagaccatcctggccaacatggtgaaaccatgtctctactaaaaatacaaaaattagccaggagtggtggtgcgcacctgtagtcccagctactcaggaggctgaggcaggagaatcgcttgaatccatgaggtggaggttgcagtgagccgagatcgagccactgcaatccagcctggcgacagagcaagactctgtctcaaaaaaaaaaaaaaaaaaaaaaaattagacttttccaaataatggtcaaggtttttaagtatgagaaaggagtttcatggtcttggggatcagggtcctcttggcatggagtgggtggtgacgtgaaggtgagccctccagttccagctctgttattagccttcttgtgcctcttgtgtggctgtttcccagctccaacccaaagttttattaggataaagtcttggatttaggcatatggatattaaatatcagtagctgaatttggggtttgaaataattgctgcttacttctaacttccccatcccactccagattctttttgccatccctatctacattaaatagctaattgaagccaggcgcggtggctcatgcctgtaattccagcactttaggaggccaagacgaatggatcacctgaggccaggagtttgagaccagcctggccaatatggcgaaaccccacctctactaaaaatacaaaaattggctgggtgtggtggtgtgctcctgtagtcccagctacttgggaggctgagacaggagaatcacttgaacctgggaggcagaggtcgcagtgagctgagatcatgctactgcactccagcctgggcgacagagcgagactctgtctccatcaatcaatcaatcaattattattcataaaatgagaagaagctcctccgccttcccctgccaaggggatgagcaaatgtgtgttacagctcactttgaagagctgtccaggcttttgagtgaaatgcagaatttttacctcttgcttagtaatttgctcatttttcagactactttgcacagatttaatgattaaggaaacaggataggcaaaggtgccagcgtttgatattatcttaaggcctaaactgaccttacggtgatgaaatgaactttttgagtgcgtttgtctcctgaataaatctgtaacagttttcttaactgactccctctgtctctcagcatcagaaagaaatgagagaacattaagccacagaaagcaaataatggtcaaaataaagatactcttttgctggcaaacttaaaaattcacttgtggggctgagcgtgttggctcacacctgtaatccctgcagtttgggaggccgaggcaggtggatcacctgagttcaggagttccagaccaacctggccaacatgatgaaaccccttctctactaaaaataccaaaaaattacccaggcgtggtggtgggcacctgtaatcccagctactcaggaggctgaggcaggagaatcacttgaacccggaaggtgaaggttgcagtgagctgagatcacaccactgcacttcatcctgggcaacaagaacaaaactccatctaaaaaaaacagattcacttgtggaatctaatagctgtaggcaagggatatttattgaaaccaagatttaagtgtggtttatgatgtttatggagtagtttaatactacttttcttcaaaatgagtttttaatttaggaaaaagaattcagatatgttcccagagtagagatgactgaccatcatgggagtggttagggtttggggtttgtgtgggtaagattctgtttacccactacagccattgtgtggatttaaaagctttcctggatggaatttatggagtgaaatttgaaactagtgtcctgtgtactacaatatatggtcacaacaagcaatcaatttagaaagaaatggaacggagaagatacaggttaaatgatgagtattgtgcagtgcagcaagacatagagtgatcttaacagtaatgtggtatgtcaccatctgagttctgttataaagctcctaggcaatgactaaatcctagaaatcattgcctactttcagtggcagacagagtataatccattcatgatagggggttccaggtacattgatatagaagactggccaagggggaatgacaggggttacagctaacatttcctaggtaattggttctaatttccaggctccaagcaagatactgtatctcttttaccctgtttaatcctccccagcacccagtgaggtacagatggtattgtatccattttagaattgagatgactgaagcttagagagattttcccagtcatatatattcacggttcctggatacagctgtacaggttgttcactgcatgaaggtggctggctgaggtagcaggcaaaggatttgtttgctcagcagaggcagcattttctaatttgcactaaaacctgtgtaggccaactgtagccctactcataaagttggttaatgcctgaactgggagtagaggtgaggcagtgttgaagtggataggtagattctgagaagcttatactatacctactgaagtcctaatctgtaggctgtctgcaaactggtttgttttgctaccatcctatcccagcatttcctcaaagatcccacagtgacttctttattgtggatctgatggtctttggcagctatacagacattcttagagtcacagccaggattaaagtctaggatgcttgtcttcaagtcatgcatgctttctgtatgagataatatacaaaaagatggtcaagaaaagtgattttgagataaatagtggcctagaatagctagactgagattgttcaagcacagctattaatttgcttacttgctcagcactcaggctgtgctatttgcttcaagggatataaagattgctgctttctagaaaattataactcaattagggaaaccaaatcaatatatatttcataatataaaataagagaaattacagataacaataaataatagccaaaatacctttcttaactaggcatgtctatgtttctttaccttgctttagtgctcttagatgtcccattccagcctttgagttggagtggggaaggtgttccttattaaagaagcatctactacaaaaaatctaaaaccagatctgaggcccatactagacccttctattagtggtaattttaaaaaagaattttccatctaaatttaatagctttcttctgtagctaccctaccctatccctgggccaggcaccaaagtgaataataatgtgctataaaatccaaaccaaaatagtacatcttctttggcatttgaaatttcagtgttttttgcgtgtagctacaaatgtcttccattgtggcaaccactgttttgggtggttttttttttttggagacaggatctcactctgtttcccaggctggagtgaagtgatgagatcatggctcactgaagccttgccctccagggctaaagtaatccttccacctcatcctcttgaacaacttggactacaggcatgcaccaccacagtcagctagtttattatttttatttttgtaaagacagggtctctactatgttgcccaggctggtctcgaactgggctcaagaggtcctcctgtcttggcctcccaaagtgctgtgggattactggtgtgagtgaaccaccacagtcagttttggggttcttttgaataatcagaagctgaaatcagaagccaaaaatagcaaaatgggaattctgtgtgcttttgtgatatgattatatttgtgttcccagcctccaaagaaagcaaatgtaatttatatggtactcaataaactatggcagtcaagaaaaccaaaagaaaaacctttttccacttggcactgtccaatagagctttctgtgctgatgaaaatgtcttctatgtgcactattcaattcggtagctactagccacatatgcatttgatatgtggctagtgtgatcctaaggaactgaattttgagttttactttcataaatttaaatttgcatagccatgtgtagccagtggctaccatactgggtagcacaggcatgccacatgctgtttctctcttaagttggcacctttaatttctgttttaaaattcatgtctcctttacttgtccccttctatcttctctttctcactcactcccttcctttttctctttgctttttatttctccttgcttctttgctttcctgttttttctcaaccttctgtgatactactaggctgaccgtaaccccattaattataattatttattatggtctttcacctagttagacttgcctgcctgtgttctccttctgtccccaaagatgggggcattcgcggatatgcagtgtttaccaaaagctcctgatatactggttacttaataaaaacaaacaaaaaaataaatgggatttttctgacaagatggttttggtgaacctatgctgattcctgagatcacggcttctttttctaaatacacaaaaaaactgctttggtaaatcattctagaattttgcacagaatgaatcaaaatcagtggtattacataatcctaggctccatagttctgatttccagaactattgactaatagtaatcaaaacactggaatacttcactggaagacttctctgtccttacttttcagtagggggtttaatctaactcctctccagtctttcttctagaggaactctgtaattccaatctcactattttggtcttcccttctcctcctccttatctcttccccctttctgcttttccttctcctccttctcctgatataacttacttcctttctgagaatgccacttgtctctttctaactttaggtacttttgcctacttctttccttctactttaattcacatagaagtaccgtgagactatgtaaacacatctactttaagttaaacatttcctctattcagagtcatgcctttttatatttaaaaaaaaattctaggctgggcacggtggctcacttctgtaatgccagcactttgggaggccgaggcgggtggatcacctgaggttgggagtgcaacaccagcctgacaaacatggagaaacctcatctctactaaaaatacaaaattagctggacgtggtggcacatgcctgtaatcccagctacgtgggaggctgaggcaggagaagcgcttgaacccaggaggcggaggttgtggtgagccaagattgtgtcattgcattccagcctggacaacaagagcaaaactccatctcaaaaaaaaaaattctatatttgatttcaagcctcaaataacttaagtaataatgactacccatctgtaagagtccttgctttgtgatactgttacactctgttgtattgagaatgctctaagtcatatgttaccaacatgctgtggacctttagcttttcccagtttccagacagaagcagtggtcagtcacttaactgcactagacagaaaagcagtttttcccttctgaaggttaaacaggtttttacaccactggagatttttaaggtgggtatgggtattaaggtgggtattgttagtcttttccctctaagtttccccaatgtccaaagaattaacaaaattttaagggttctgatttatatggtaacacagtctgttagtcagatgtaccaagtttcttcctatctaattttttttatttttattttttttgaaatggagtcttgctcttggtcaggcaggtctcgaactcctgacctcgtgatccacccacctcagcctgccaaactgctgagattataggcgtgagccaccatgcccggccttttttattgttatttttttcagagacagtgtcttgctctgtcgcccaggctggagtgcagtggcgtcatcttggctcactgcaacctccacctcccgggttctagcgattctcctgcctcagcctcccgagtagctgggattacaggcgtgcaccaccgtgcccggctaatttttgtatttttagtagagacggggtttcatgttagccaggctggtctcgaactccggacctcaggcaatccatcctcctcatcttcccaaagtgctcaggatacaggcgcccagctcttgccatcttagagtctttgcaatttttacttttatagcctaaagtggcgctttgcatgcctagatgtatcttcagcctttatactttaatcattctgaggggggttttctgtgtccctccttcatcaccttcaccctgtttactccctccatatcattcattcctcaatacttatttccatgtttccctgtctccaccactgggatgtaaggatttcttatcacttgttctgtgcagttaatctcagtgctcgggctcacagctgggagctgataagtgctcaatgaattcaagtgtttagaagaatgttagtgcagagtagagattgggcaggcagtgttagtaggttagtaattattactagaaccaggtagagtttctacaacctgcattgaggccctgagcatgaagaatggagtgttaaaatgagcctttcaaaggcaggattggcaactgtgtgaggtgacaccactagagacatggtttggacagcgcttccgaagatggaataccagataaagatcagtgtggatggtggagtccttaactgattcagtttaagatatttgattttgatgcatttgggaatagggtgctcttgctgagaataggggttagggctcaatttacaaacctttctgttcctacattctaggttcctatgattataatgattcttgctgataatattttctcccagcattatttcttatatataatacgtgactataaaggctcgttcctgtttcaaatgcctttgcacatgcatgatttggatttttttccagccaggtctcaggggccatgtttttaaagtctgctgctctttgggctgatattgtggcttcttgaatcgcatacaaagcaggtttcttgaaatctgctcatctaccatagtttaccagttatctgtatccttgcggctctgcttgaactgaagcttaatcttgttctttgtagggcccagctatttttgcttgtcattctatcacatgccgtttaccaggaaacattcaaataatgattaatgatgccaaaactttaaacatggaggaagctggtaataccagctccgctgtggagattttcaggagcatcaatgccggctgaccggactggtatttgagtctcggataatggagtagtaggtctcaaaaagttacacttttctgggtaattgtcagcttcccagagtactgttaaattctgtccctcaaaaatgatgaaattgcaaaggaatggtcactgttacaggtattctatcttcattatctgatttaatcctcaaaaaaataattgatgtggaataagttttttcattcccattttaatgctagaaaattgaagcacaaaatctacccaccaaattgtggactgtgttttctgtatctcttatcaaagctctccagggtccctagaccctctgttgtccctctgttctagcctttcagattggcttctttcacttagttattatacataaaatgccatgttataaaatgcctcagtcaggataatggggaaagtgttcttgggagacagtgcacataaagaccttacagtgctgggtgctcaaaatgttaccatcacttttattgttagcctcttccctcttaagtttccccagtgtttaggaaattagcaaaactttaagggttctcatggtaagacagtgatacgactattatgtatatggtaagggggtgatatatctatcatggtaagtaacaggacattgaaaagacagtcatgggaataaagctaagtaaacacatgtttcattggaatagcttctattagtgacaatacctcctatattttggactaattcccagatgaaagattttgctgaaactaggcattaatgaaactaagccattcagtacagtgtgattttctttttttatcttgtgatttgagaagtatattctaaaaacccagtaattcagccaggctggacattcagttaaatatcagtggagccagctgtgtaaggacttattggctttgtcctatacatgtggtatgtctggagttttggaaacaattcatggcctccttttatcggttgagtagcattgaggcctcataaaaaatagtaacttgattctaaggtaaatttccctggaaagtatgaaatgggaaagttaggtttccatgtacccccccgctacgcatagcattatttcaattccaagaggcatttgtagtcaatttctatgatgattggaaaggagcttaaaaaattcttacaatctctttaaaaacttttgaagcagaggagaaaaaattggtaatttgtttttcaggaagaaacatacctggatttatctattgctacatgtaggttttttttttttttaactaactagaatcacagcatctttttctttttaaactaacttgaatcacaaaatcttatgtcatacttcatgtctttccttattaaggataattagtttatggaggattcagttatgatggtgatattattagagacttatctgaatgaaatcagaaaagtgtatcccgttttatgtagaagatttttacataaaatatttacacacacacatacacttcattttttagagcagttttaggtttaacagcaaaactgagcaaaaagtgcagaatcctccctacccccaccatacccctcaccctagcatccctgactataagcttcaagactgcaccagtatggtacagttgctacagttgattaactggtattggcaaaacataatcacccatcttacatagtttacattagagttaacttttggatttgtacattctgtgagctttcacaaatataaaacggcatgtactcaccattatggtatcacacaaaatagtttcattgccctaaaaatcctttgtgctctacctattcatccccctaccaaaaccctgatctttttactttttccatagtttcgccttcgcaagaatgtcatacagttggaatcatactatatatatgtagcctttcagattggcttctttcacttagttattatacatttaaggtcctccgtgtcttttaatggcttaatagctcatttcttcttagcactgagtagtacattgcctggatgttccacagtttatttttccattcacctaatcttggttgcttccaagttttgtcaattatgggaaaaagctactgtaaacatttatgcgcagatttctgtgtggagatcttaacattcacattggttactttttttaaatttcagatttatcaatattacagagctattgcaagagtcatatgagaatcgaggatctggaaattctgtatgaaagaggtgccatctgagtagggccttaaaggatgcgctgatttggacacatagattggaggaggtacatcgtactgtggctggcacagtatgtgattttctgtttgattggagttcatggtaaatgtaggaacacggtgttatgttttcgatgccttcgatgctaggctaaagaagataggcttccttagtgaggccataggaacccatggcagatttttgaggtaggaagtgataagtaatgtcactcatttatttaagcagctagtcaagctcgcttagttccaaatagctgcttgaccttgcctagttccaaataattgacttaaaattaacaagttgacatttattaaacagtactttttacagtttaattgttcaccactttagactaaattttttctacaggtggtgcaagttaattagattttcttataatgagaaagaaaagcatttcagtacagtgtcttctgttctgatattcaaggtcatttcctatataaaagtaaaattctacacagcataaaaccatcctttttgacatttagggaccataggttttaataacattgaacaaagggttaaattttttaaaaagtttttgtacactctttctttggtatgcttcatctctttcatttgagctgaacagctttaaatttcacttaaagaaatgctagataaagagaagaacattgtataagggcaactaagtgaacaggaagctgtgcttctcagaatggggagattttaaaatagaggagaaagctgtcaaagcaaaagtatagcagcctcagctttacttgggaatttattagaaatgcagattgttagactctaccccagaagtcctgtgggcggggctggcaatctgtgttgtaagcgagaaagactaatctaaaccactgatcaagggagggggatgttaagacttactgcagaaaagaggtgagaaattgtactaacagttactgttaattcaacacttactttgtaatgcacattttacagatacagcttatgtaatcttttatgtcaaccctaggaagtataatattacaatatcttactatatagatgagcagaaaagaatggtttaagaagtagcattgcaaaacttccggcatggaaggtgtctttgactctatactctgacctctttaaatcgtgctaggccatgcaggtatgttgtttgtctcccagaaggcagcggtggggctaaggcagcacccacctctctgctccctctgctgcattccccagcctccctgactgaggtaggtatttcttccttcctgcatccaggtggagcctgcctggtccagtgaaggaagcagaacaggaatggcaggaaaccagctttttctgtttctctggagttctcttaacaaaccctgtgaccctaggcctgtctcttggtatctctatgccttatttattttcagcggtaaaatgaggactgggataaatctgtaggttctttctgaattttatctggctctagcacttaattagagacagatggtcaaactaggtgacctctcaagggttcattctggttcgtgttgagaggagtttgatattggaaataatagattcttgtttatgtgcgaaatggagacagtactttctggaaatggtgtgatgcaaagtgaaatcatgtctgtgaagtccctagtagcctgcctggcatacatggaaggtgctcagtaaatggtagttcctcagtccccaagaggaaaacagccgcattcctgattctggtgttttctttccttaagttttaacaggttagtattttaattttcctctcaaggagggaataagaggtgctaggtttgtattaaaatattaagttaattaaagcttcctattaaaattttaagagagaggaagagaatggggcaacatgaccacaataaataaagcaaataggtcattatgtttccaaatggcattatcccttgactgttggtagctttcctaataataataggttgaaaaaatgttactgtaacataaataataaaagatacttatggtagtactctgctaagtactatatagacatgagatacttaataacttttaatatcatggtttggcaaaagaaacttcacaatggattaactatttatttggtgaacttaacttggggcaggcttgtgggtggaatttaagggttatttcttcttttttttttttttgctcccccggagacggagtttcactcttgttgcccaggctggactgcaatggcgtgatctcaggtcactggaacctctgcctcccgggttcaagcaattctcccacctcagcctcccgagtagctgagattacaggctcccgccaccatgcccagctaatttttcttattttagtagagatgggattttgccatgttagccaggctggtctcaaactcctgacctcaggtgatccacccacctcggcctcccaaagcgctgggattacaggcgtgagccactgtgcccagccgagttgtttcttccctaatttctctcacaaaccttccttttatatagagaaaacatttttacttttcatttgaaatattcttattgttgtttttttctgatcattactgatgtaccttctatagaaataagacacatatttggcagggcacagtggctcatgcctgtaatcccagcactttgggaggccaaggagggcggatcacgaggtcaagagatcaagaacatcctggccaaccaacgtgatgaaaccctgtctctactaaaaatacaaaaattatctggacatcgtggcacacgcctgtagtcccagctactcaggaggctgaggcaggagaatcgcttgaacccaggaggcagaggttgcagtgagccaagatcacgccactgcactccagcccaggtgacagagcgagactccgtctcaaaaaaaaaaaaaaaggaagaaataagacacatatttatcccaacgtacattgtttttcacaagttgcaatttgatatccttagctagtttcatcattctaccgtgacatttatccccattatgacatttctaaattatagtgcttctctctcatgttacgcatgtttctaagctcttggttggaatctgtaaaatagctagttgttaacatttaataaaatttagacttacctcaccttactctgttagcaaagagttacatgaactctgttgttttgaattaagaggtcagttgtggcagtaaacctgggtagaatttggaaaggaactaggctacttcctttttgattcttccttattaggtcatttgtcaagtggatacattatcttctttccctgagggcaggagaccatcttagttcccttctgttaaagagatctatgattcattacttccagtgtgaaggccaggtgcttttgcatgagttgtaaactgctaagcgagcccttttgtgccttgtttgtgtatgagagtctttctcttcagagtgtagggcaacctgtccccaaccagtcccctttcccaacatccccacccacagtgtgatggatgctggcagtcataccacattcaacatttccaagtgggacttgtttttattggatatgatcaccaaaaaaatttgaatttagatgagaaacaaatcaaggggtggttattcacattgccgatgggttttgggttttgtttttttttttttccttcaaaatggttcagcctaggggttctttaaatagcaagttgctctgctagatttaaatgggatttgatatataaaaatccatttacacatttaacaggatgttatgttggtataccagaatgatgaagagcaaaattctggagtcttaaacccaagcaagtttagaatcccagctttctcgtatcctggcttgtgtgatcatgggcgagttatttaacttctctcagcctcggttttctcactggtaaaccagagatcatagcacctcatagatagcacttctggagtgttttgaatggcagaaacagaaagtgtcgtgtaagacaacacatgcattgtgtaaggaaagtcttagatgtctaacacagcagtggcagtgttcattttcagggccattttgcctgagtttttgttaggcccttctctcttttcttctttgaatgtatttgtaaacttgaaaagaacaccgcgaaaagagctcaggatcctgctcagccacacttcacctgctctccagcttggcatgattgattgtcaggaaggcataaagaactcaaaccatgaattaccctactcggggtaatcacaatggtttggatggcatctccttaatttttgctttgacttttctttcctccgggcaagagagagtagaaggagtggcaagagtatgccttttagttactgagttctaaattcttggaatgagcatagtctgttttctcaggatcagactagaaggcgtcattctattacagaagagccaagacttgtcccaaatggatgtgggtttcagcaaagcatctttagcttaaggagcgaaggatttggactgtgttcagcatctgtgcttcgcaggccactctttatccttttagtgagtcccgcttgtctgtcctctgtcaagggctcgtgtacaccatgctgatttagtgctaactggggagattacaaatgccttgcctggcactgtcagctaaacctgaatcattgtctgtgtactgtgacccgactagtcagaggtttaccctttgctttgctgctcactcttataggcagaaaagcccagctcaccccagcttttataacggggtcagctccagaaatagcacctttaactgggaatagaagcaacacaaatccagcaagtagatagtatacaatggctgctttttggccttggaacaaacaaaagtggtttatgtttactacataccacttccaaaactgctgtctgtcatttactagagagtttatcattcctgagggccaaggtctaggttttcttcacacaaatgccctccaagtgggagctgcttggtgttggtcattgtttgcacccagatttataatttggggttaattagacataaagacttaaaggcaaatgtggtacctgatggaccatgggtagataagacacctcccaaaatggatggtgaaattctttttaagagtcatagtatggagaaagtccccttgtgaagctttgtgttggagcctagaattgtaatgtatggcactattagacttccaaaaccaatgtgaacttcagtcgtttgtatcatgatttgctttatcctatgttcctatctttcccggtagtaggtattactttgtctgtgggttacatgtctttctcctctaagatttaacctggggattattacatgcatatttatatgcccagagacaatagtaggcgctcatcaattgttgaataaatgaatgaatgaatgaccaaatgattgaacaaacaaaggagcaagtgaacaaacagagatgtgaagtggtggggggcatttctatatgattgtgtgtaaagagcaccctaacacagcatctgaacaaatcactcttggaaatctgttcaatcccaccaccttcactagctattcctgtgaaccccaaccctcccctagatacattttggtgatatattagattattttttctttgcctccctcctaccatgataaaaaggatattgaatggccaaaccagtgcattacagtaacatgaaagaaatgtttatctttcatctaccagaattcaaggaaaaaaaccacaaaactttgtcagctagatactttcctgaattgttttttaaaattgtttaaaaaattattattattgccaggcacggtggctaacacctgtaatcccagcactttgggaggctgaggcaggtggatcacctgaggtcaggagttcaagaccagcccgagtaacatggtgaaaccccatccctactgaaaatacaaaaaatttagctgggtgtggtggcaccatgcctgtaataccagctactcaggaggctgaggcaggagaattgcttgaacccgagaggcggaggttatggtgagccgagatggtgccactgcactccagtctgagcaaccagagtgaaactccatctcaaaaaaatatatatatattattatttttaatagggtcccaccctgtcacccagtctagaatgcagtggcacaattatagcctacagcagcctgaaattcttggtctcagggaatcctcccacctcagcctcttgggtagctaggactgcaggtgtatgctaccatgcacagctatttaataacagttttttttagagagggagcgttgctttgttgttcagactggtctcaaattcccggcttcatgcgattcccctgcctcagcctccttctcaggtagctggtattgtatgaattgtgttttgaataagaagaaattaaggcttataagatcagttgtgtgttagcagcgatgttgctgactgatctttgcaatctgtaggactatttggtgctacaataataagaaattaatcagtttgataattttgccatcatttttaaaaaattttgtaaaataattgaaaatcatatgtgcaatatcttataaatttttattttcaaagcacattcctatatggcaattgaagtacagtttgaacttacttttgactaccttcttaatagtgattgatcataaattataaaattttcacttaccaaattatgtttaaaaagctaaatttaacattttctttttaattttggagttgaatggtcctttattccagtctttgtttttgtttttttccaagggaagacaaatatttaagttcaaagtcatgtttaatagaggaaatgaatgaaaagtggatgtctgttatctgtttgcaacaatcatctttatgtcctagtaaaagtttaattttaaaatctaactttacagatctatacccagtaaatttttttttttttttttttcaaacagagtcttgctctgtcacccaggctggagtgcaatggcgctgtgtcggctcactgcactccgtctcccgggttcaagcgattcttctgcttcagccctcctgaatagctggtactacaggtgcatgccaccacacccagctaatttttgtatttttagtagagacagggtttcactatgttggccaggctggtcttgaactcctgacctcaggtgatctgcctacctcagcctcccaaagtgctggggttacaggcatgagccgccactcctggcccccagtaaataattttaagaatcttaaagttactcatttttacttagactttatgagattaagctattttcaaactcacttctatttgtcctcccctgagagctatttacaaatttgtatagcactctggagtgtgataatatcgaagtcaatgcacagtcaggaggcttgttaacttatgtgatgatgtcagttttgataaacatctttctcatttaggcatttaatgataatcatttcttcaagaaaaagttcttagtggggaaaaagaggcgaaaagtacagtgtgattaacttatgatgcattttggattacagccttttaaccaaaagagaatcatcattaaaacaataattcctcagaaggcttgaggcatttaacttctcttaattaaattagctcagtttactgccagtcaataaagtctggtttggaatgatgatagaaattaaatatctaagaatgcagtatacataatagttaaagaaatgcaattaaaagtaataaggaggtactacttttcacttaggaaattaataatgatttatagaagtgagactactaacttctgggaaaaatatagtgagactgtcacttttatacaccactagaaagcccttttataatgtttgtcaagattcttcaaaatactaatagcttttgatccattaattctttgtctaggacatgctgagttggtgatcagatgtgaagaaaacttcaggccaggcttggtggctcacgcctgtaatcccagcactttggtagttcaaggtgggagcatcgcttgagcaaaggagttcaagaccagtctgggcaacatagagagatcccatctctacaaataatttaagaaatgaaattagctgggagtggtggcacatgcctgtggtcccagcttacttgcaggactaaggcaggaggatcacctgagcctgggagattgaggctaaagtgagcccgtgatcacaccactgctccccagcccaggtgacagagtgagcacctgtctaaaaaaaaaaaaaacctggaaaaagaaaaacttcatacagccaaaatacccaacatcatgcaaatgcatggttgatttatgttattttctattttggaatattatgcagaggttaaataataagtgcacataatatttactacaaggcagaatatttgctatatcttaattttactaaaaagtgtaacatataataatatttgaattatgtatggaaaaagagagtgagaacaagaatgaattgaaaacagaaagaaaatgcacccagatgtttacagtcagtgattatgttctgactggcaaaacataagtagattttttttttcttttttttttttttgagagagatggagtcttgcttgtggcccaggctggagtgcagtggcgccatctcagctgactgcaagctccccatcccaggttcacaccattctcctgcctcagcctcctgagtagctgagactacaggcacctgccaccccacccggctaatttttttttttttgtatttttagtggaaacggagtttaaccgtgttagccaggatggtcttgatctcctgacttcgtgatctgcccgccttggcctcccaaagtgctgagattacaggcgtgagccactgtgcccggccataagtagatttattttctaaaataagtgcatattacacttatgataaaaattatcatcatgaaagattttatgttcaaggatttcatatagctgctttgtatttcttctggcacattacagtcatagtggcagtgacttgtagggacattgtcctgatacttcgagtgcaattgatgatatttgtttaatagtgaatgtagcttaagaaaagaaaagcaatcaaacaacaaggtgattaatgtagccacttcaactcctcagatctttggctgacatgttttcctagcaaagcagaggtacttaactaaccacagagaaatgctcacacatgtcagaaggaaatccaagtgatcacttgttttgccttgggcatctgcactttttatataagtatgactttcagtctgtgagacctttcgataagtagtgataatccagaaggattgatgtagtgattctggacttgagatttcttttcaccactaagacatttgactgtcacttgcatcttaatgcgtccatataattttctaaagcattgggggactgactaggtaaagtcactgtggccttttaagtatgtggccagctgatctcatggcctaccagggcttccaagtgattagtggggattggcaagaattgacctctttggagcctggggaggcagaagtacctcagtaatagggttcagggagaccatacatggagcatagctctctctgactttcaagtggatagagctagtaggcctctactcattgtggtgtttgtgatcagacaacccttgctttggaatcactcttcgttgagagatactgagtccaggatgtgccaagcaagattgtagatactctcacagatgaattcacccattcatttattgagcacttgattttttaggagtacaacttcatcattaatttcctagctgtgtcatacaggatcagttaggttagattctccctttgtaattaatcctaattgctgggactttcatgtttctaataaatgtctattcccataatcctgtcctacattagctttcttcatgttgttctgtgagatctatagtaagcagatgacactgcttattatagattagctacttcctgtgtaataaatcaattattcctctcaatagggacaatcttgaattaaaatcacatttttttcttagagaattctctgtcaaattctatcaaaggccatggttttttttgtttttttttttttcctgtccagagacaccttattaatgacttgattttatccttatttcaaattctaattcatgaatatcagggtataaaatattaaatatgctggttcagctaccagcttttcaagcatcattggggaacatcctgttatataataggaaaacatttggtatggcttttgggatgtagatcatttttataattattatagggagtaaaaaatgcagaataaaaaataatttaaatataattagaagtgagagcaggtcagtatgaccaagaatataaatcataaatctctctatttttgtgttcctttatttcatgcagagaaataccaaacctttgtttctaaaagggcaccaggtctttcagaaagctgtggttctcagcagcaattttagttaggtttcgtttcatgttttctggtattctgggcctcccaatagccatttgtgcctaaaagagagagaggatgaggagatttgggttgcttgtactgccagcctggtggcactctggggatattagatgtgttctgaggatatatgtgtttatttaaatttaaacagaaagtatttcaatggatgctgggcgcagtggcctgtagtcccagcactttgggaggctgagttgggtagatgacctgaggtcaagagtttgagaccaacctggccaacatggcaaaaccccgtctcttaaaaaaaaaaaaaaaaaaaaattagccaggtgtggtggtgcatgcctgtaattccagctgctctggaggctgaggcaggagaatcgcttgaacccgggaggcggagtttgcagtgagcagagattgcgccactgcacttcagcctgggcgataagcaagactgtgtctcaaaagaggctaggcgcagtggcttacgcctataatcccagcactttgggaggctgaggagggtggatcatgaggtcaagagatcgagaccatccatggctaacacggtgaaaccccgtctctactaaaaatacaaaaaattagccgagcatggttgtggtggcacacacctgtagtcccagctactcgggaggctgaggcaggagaatcgcttgaacctgggaggtggaggttgcggtgagccgcgatcaagatcatgccactgcgctctagcccgggcgacacagggagactccatctgaaaaaaaaaaaaaaaagaaagggagagagggagggagggaggatttcaatgggacagaaattcaccaggtacattagaaagccttaacacttgagaatgtgaagtcttaaaaaaaatttttttaatagtttgggttacttaaaatgaaatactgtactgaagcagatagaaggactcttaggacctttctgtgtttcttctgtacctaatggcatataataaattcactgttttgtttaaatgatcagttgacttgagctttctgtcatctgctcagaaacactactttaggaatcttattccatttgggaattctgactagaagctctcccagggtcatcatatgaatgagtaacttacttcgcagctctcctcttcctcagtagctgcttctctgtagggctggagggaaagagagtcttccatgcagtctcatcagccaagaggaaggagatgctggtacctggtctgcatcccaacagacagcacaccctcatgccttccccttgaatgtacctttttggctcttcctcattcctggggaaatgtaatagttcttgattgttcacagtgttgactgctccctacaatgtgaggttccccctctcctctcccacagatggcacagagaaagtgcttatcatcgacacagtagtggggaaaaaaatggattctcattttagcaggtgacttgagggtggttggttgtcagtgtgctttttttcatattggcttgttgctacagggtctgatgctggcagattacaactttgtagctagtcattttcgatttatttgaacctatttctccagtctactgagctttcactggctagcatcaattcagacacattgcaattcttcagaatctctatccccatcagatggttcgatctatgagaaatttagctagaggcgtttagacaaaaaagaaatattgtggctggggaagcatttaagttagaggaggcagccagggctgttttattacttagtcctgtgtcacctgtgatgacccatgagagtggagaatattgatcgcttgtcactcaaggcattcagcagattgcattgacaaagcttggcaggtctctaatagcagggttactggccttgctgcggcccaagggaaaactctgcaggccctattacttggcggcctttaactcttatagaattgggagagaacactgacaaaagcgaggacatgattttacggttacaaatgatttttcttgcttgctttcttctcaccctttttaatttttcttttcttcttttcctgtctatcttaccttccctccgtgatccctgccagcccctcctttcttattatagctgatcatggcagtattgtttttttctgggtaaaaatcagagtggattagagaaagcttagcaggcctagcatgaggcctgagttattctctccttttaggacagcttgtgcctgaccacattgtttggaatgtgcctgtggatatatatacagtacttgaacttgatgtgtaggccattcacagctgttgtcctctagtagaataagaactgccacttcatgacagatgggtttctctcgttttccatttcctggtagccaggcttggttcaagcctttgaccttacatagtcccgaggttcagctgaaagtaatgtgctgacatcagagagataatggcactagtgcaaaacaggaatgattctaaaaaaacagtagagaggattctatctttcctagacactgcctgatttatgcacaggttcgaatcaccaccattaatgacattttcattcctaacataggttggcctcctgttggacactgttgtgtaatgagcgtttctgcatggctgtcatttgctttatgaagcattctttttatttctattttctgtgtacctttcatttaaaaaaatatcgtgtttgttatctccattgtctctttgaggatgagaaagacaaatatcattacccccatttcaaagaagagtaagttctaatcacaagtgatttaaatgttagagtttcattcaatattttcactaaaatttctagtcctctagtaaatcagatataagcaaagatcatatgtctatttcagcctctaggtaggctggccagctttcttgctttctccctctcccctcccctcccctcccttcccctcccctctcctcccctcccttcccctcccctctcctcccctcctttctcctctccttttttttttctgtagtcttgtactggtcaccccttcacttcctcttcctttgcaatgctttaggctgcccaaaaggttctagccagatgaacagaaacagaggagaggagagcttcttaagaggctggtaggccaggtgcaatggctcatgcctgtaatcccagcactttgggaagccgaggtgggcagatcacctgaggtcaggagttcgagaccagcctgaccaacatggtgaaaccccgtctctactaaaaatacaggaattagctgggcatgatggcgcacacctgtaatcccagctactcggggggctgtggcaggagaattacttgaacccaggaggtggaggctgcagtgagctgagatcacaccactgcactccagcctgggtgacaaagtgagacctcatctcaaaaaaaaaaaaaaaaaaatgggatgggtcagccttgagtagtggacatggcctttgcatttatattccaacattttgccacagatgagttatgtattattggcagattacttaatctctctgagcctttgtttctccatttatcgaatggaaggtaatattgtttaccaaaaaaagtgaattatgtggtatatggattatttctcaataaaaaatatgagttgtgtaaagtttctaacatagaaatgccctcctttgcttccttcctccttatacaactaagggcccacaaaggcagaatgagaattaccatctaggccaatactggggaaatatgtgctactactggagacagaaatgtggaagtattgcaaacgaatgtggacctattaatattctatagcactttgagccactttgaattaaaatacttatctgtgaaaggttttataatttatatgacctgaaataatttacacctaattagattttgtcaactgaataattctgtctcatgttgcttccacagaataatttaagcaactgcattttattctcaaaatagctgtaaatgtcaaattaattttgttgacatgatcaacatgtagaagagctacttggcagaattgtttgtcaactgaatgtattatgcatctttacaaaatatgtagattgattatggtttagctgacttttgcagtttgttggtctcctggaaagaagtaacgggtggtggttacaaaaaccgttatggcatttctgttcatctggctagaaacttttcgatatctgtaagttttccttcacttttcattatatagaccatgtctttcccttgggtgttatcttttttgtctgggtgagactggatcccacgtaactgctttggtgtttgttatactcctcattaattttatggggctcttagttgacactggccacataaaaatgattgttgagtctcactctttttattttggaccatttctttcatgtgggagcctctttatccctctccttaaaaaccctgtttaaggattagtgtccttgcagtttagttgtagcttactcaagttatcccatttattccaaaatcccttttccactccattataccctgtctagtccggtcttctagctactaagattgaagtcctgtcatcttcaggtttggttgaatccagtgcttcccaaccctgtctcatcatggcacatgtagaaaatgatattattgtacagcacacggaagtaaatcaagaccttttgctgtggaggtacctggctcagaggccatgacctgccttaagtaggagggaatacatgcatactatcctgtatgttttggtgtaaccaatccccaaatttgaaccaatcttggcaggtattagaaatttgcttatttggtgacatctggaatttacctcctcttttgagctcagtatttcatgtactttaaggtcattactgagctttctaccaaatcattcccatttgtgtctagtcattagataattcagatttctaccttggatgccttgaagtgatgacaccttacccttgctcatctctctcccaagggaataaacctgtattttgctttcagcttctgcttagaggagctggctccatccagaacaattcccctcccactggacatcaaaagattgcatttccattggcaacaagtctcaacatagctcagaaactactgttgactacttgtctcccctataacaatattggatccattggagagtgaatcagtgtctccctcaagttcagcccactcatttagatttttcattttagactccgtgggaaggatgtcccagtgcagagttggcctctgtacccctgattatgtttcagctttctctaatttctctgctaacctgctgttgatgcccctaaaggcactcaatattgagtgtgctttataaatacatgaactacatgtattttatgaaaacataaactacaaatacgttaaaatatactgtagattcattactaaaaggcattatctattcagtatccttaatgtacaaataataaaagagatatgaaaccctgtgtctagagctaaaaatataccttgacagtacaaatacacatggctaaaaggcattatctttttagtatcttcaatgtacaaataatcaaaaggtctgaatacttctgattttcataatggagaaggggaattgtagaaactgtagaccaattagcttgatgtcagctcagaaaagattctagaaaatattattaatgaatgctttctgagagtttaataaaagaagtagtcatcactgggaacctgtggaggttcacttaaaatgttatgccatctatattccttcttctgcagcagagattgccaaactttttctatacatagccagatagtaaatattttaggttttttgggccatacagtctctggtacagctactcaactctgccactgtagcaggaaagcagccacataggcagtatgtaaacagatggatgtggatgtgttctaataaaataacttaatttataaaaacaggcagcaggctgatttggccaattggccatcgtttaccaacccctgctttagaagaatatcttagataatgtgtacctgatatattctattcttctttctgatgggaaatactttctctttttttggcgtaaagacgttttattttctttgctaataaagagttggcataaaaaaaagcatcgcattaaaatcttcataaaggacatggaaaaggctcaagttaataatagtttacagtaagttctcacttaatgttgtcagtcatttcttggacactgctaccttaagcaaaatgatatataatgaaactaatctttttttctcaccaacattgtagtgaaaagatgttgaacaaaaagacgttatccaaggatgtaaatcatttaatttaaagttgcagtttccaagaacctattgactgtgctaagtgaggacttactgtagttaggtagaattataacaggtttaataattatgaaacatgaagagtggtctgtggttgcaggccacaggctgtgtgctcttgattcaattatgtcaatatttttattagtgacttgactgaggttggaattgacttgtggatcaaatgtgtggatagcctgatgaagagagagatcacttacactttgggtgataggagtaagatcccaaaaggccttaggatagcagctgaaatctttcaggcttaaatgttgaaaacagataaatgggaaaccctgtgtctggagctaagaatgtatcttgacagtacaaatacaaattgtgaaaacatagttgaatagcagcctgtttgaacaaagctaagagagtatttcaattagagtgcttgcagagaaagttatccaggtggttgaagggactcagaatcatgtcctattagaaatggttgaaagaagtgtagatatatagcctagggggatatatgataactgtcttcaattatttaaagggctgtcatgtagaagaggaattagacttattctggggggtcctggaggacacaggggagagcagtgggtagaagatacaggtagattcaatatgtaaataggaactttctaacaatttgagctgtccattagagggatgggcattatttagagggtttaagtcactggcaatattgtagacatctgttgctgaccttgtggggatgttgtgagagaatattagctttgactcattattggatgggatggttcttatggtcactaacaattctgagagtgcgtaaaaggtaggccgagggataatgtgctgcgccctacgtcccagtagttggcaaagtccaaacccagatgttttgagtctcctgccttgtttatatggttgaaatgctgactttacacagtgttccatatatgtatctgtacctgtcatctttatgtgattggctagagaccctgtcacgttcacttttgtaatctcacaaagcttgacaaatgccctgtacataggaggagcaaagtgtttgttgacctaaagtgaattacagaacagctgagacacatctaaatattgttcttttactgatcctggttccataatgaaaacatttggaagttgaccagaaattatacctggggattcctagtagaatggtgatgtagatggaacggctctctgcctttgtttctgtctgtggtacaccacacacaaatgccaacacttcaccaagagtggaagccatcaggctgcactctctgaccaggattgttttaccccttctggatggcaatacatcgctccctttctttttcactgcctcctgtgcatacctccgtgctaaattaaactccagaccctgggatgtctggaatatattttccagtcttctgaattctaccaccctgaagtagtcatttgctgtcatcataattctggaagatttaatattcagattgacagtggatatgccggtctcattctttgatgtttggtacatgggcaagtggtcaggtatcctggcctatttatcaccatattctccatggcctgtactcagggtcaggcatatggtaggtagtcagtgaatgtttgtttttgttagtaggactctggtttagtccttacagtagtcccttttatccatgttggtatgttccaagacacccagtggatacctgaaactgtggacagtaccaaaccctttccatactgtttttttttaatatgataaccaagacagctactaagtgactaacaggcaggtagcatatacaccatgctggacaaagagatgattctcatcctgggtggacagatcaggacaacgtgagaatttcatcttgcaactcaaaatactgcctaatttaaaatgtattgacgaattgtttatttctggagttttccatgtaatatttttggactgtggttgctcatgggtgactgaaaccacagataaggggtactactgtacttctgtttcatcctaatgaagtaaagtttctttgttcatcaaggcagtattttctttctcttttgtacctaccatgctctacctacctcatgtcttcattttctgtgccactttcttgctgtgttttattaggataatgttttaatagaataaaagaagggcaaaggtatagtaattgaatgtccttcactatcaatccccccaacccctgaagggagaaaggaaggagaatgtgggggagaggggaaggaagaaaggaaatggtggagaaagtagagaatgagagaagcatcctgtttcatactgagaagactttggtattgaagaattttgactttgttagtgccatataacttgtgtgttgctttgtttaaattctcgtctgctctcatgttttcattgcattctgtggatagcagctaagagagctttcagacacatctgtattagaagtaaaataactgttaatgtcaagactatatctttgcttttttctccctcagcttcttttctcgattggtagaaaacatggaataatggtgccagggttagctttgcctggagaagagttctgtttgccagccctgctgcagattgataaccatcaagggaaggatagcccagtcataagtgaccttgtggactgcgtatctttatgtaccccttacacactagtaggaagaacccaaataccatctgccaatgacagtgaggcaggaacctcacttttgtgacaaaaggattgtactttgctctgctggaactggctcgttaacaattcataagaaccaattaagttttcaagaattttgtgagctggttttttagtaaaacctttattagaagttaagttatattaaaaaaaataattagatgggtatggtggcaggctcctgtaatcccaactgcttgggaggctgagacaggagaattacttaaacccaggagatggaggttacagtgagctgagatggcaccactgcactccagtctgggcaacagacagaaactccatctcaaaaaataaaaaaaagttatgtaaacttacctgtgcttttaatataatttacttaattgtaatcagtattcaaaattcatcacttccttattagctgctacattttactaatatccatgaccttgaggttatttacatctagtatatggtagaaatactacaaaatgatgtgttattgagcctcttttcctaactctgtattcaatgacatcactttagtagccatggtggaagtatttacaccacagaaattggtaaacaggatgtcttattctgttttgttctgctgtaacagaacaccgcaaactgagtaatttataagcaatagaagtttatttggcagatggttctggagactgggaagttcaagatcaaggggccatatctggtgaggaccttcttgctgtatcacagtgtggcagaagacatcacatggtgagagaacatgctcaagagagtttgaagctcttttataatcagcattaatccattcatgagggtagagccctcatgacctaaacatttcccattatgttccatctcccaacactgttgcacttggggttaagtttgcaacacatgcttttggggggacacattcaaaccatagcactgtacaaatccaaatttggtcatttgttttgttgattgtctacacttaaaagaatgatggaggaaatgttattaatacagattaaatttaaaagtatgttgtatttgcatccattacattgtggatagcaaaacaattaagagaatatcttcttgtattttgaaactgtttccaactcaacaaagaagttattcatgtcctcgaggaaggaaactgtttatatcattcatgtcttaggtgttccactttaattttactggttcaaaaacatcaaccaggttttacaaaactacactcattcttcaggtacaaccataggttggctgtagatataagaattgcacatattttaacagaagcattctgtgaatgttaattttcccatttggttggaattcacagtaaagtttagcatgtactttgttattatttgtaaattgcttgctatacatgatttatatcagtaaattttataataaataggtgtacatctatacatacatacttcttttcccaaggagctggttgttaagtattaccaacacactactgtttacaatccaaatgagaatgtagctctgtgtcttaaggtagtgatgatcttgtgtaaatggtgagatttttgccttcatcatagcaaaaggctcaaatgcactataggaaggaaacctttctgattatggaatatgaagtcaggattttaaatgccaccaactgtcgaacacttaaaggacaaagtgtttgaaatcttaaagcctgcctactctatttaaaagaacattagagggcgttggaaagaggtgataaatatcattaggacctcagcaaggctttggaacccaacacattgaaagataattgagtgaagaggatctctggacacaaagcaggcaatttagttatccaaagcatttatgtcaagcagctaatgcgtgaggatttatttatttgtgtttttctctcagagcttaatccatgaggagtacagagtggtggtagggtggaggctagcctttattttgcattgctctgagaagtgttgcgataatgggagaaatttggtgtcctagaaacgttattattataaatgaaaaatcttgaaatacgaggaaagtgaattttttaaaactgggattagaaactcagaacaaaatgagctggacgcgctggtcatgcctgtaatcccagcactttgggagtccaggaagggcggattacttgaggtcaggagtttgagaccagcctagccaacatggcgaaaccccgtctctataaaaaaaaaaaaaaaaaaaaaaaatcagctggatatggtggtgggtgcctgtaatcccagctgctcaggaggctgagtcaggagaatcgcttgaacccgggagatggaggttgtagtgagccaagatcatgccagtatactccagtctgggcaacagagcaagactccatctcaaaaaagaaagaaggaaaaaaaagaaactgagaacaaaatggtcttttgcctctttctacttaaataagatggctcatgcaaaactatatttttgtgtgagatttttggttaacaagaagttgtatttccgttcatcagttagactcagtgtggaggaatgttttgtttaacctactttaactagaaacaaaatgtatttgcagaagtttataggtagaattataaggtgatctaataaacttgaaggttactttcagcatatggaaatcagaattttgttagtggaatggcaaatgtgaagaatgaaaaatccagttgatgccagttaacattaacttttaggaaagaaaaaacggtagatttttctgtgaagagtgtgtgtgtgtgtgtgtgtgtgtgtgtgtgcgcgcgcctgtgtgtgtgtttaaattagatttttctgtgaagagtgtgtgtgcctgtgtgtgtgtttaaaatttagctcatctggttctgtgttgtgtgttttctctgtgtgtgtttgaaaggggacatattatgaacgttatggttccctacctctaagatccattcctaaaatagttttactaatccgaagaatgactaagaatgtaactatggaaataaaatgacttttcaatcctgtgttgactacgtgcctaaaatgttgatttgctaaaacctggtacttccaaattaaatttcatggtatatggatgatttattgtaatctcttgtgaggaaattcatcttaaaaactttttcgaaatcatcctaagtttgggagaggagagcatttctaattcaaagcaggagtcaggctaagatcacatgtctccctagaggaaagaggggaggttttacttgtgcatatgttttttaaatatttatagatacagctggacttttagtactttagttctggttttaatgatggaattcccaaaggactaaaattgttccaaatgtctgaaccgtgtctgaagttcaagaacagtatatggttggtctgaagactttaatcctagttggaaactttgaatgagaaacctggccttttagtcttgtatttcttgaactttctgttaacagaatatctcctcgccttttatgtagcccttaactagctgcagactgacttggtcttctctagtaaagcattttctatgtaaggtcaccagtaaatttctttttgtcaacagagtaccttcttgcctcctattcagccgttaactgttttgtactgacttggtcttctctactaaagcattttgtatataaggtcaccagtaaatttctaagtcataaaattaagtgatttttcttatttcccatctatccagtcaacagtcattttattcagtacctactgtgtgacttggtgctagggattcattagtaaacaaagcaggaatattcttttacaatgtggagctttcaattttctgaccctgttgaccttccttcttcaaatttcataaactcgcttacttctggttagtgaaatcaatgatgattattttaataatgattcctcccctcatgattgtgctcagggccctctctttccctgatgattgtttttcttgatactttgtggatgattttatatggctaagacttccaggttgtcatctgcccatacacagaggaagtcctgagggaacccacgagtttcctctcactgcttccgtgctgtgtaggcaccttctcctgttagaaaaccatcaataggagcttccatgatcatggtggaggcggcaaatagtgtgtattttgcagggataaggcagcgaggacaagttgcctctatctactttagccagaagattagtactaatttctaaaactttcaaatttgtctttaaaaaattgcacccatatagcatatacatttagttgtatgcacacacacactaaaataaacttctttgtatacagtgatttggtataatcttaggacgattgtattttccttttgtttgtaacaactttattgagatataattggcatataatgaactgatcatatttaaactatacaacttgataagttttgacatgcatacacctatagaaccaacacaatcaaggtaatgaacaggctaggtgtgatggcttacacctgtaatcccagcattttggaaggctgaggaagcagaatcacttgagcccagaagttcaagatgagcctgggcaacactggaaaactctctcactacaaaaaaattaaaaattagctgggtatgttggttcgtatctgtagtcccagctactcaggaggctgaggtgggaggattgcttgagcccaagaggtcaagactgcagtaagccttgatcatgacactgtattttagcttgggtgatagagcgagattccatctcaaagaaaaaaaaatgaatatatccatcacccccaaaagtttcctcctttctctttgtaattcctttctcccccacctcccttccatctccaccccagcttattccctggcaaaaaaacaaaacaaacaaacaaaaaaaacaaaaaacaaaaacaaattaactgttttttgtcactataaagttgtatacatttttctagaattgcatataaatggcattacatagcacatactgtttgtccttttttttggaggagggggggttctggcttctttcactcatattatgcttatccacattgtgctgtatataatgtttcacaatattactcaatttatggatataccatagtgtgtgtttatacattggactgttttcagtttttgttattatgtataatgcagctatgaacatttatgtaagagtacaatgtacattctcttggacaaataagagtggaatggctggataatgtactaggtatatgctaaatgttctaagaaactgccaaacaataatcaaagtggttgtaccattttatatgctcaccagcagtgtgtaagagtcccattgtttccatatccttgccaatacttgttatgggcagtcttttccattttgccatcctaataggtatatagtgctatctcattgtggtcttgaattgcatttccctaatgaataatcatgttgagcaccttttcatgtgtgatttttcatctgtatatcttttttggtgaattctgtttatatcttttgccaatttttaaaaattacatttttttcttgagtgtcgagttctttattctgtatacaagacctttatcggatatatggtatacaaatatttgcttccagtgtgttgtttgtctttttattctcttaacagcgtcttacaagataagaggtttcaaggttgttttttaatttttatttaatttttagagataggatcttgctctgtcacccaggctggagtgcagtggcatggttatagctcaccgtaaccttgaactcctgggcttcagccatcatcccaccttggcctcctgactacctaggattacaggcacgaactaccctacccagctaattttttaaaaacttttttgtagagatagggtttcaccgtgttgccgtggctgttctcgaacttctgagctcaatcaatcctcctgcctcagtctcccaaagcaaaggtttcaaattgtggtgaatataatctatcaacttctttttatgggtcatccttttggtgtcatatctaagaaattatttacataccaaggatacagggttttcccttatgccttgctctggaagggttacagttttaacttttacatttatgtctgtgatccattttgagttaatttttgtatatgaaatgagacatatagtgaattcatttatttttgcatacttttttttttttttgagatggagtctcgctctgttgcgcaggctggagtgcagtggcacgatcttggctcactgcaacctccgcctctgtgttcaagcaattatccctgcctcagcctcctgagtagctggaattacaggtgcccgccaccacacccagctaatttttgtattttttagtagagacagggtttcaccatgttggccaggctgatcttgaactcctgacctcaggtgatccacctgcctcgccctcccaaagagctgggattacaggcatgagccaacatgcctagcctatttttacatacttctatacagttgttccagcatcatttcttaaaatgactgtcctttcttcagtgaattacctttgcatccttgtcaaaaatcagttgtttatttacatgtaggcctaattttcttcctttttactaatcaatttgtctgtcttgaggttgccaacccaaggcccatgggccaagaaaagctcacagcctgtctttgtatcatctgttagataagaatgcttttttctatttcttaagggttgtataaaaaaaaaaattaaaggaaatgtgacagaaaacatgtgtactgcaaagcctaaaatatttactgtctgaatcttctcagaaaaagaaaatttctaaacttgacctatcttgacaccaataccacgtcttgattattgtagttttataatctattaaaatcaggtaatgttagtcttccaacttactttttccttttcaaagttgttttggctattcttggccctttgcatttgtgtatgaattttagaatcactttgtaaatgtaaatttcttcaaaaagacctgctgggatttttattcatattgtattgaatctatagaccaatttcaaaaaattgatatcttagcagtattgagtcttttaactcataaacaaggtgtgtttctttatttctttagattttctttaacttctctcagaaaagttctgcagtggccgggcacaatggctcacgcctgtaatcctagcactttgggaggctgaggcaggtggatcacctgaggtcaggagttcaagaccagcctggccaacatgctgaaacccagcctctactaaaatacaaaaattagctggctataatggcgggtgcctgtaatcccagctacttgggaggctgagacgggagaattgcttgaacctgggaaacgatggttgcagtgagctgagatcgcgccactggactccagcctgggcagctgagtgagactccatctcaaaaaaaaaaaaaaaaaaaagttttgtagttttcaggttacaaatatttcacaacctttgtcagatttatcattatgtatttttgaagctgttgtaaatggcattgttttataaattttaatttctaattattccttgctgcaatgtaaatgtacagttaacttttgtatatttatcatatattctgtaatattggtaaactcacttattagtgttaatggctctttttaaaatttatttgtattgtatatatagttgataatgtcaaagaagagtaaatataattttccttttttttttttaatctggatgctttcatttcttttcttatattattgcactggctgcaatctctagtataatgttgaatggaagtggtgagagtgtacatgcgttttcattttaactcatattatggggaagcatttggtgatcttccattatttatgatgttagctgtaggttttctgcacatacctttatcagtttaaagaagtccctttctatttcacatttgctgaaagttttaatcaggaatggatgttggttttgtatcaaatgctatttattaatccattgaaatactcatttttttattttttagtttaatatggcaaatttaactgattttcaaattttttttataaaaacatgatatatttttataaaagtatattaaaaattattcgtatatatatagttgaacttaattagcctgtcattttctttttcttttttttttttttgagacagagtctcactcttgtagcccagtctggagtgcaatggcgtgatctcggctcactgcaacctccacctcccaggttcaaacaattctcctgccttagcctcctgagtagctgggattacaggtgcccaccaccacgcctggctaattttttgtgtttttagtagagatggggttttaccatgttagccaggatgctctcgatctcctgatcttgtgatctacccacctcggcctcccaaagtgctgggcttacaggtgtgagtccctgcgcacagcctattctgtcattttctttcattgtctttggtttctatatcaggataattctgacattatagaatatattgggaagtattcccttctctccaattttctgaagcagtttgtatagaatttatattattgtttccttaaatgtttggtaggatttatcagcgaagcccttgggcctggagttttctttataggaaattttaaactccaaattcaatttgtttaattgacaaagggcttttcaggttttctattttttcttaagtaacatttggtagtttgtatcttttctgagatttattatttctttaatattttgaaaatctgtgctgttgtaacctttcttattcttgatagtgacaattcatgtcttttttttttttttccaggtcagtgtggctagaggtctgtaagttttatcggtcttctcaaagaactaacttttggtttcattcatatttttgtttgtttgtttttgagatggagtcttgctctgtcgcccaggctggagtgcagtggcgtgatctcagatcactgcaagttccacctcctgggttcacaccattctcctgcctcagcctcccaagtagctgggactccaggcacccaccaccacgcctggctaaatttgtttttgtatttttagtagagatggggtttcaccatgttagccaggatcgtctcgatttcctgacctcgtgatcttcccgcctcagcctcccaaagtgctgggattacaggcatgagccaccgtgcctggccacaggtttcattcatattctttattgcctttcagttttctattttatttggtttctactcttatcgttgttatttcctgtattctacttacttttgctctctttttttttttttttagtttcttatgatggaagctgaaggcattgatctgagacccaccttgtttgtttgtttgtttgtttgttttgttttgttttgttttaaagacaaagtcttgctcttgtcccccaggctggcgtgcaatggcgcgatctcggctgactgcaacctccgcctcccaggttcaagcgattctcctgcctcagcctcccaagtagctgagattacaggcgcttaccaccatgcccagctaattttttgtatttttagtagagacggggtttcacaatgttggccaggtgtgagccaccgcgcctgtccgagacccatcttgctttctaatacagtttaatgctatttctccttcaagtattatactattttaggttcatcccacacattttgatatgctgtgttctcatttttatccatatcaaaatactttctaatttttctttaagtttactgagacttgctttgtgactcagactatggtctgtctttgtaaatattccatgtgtgcttgaaaacaatgtatattctgctgtcgttgggctgaatgttctataaatgtcaattatgcataatagtattttttaagtcttatatccttctcgattgtctatttatttgttctttcaattattaagaaaggggcattgaagtctccagctaatatttgttctatcaattattaacaatggagcattgaaatctccaactatagttatagattttttttatttctcctttgagttctatcagtttttgcttcacttattttgaagcttttttattaggacatttaagattgttgtattcttttcatgaattgactactttattattataaaatattctttgttctgaaatatattttgtctgctattgatatagctattgcagctcacttttgatagtgtcttttttcattcctttgcatttaacctatttgtgtccttatatttagagtccattttttttaagagaacttgttttggggtatttaggtctttataattctttttattgtgtctgacaatcttttgcctttttaattgtggatatttagactgtttatatactttcttgatatggttatgtttatatattttatcttattttttcctatgttcctctgtattctttacttacttttccacattttgtgccttttaaaaatcagttgagtatttttaaaggccgggagcagtgtctcacgcctgtaatcccagcactttgggaggccgaggcaggtggatcacttgaggtcaggagttcaaggccaccctgtccaacatggcgaaaccccgtctactaaaaatacaaaaattagctggatgtggtggtaggcgcctgtagtcccagctgcttgggaggctgaggcaggtgaattgcttgagcccaggaggtggaggttgcagtgagccaggatcgtgccattgcactccaagctgggaaagacagagagactgtttcaaaacaaataaataaataaataaataaataaataaataaatttaaaaataataataaaataaaatagaaatcaattatttttaatgattccattttatctcctttcttggcttattagctgtaggtctttgttttttggttttaattgttggttttggggttataccatatcttcaacttataccttcaagtgatatactacccattcatgtataccataagaatcttacaagtgtatacttttgtttcaactctcttgttgtcacacaattctacttttatatatgttctaaagtctatactatattgttattgatatttaattagttaattgttctttgaagaaacttacataatataaattttttttttttcttgagacgaagtcttgctctgtcacccaggctggagtgcagtggcacaatctcagctcactgcaatcttcacctcctgggttcaagcgatacttctgcttcagcctcccgactggctgggactacaggtgcgcaccaccatgcccagctaaattttgtatttttagtagagatgggatttcaccatattggccaggctgctagctgtgctacaatttctggtgctcttcattcttctttacatagatgcatttctatgtaataccatttgccctcttcctaaaggttatcctttaagatttctgtctttttttttttttttgaggcggagtctcggtcacccagactggagtgtagtggcatgatctcagctcactgccgccttcgcctcttgggttcaagcaattcttctgcctcagcctcctgagcagctgggactacagatgtgcaccaccatgcccggctaatttttgtatttttagtagagatggggtttcaccatgttggccaggctggtctggaactcctgacctcaagtaatctgcccacctctgcctcccaaagtgctggggattacaggcatgaactgccacacctggcctaacgtttcttgaagtacaggcctactggtgattaattctttcagcttttgtatatctgaaaacatcttcattttactttaatttttaaaagacatgttagttgtgcatagaactagcggttgatactttcttttcccttctcccagtactgtaaaaatgtttcacagtctttgcaattgcattttttaagtaagaaaattaggtatcattctaatctttaacctctgtatataacctgtcatttttcccctggatgctcttaagaatttcttttatcactagtattgagcaatttttttatgatctgcattggtgtacttttctttatgtttcttgtgcttagggttctttgagcctttagatttgtggttttatagctttcatcaaatttagaaaatgttttatcctcataggactattctgattctcctcagctagtaatttctttacctaatggacccatttacaaaatacactccaggtcctataaattttttttaataggtcatataaaagttactaccaggaatctgatgtttatagtgacagaatcaagtctcgacacttggaaaagaacattgtctgttttctcttgtaaactctgggattgctgaggttttcaaggaagccaggtactaaaccactctgctgttacagtcactgttcttctttttggctttcctacctcctgagattcttggcagatgaaggataagtgcttcataagcctgaaatggtggcccttctgggtcctgtggtaatcatctgagcacgtacttttcatttctgagttagtacggagattcctgaagttctgtctacatctttccaatgttggatttatacccaacatgtaggaatataaaatttagtgctaagatgataggtgttcactttgttccaatcctgtaatttgctgtggtgacatacaagggaaagagaagagccttaaatatttgcctgctagctatcaagtaggggggattatactcttaatctcatttacattttcttgtagctatagcaaagtttgacaggcaatcgtcatatcccccaaattatattagtgtgccagttacaggtctgtgactcctaagtattatttttaatacttaggagtattttaatactcctaagattatatttaaaaaacataatctcaccagtacatttttattccttcctttttaataaaccagctttgacagatgaaaaggaatctgtgctgtagctcagatttctcatgttaggcatattttagccgtaaacttaattatcgcaggaattttcaaatgactccaactttttctgcacttggtatcagaggataccaagtcctgtttttgagctgataaaatcctccttctgaaagcatttgtttattatattactgcttcacatgagctgagctctatcctgaccccgtgttaagtgtctgtggtagatttcattacatccatatactggaagtcctgccaatacactggcagcaaaatcctagtggaaaataaatggcaataaaaaagagaaatgatagcctgtgtgagtggtgaggagcacagctttattgagactggacaaccccagagtagtgacttggcatgcagacatgagcttaagagagtgtgagtgaaagctgatattggaataacgactctgtggcacagacatgggaataatttaattaattgcactgaaatttctttgatgaatagttatgtggtgataagcatgaggtcgaacagcagaatgagtctcagctttttaatgggccagcacagctgcggttttggatgccttcccactttatttctgcctgcagctctccaccgctttattcatccacatctcagctaggagcaccactcgcggggccccctctccatgtcggcagagctgaggggcaagtacatttggccatgggaagcaggctggtgactgctttgaaatgaaaaccagatcaaacgaaaattgtaggatggtgtccttatgatgcctgcacctcccctcctccccaaatctctaggatgcttttacagagtctttgctgctacgttgtataaagattttaataaaaatttcttgtccctggagaaacaggcatgtctttgttgtcagagagctagagggaaatgagcaatgcagcccagctggagtaccagcattaatcccatgattcgtagcccgtattttcagacagatcaattacttatggctgtaaccaatctctcatcgttttcttgctgtgcagggctccatttccagactcggcagctgacataaccttccaacttgataggacttcagctgcaaatctcttcaggtctgctgcctccattcatcgtggttatacaaatgagttgttaaataaaaatcaaaagtaaaaaattatgggtggtaatctctgcctggctcagtaatacccatgggcctaggcaacattttcagttggatttttaaaaaacaagatggatgattcacttgtctgacttccttcacttttatggacaggctttgcatgagagaaaagccatctctagagggaagaaattatccacagtggatacatttcttatcaatttataagttgaaagattaacttagaagtggagagaaaggagattatgaggagacacgaaggacatgtacaggtgagctgtgtctaatgcatttcacactgagtgagtcaccccttttcagctgctaggctgcctgggcttaaggccaggagattctgtatcaaaaagaaatgacccttgctaacacagaggtgtcatggaacatgtaagctgtttatagagtatgtcactgtgtgaatgtagaacttgtgtgaaggatctaaacccaataacctttgaagaatttacccagaatttatttagtgttttcaagttataactactccttgtgtgtattgaacccttcacagctatgtcaggccagctaagccttcctggaagaggtacttaggggccagataaagcaaattggagaatctctttgtgatttgactcactttagatgcacagatgctcatctgttaggaaagcatgtattgactctctttgtgcccttttctttcattgtcactccatcatttccatctcttcaatgaatagtcctttgaggactttcccattttccctataataaccaactacgaaaatttgcaggaagcaaaaaggaaaatgtggacatctagagaatataaatggttttatgtttaatctagggggaattatgtatgtatttatatatatttgtgtatgcgccctgcatgcttgttgcattttgctgtatgctttagaaacctttgcctacatggaacccattagtagtgtcctgggacaggtattcatgaactctgttaacaattaaggaagtaagttcctgctgctacaggctgacagccacagtttccccttgggcttgtatggctttggattgattctaaagaagcaaaggaaacatacagaacatacttgtttgatttgaaagttaaaaaccggtctgtgtctgttttcttctcccttttcactctagcccttcttaggcatcccaatgcgagtagtaaaacataaatcatgcaatatcataagatactgctacagctcttgccctgccctggatttgtttttttgtgcatctgaattttattatgatccataaagcagtatggaaatggctcattggtagggttgcatggcagtaccccatcctcagaccctgccaacaattgaaagtctgagaggtaataagaaataaaagggagatgagatttatagttcgtgagttcaagttgcttttttttctccgtggaatgttgcctgtcttattaggagttctttagtgaaacaaaatgcagtggtagcttagagaaattatggatactttccaggggtgtgggagaagcttaggagtctgtaagccttctcccctggttgcagttaggaagccagttgacagtataataggcttttggaagtgggtgcaatggtttgtgtgttctgtttgatgttgcaaataccaagcccgcagggagatctgcaaagaggatattctgttcttaaagaaaggaaaagattaacctgaaacgtgaactgaaaaactcctgaattctagaggacttaggtgcagccaaggaaggatctcatttacttacgtggaaacatcatttggcaagctgcctgctccagacaagcagatattttttaatgatttcaattaatgaaaagcaatcactaataaacttgagaggattggatcacatattaagagtgtgtgtgtgtgtgtgcgtgcgtgcgctcacgtgtgcgtgtgcagtatttgcatggttaaggtttggaaatacgtgcattctcatacacgcatagaagtcttacaactacgtgtactacttggagcctgcctgatggtccttttcttcacattcagaatcatgcttctgacccattaggagaggctaactcttgttattttggagacattttcaggagtggtaatgaatgggcattaaggcacttctgttattcatgaatatgtacattcacttaacatatttattgagtacctactgtatgccaggtattatgctaggtgctgaggttatagcagtaaaaaaataaaaagatacatagtctctgctctactttagtttataggttattggagagacagacaagaacaaataataatacagttatacacttaaaatttttatattgcctttgtattcaataaaaatttgttgagggcttctagatgctgtagactctgtgatagagtctaaagaaaagcgtcttgcctaatttctgttaaaatcagtggtttgccatttacgaggaataaactggccatgtttagttatggtattgaagaaagggtttgatccatacaggaactatacttcacctctatgtattaatttagtacacagttttaagaacagcaaggtagcattcaagaagagcattctgttatatacttgtatataaaccctattgtatctactaaggatattgttataacttcctcttcactggtatctcctcaactctgagttcaagacctacccttctctccagctgtgggaaatgggatttgtcaacctctctgagacaaagtttcacatcagcaaaatgggaatagttgtactagttcacacggggttgtaaagagtgaatggaattgtgtatttgaaaacacttcattaaagggatggatatttcaagtacactgatttaatttttacaaataatatgaatgtattagatcatcacatgtaccctgaaactatgcatatcaattatgcatgaataaaaaaattgttgaaaaagccggtcgcagtggctcacgtctgtaatcccagcactttgggaggctgaggtgggtggagcgcctaaggtcaggagttggagaccagcctcgccaacatagtgaaaccccatctctactaaaaatacaaaaaattagctgggcatggtggcgggcgcctgtaatcccagctaactagggaggctgaggtaggagaatcgcttgaacctgggaagtggagtttgtggtgagccgagatcgcgccattgcactccagcctgggcaacaagagtgaaactccatcttaaaaaaaaaaaaaaaaagaaaaaaaaagaaaaagaaaatactgtgtaaaggactatactcatttgagtttgtataattttcattattattacatcagatttacagagagaataaaatttattgaagccaactgtgttgtcttaaacctccgaaaattcagaaggaggataatgctgagttcaagtacgatatagaaatcatcatatcttttctctagcaagtgttccaagagaattagaatataatgccaaaattaaggtagaaattaagttattctagaagtgggatagccagtgtcagcatgcatgcatgatccttgaaaagtgatattgggcagcatttacaccaagctttgctatcttacgttctctttttgcttcttctacctggtgttatttgtgccttccctaaagggctgaaattgaaaagaattagtacgaatgcattttcaatgacaccttggccaagaggttcatgcatttcagctttggacaaggtgctatggttcaaatactcatgaatatgatataagaacagtcattatttaaatgatgaacctttatatgagattacactgggtgttactaatctgcaagttgtattttctgtggggaaaaatcagtatgaatgaatcaagaactcagtgtgcatcctgcagtgcatgttgtatttgcatgaacggagatgtaatctcttcaccttttgaatcattttgtttaaaggccctatatagatcattctgctcttactggtgggtgacattttcttaaggttctctccctagatagactaatttgaaaaaaatgcatccctcttgatgtctgcatgtgcatgtgtgtatgcatatgtataaaatatagaggtgatcacaaagcatactgggccacttagcacttccactaattccacattatcagagattgtttggagagcatatttcattctccctactttgtcacttatttctaacactgagtatatctgtacagttcttaatagtaaatggcataatatcttattctctgtattctatacattgtcaaccccattcctagctgataatcagtagtcaaaaatgggtgaataatttgaatggtacttgtctttaattgtgattcatgtctgaatggcttgctggtaactaggagctaaatttaatgttaatccaaggtcacactctagtccacatactggaagctcagcctcttgacatgcatgcttcatgcaattatcaggctgctcccttgtaggataaagtgcggcagtctagaaagcatggcactcaaatgggaagaactgttggtgagtctgtacagaacagatgaggttgcagatatttgaaagcatttgctaatggaaactctgggtaaggcagcatcttaaataatacgtagaatcagcatgctgtctccaaaacacatttgcagcatttattagctgggtgtgagctaaaggtaagctcccattaaaagaaaaaaaaatcttcgtaatgattagcaggggcccagtataatttaaggtattctttggagtttataaatatggcctcataaaaagcctgaatataagagaactgtgactttaagtcattagaagcccagtggtttgataaaataacaggaaacagacaatttattatgagcagtctcagtagctctggattatctataaaacttttacggccttccccaagtggcaagaagccataaaacttgcctgaatgagggacttgttaatttacttgttaaagcaaattaaaaatttataagtgcttttaggtaaatgagatcttctctcattgctgcccttgcggggctgggagtcctaggaggggagagtggatatgcttagacaccactgcagaacaataaaagctattaaatttttccagtttattacagcagagccatgcagctgttgccatggctagctgtggggtaccggtggttgacagcctggagtctcactcaaagggggaaaaaataaaaagccaaggaaagggatgattttttacttttataattctccaattgttgatgttgtagaccatgtctttttatttttccttgaccttgtaaatccagaagttttaaacttttttcttttctttttttttttttgagacagagttttgctcttgttgcccaggctggagtgcaatgtcacaatctcggctcactgcaacctccgcctcttgggttcaagcaattctcctgcctcagcctcccgagtagctgggattacaagcgtgcgccatcacgcccagctaattttttatttttagtagagatggggtttctccatgttggtcaggctggtctcaaactcccaacctcaggtgatccgcccacctcgacctcccaaagtgctgggattataggcgtgagccactgtgcctggccttatactgttttttcttatccccagaagtgtttctgtttattttgtcatacattgttggtccttgaaaattcctgcccgtcatgattccttttagtcatttagtccatggacaaaggccaggtcttaggctgtttttgttaacctcaacatttcttgaaaaaaacctctttctctctcttttcctttcccatatctagccacaaaactaggagaaggaagaaagggaatctggtacatgttcttgtgtatttaactccaaaaactgttagaatcaatattttttgtggaagccaaagtttataggtaaaggcagattttcttgcactctcccttggatgaaatgtcagcgtaggttaaaattcttggatcttagcatcttccttaacttagggctgttctctacgtgttgaatttcttctgtaataataggtttctgaatggtgactttggctggtgggggtcatttttttggctttaagccctgtgactcaggggattttttttttttttggctcccttaaatacaattcacaatgagcagttttctccctgccctagtgacagtaaggtttctgggacataggaaatagcttattcttccactcagatcagaagttttgattgagctctgtggcatttttaaggcagaaaaagacacgttatgcctcaactacctaccctatttaatgttaaattaaaatgatggttatttttaaagtgtgtttacatttaaaaattcctccagaaaagtcaagttctgcaaacattttcttgtagtatttccagtcactgcacaagaaaggtacattttattagttttaagaacagaaatagtagaaagacataattggtacaagtgtttgttcttctacagtatttactcttcagtttttacatatatatccatacctctgatttgtagtttgtttggaattatgtttagaaaagcatattgttggcaagtaaagcatcacaaaattaagggtagagaacagcagtaaaaaaaaaatgacaaatatgtatttttagactgtattccagttttaggaggtatcagcttttagagattccttaacgttaaaatttgtttcagtaagtaactcttgttgtggtcgctgtcttcagtattccagaaataatgctgtatctcttattcaacttcatgaacctctttactggcttccatattaatgtcatttgcatttagagtgtgtcatcttcatttagaatctcagcaaaaattctggtttataaccatctttgcacaaattatctctgtgctttaggacacttttctgggcctggtcttgcattttttatgaatacaactttaagagtggaacttaaatatgtccccttttattggattatccccatagacctgaccacaaagtctgtggaagtagaaagctataacggttgtaccatttttttttttttaaatactttaagttctagagtacatgtgcacaacatgcaagtttgttacataggtatacctgtgtcatgttggtttgttgcacccatcacctcatcatttacattaggtatttctcctaacgctatccctcccccagccccccaccccacaataggccctggtgtgtgatgttcccctccctgtgtccatgcgttctcattggttgtaccattcttttgttcaagagtatcaagttgaatttcatgtactgaaaaagtagatagatttaaaaacatttaaatttaggtagcaaatgacattgggccaaaggtccattgctaaggagacccaggaaagaatttattacaataggaatatgaggtgtggaacccaaggacagctgtcatgaaggataggtaatcacagtaaagtagtgatgcttcatatacatttgtttttgtttttgtttttttgagacagagtctccttctatcccccaggctggagtgcagtggcatgatctcggctcactgcaacctccgcctcctgggttcaagcgattctcctgcctctgcctcccgagtagctgggactataggcgcacaccaccacacctggctaatttttgtatttttagtagagacggggtttcaccatgttggccaggctggtctcgaactcctgacgccaggtgatctgccagcctcggcctcccaaagtgctgggattacaggcgtgagccacttcgcctggcatatatttggttttaagagttcaagctagaattttagagtagatgttcactcattagtaatattgatatatgttgtataatgattgcttaattgctaattttcttatgctaattgatgtttttctataaaaccaaattcttcagctctttacatttattgaatgctatctggcttatgaattttcataagaactgccaaaaaaaaaaagaaaaaaaggggcaggtcccctccttccttctaaaaagagtggttcatgcctgtaatcccagcattttgggaggctgaggtgggcagatcacttgagatcaggagttaaagaccagcctgaacaaaacagtgaaacaccgtctttactaaaaatacaaaaattagccgggcatggtggtgcatgcttgtaatcccagctacttgggaggctgaggcacaagaattgcttgaacctgggaggcagaggttgcagtgagctgaggttgtgctactgcactccagcctgggtgacagagtgagacctatctcaaaaaacaaaaaacaaaaattaaagaaataaaaataaaaaggtagagagtatgtctataatgactttttaatgtgtcagggagtttttaataggaaaaaaaaatcattccactaaaaatatgtcctctgtctcccaactagaatttcttccccatgtcactgccagccattgctgtgacaatatagtctcttactcttttatcaaatattctccatattattgctgtaagtactggacagatatcataagtaaaatatgtccacctggttgctaagaaaaatcccacatttattttatatattttgtaatagctttacgtattcgttcaaccgtaacattttggtttaaagacttcattaagctttcattgtccaatagcaaagaagtatgaagtagataccccttactttgcagtgtttactttttttttttttttttttttgagacagagtctcgcactttcgcccaggctggagtgcagtggcgtgatctcggctcaccgcaagctctggctcccgggttcacaccattctcctgcctcagcctcccgagtagctgggactacaggcgcctgccaccacgcccagctaattttttgtatttttagtagagacggggtttcaccgtgttagccaggatattcttgatctcctgacctcgtgatctgcttgcctcagcctcccaaagagctgggattacaggtgtgagccaccacacccagcctgcagtgtttactttttatttattttttattttttggtgatttccttttaccattagctaccagctgtcaggtattttcatatagttttggcattatagtttctttggttagatcacacacacacacacacacgtacgtatatgtattgtaggtataagcactggaatttagcagagctttttaaataaatgggctagtctacatgcctttctattcttttccttctaataatcttatactaataagattatagttacaagtcagacagcaatttcatggcacctgtagattttgagtaagaaataaaactaacttcagttgattatagttttttttccatcattaatttaatccaaatttctttaagatggctaaggtaaatgaaattatattctcaattgcttgtctggtctaatatgaccaaaaaaaactgttagagactgctttaattatttgaagtgtttgaagaaatttgagagagtattgtagaatttattcttatattaatgcaattaatatattaagattcaaccacatcaaattatgtattagtcatccagaattgagagacatggttgtaaaaatatcattaaggtgtgtggtatttacttaaaatttattcctttagagataccagaataattatttatatctgtttgctaattgcttactctaaatgtttggtcagtaaatcagaaaaatattagagctatccaaaggaacaaacacactgcaatgtgttataacatgcctccattgcccataaattattaatacaatgttactctggaggggtagcataatgttttggaaataatgcacactccagaataaaaaggcctgaatgtgaattctaggcccatctcttcctttctgtttaatcccaggttaacctgagcctccacttacttaactctaaattagtaataattatatctgcctcacaggttctgagaggaacctgtagctcagtacagcaaatagtaggcactacctcaagggcagtaaatagaatattcagtcagggatccacgttctaggctcagcttaccacccaatccctgggtgtcttggtggagttgttcatctctctatattttagtttctttgtaaaggggatacattaaaatttacttttctcactttaaatatttacgtgaggattaaatcatttatgtacaattattagaaaattgtataacagtaggctgggtgcagtggctcacgcctgtaatcccagaactttgggaggctgaggtgggtagatcacgaggtcaggagttctagaccagcctggccaacatggtgaaacccctatctctactaaagatacaaaaaaaaattagccgggcatggtggcgtgcacctgtaagccaagctagttgggaggctgaggcaggagaatcgcttgaacctgggaggtggaggttgcagtgagccaagatcatgccattgcactccagcctgggcaacagagtgagactccatctcaaaaaaaaaaaataaatgaaaataaaaataaaatagtgtaagagtagacaaatgtgtacaacattattatcacaaaaatgaaagcagcttaatggtaattgatcatcctgtttttaagctactagatcagagaatgtgatgtgcccacttgtcctttactgtccttatgatagttgtctttccatgttggcacaatggtagaagctgctgtccaggctattttgggcaatttgagtcaaaaattagcagttattcaatatatacaccttttttttttttttaccagcagctcaatgagggtttctattatatatcaaggggctaatgtggcataagttgttttttcttttttttttgggaaaaatcctaactagaaaattgggtctgttcttaaattgtaaatgtgtgtacatcaaagccattgtaaggataaatttaagtctgatagtgtacatgtgtacatagtttcagtacacattggcgaaatatcctgctgattgctgattgaaaacagttgttaattctctacttcactaaattcagagtggaaaactttccttaatgaagaacagattgaggagatccaagaccttactgtgtgggaattaatggcagatgcatatactggtagttaaaatgtttcattagatgttaatgtcttgctgtgtttttaattgttcaggaattagcctctagaatattaaaaccatctgtttgttatgatgaaacagaatgcttaaatagttattaatttgtgtttcttgtctttttttgagggataatctgtaaaactttgatctgtttggagtttagggaatttggaatgtggaagtgaaaaataattttaaagcacaccagtgtcctgaatagctgaagtatgtctttttttttctccttacccactgcatatattttgtgttctttctctcttttttcttaaaggagggtgagttgactttttttattccatggtgtgatgagaatctattaaacagagctggtttaatagttgatttaaactttaagattatcttcgtgcatgtggattattttacattcaacatcaaaacagaatttagacatttagaggaatgaaggacagcttacgtttttaactctaaggatgtacttttactactatattccactagctctgcataactgttgatggctatacagactactgctggcatgggttctagtcttgactctgctgtttcatgccttgtgatctggcacagattagtctttctcagctttagtttatttgtctgtaaattgggaagtacaatttaatttatagcattttttttaatgcttagaagtaatacatgaagactgcatatttgtcttttgttttgtttttatagagatggggtcttactctgtcacccaggctggagtgcagtggccaatcatagctcactgcagcctcgaactcctgggctcgggcaatcctcgtgcctcagtctcctgagtaactgggactacaggcatatgccacaatgcctggcagtatttaaattttttttagtgattgagtcttgctatgtttcccacgctgatcttgaacttgtccctcaagtgatcttccagcttcagcgtcccaaagtgctgagattacaggcataagcacatacccggacccacatttgttttatgtagtgggcatattaattgctgtctttcttgattacatggagccagtgagatactttggatgccactgagaatatacattagcactgtagctgcaagagccagaaataaactcttcatttactggcctctcccctgtgttgatagccaaacagtggtgcatttaagttcttacccccaaaatgaaaatctcagctaatgtcatcttggctctagttaattgccaggtgtgtagagctacagtggagagaacaaatctacctgtgcatgagatcccaatttatgtctctgggggccctagtatttgtctttttgtctgtgagtttggctaagaaaaattttcagcttctcataaatttatattaatcagtaaaatcatgccaagaattagaagttttatatagttgaatctttctgcatcttggagaaattccatgtgtttagaccaaaaatgaatgatagttgggaaattcatggttctctttacgtttcctttacctcacttgcccctcaatcaaaactgaattatctcatttcctaagtctgttttgcgcaggttaaaaatgggagggtctttatacatcttctggagctgagtgaaagtcacttgctacatgaaagtgaagtttgttgtaaaccttgagtctctaattcaggttcctcagaggccaggctcataatgtgaataagtgacacaggacaatgtagggtgtggggtcgtccttgtcatggtgctccattgaccctttataactatagcattagtgcagttagtgctcttgtttccaggggcacacccccttgctaactggactatgctggcactggacgtcatatgaatgattcattcagtattaaaagaagaatcaggccaggtgtggtggtgcaagcctgtaatcccagcattttgggaggcccaggtggaaggatcatttgagcccaggaattcgagaccagccttggtaacgtggcaaaatcttgtctctcaaaaaaatgtagaaattagccgggcatggtagtatacacttgtagtcccagctactggggagactgaggtgggaggatcactttagcccaggagttcaaggctgcagtggggtgtgatcgtaccactgcactccaggctgagcaataaagtaagaccctgtcttataccatctccatagaaagcaccatcttaaaaatttacccaggatttcttttataaaggttgttgttgttatttttattattaagaaatcagtgattgttagtacacattttaaaagctttctgtcattgcaggatatgtcagaaaaaagtttttgctgtagtgatctttaacaacataagaaaaggagtggttttttttttatacttgttaggtaaaataaataggatttttaaatgcttcatattatccaaattacataaaagtggcaatctcgtcagtaagtatgtataatactaagagagctattaacttttcttggtagtggtttttgaccttttgctgaacaagtactttaaaaattttcaaatgccaggatgaagacttcttaaactaactgtaattatgcaactttttctttataatccgatacctcactatctaaaatatctgaaattacatatgatcactgtttcaagaacaaaatcagtgatagcacattttgaagactatggaatctaaaggctgattttgtatgctcactagcacacatgatacttttcatgttaccattcagcttttgagctctccttactggccaatcccagatgagaagctttttttttttttttttttttttctttgagactgagtctagctctttcgccaggctggagttcagtagcgtgatctcggttcactgcaacctccgtctcccaggttcaggcaattctcctgcctcagcctcccgagtagctgggattacaggcacgccccaccatgcccagctaatttttgtatttttagtagagatggggtttcaccttattggccaggatggtctcaatctcctgacctcgtgatccgcccatctcggcctcccaaagtgctgggattacaggcgtgagccaccatgcctggcctcacaattaagtttataacagggatatgttatgaacttaatatgcttggctattaatatttggatatgttctcaaatattctagaacataggccagatgtggtggctcatgcctgtaatcccagcactttgggaggccgaggcaggcagatcacgaggtcaggagatagagaccatcctggccaacaaggtgaaaccccgtctctactaaaaatacaaaaattcgctgggcatggtgggcgtgcctgtaatcccagctaccccggaggctgaggcaggagaatggcgtgaacccagtaggcggagcttgcagtgagctgagattatgccactgcactccagcctgggcgacagagcgagactctgtctcaaaaaaaaaaaaaaagtttaactctagtgtgtggtataccagttcagttctgtcctcatggaagtaatatggcctttcatgggatagtcactaatgataagtttagtgacatatagtttattaagatagctatggacagtgtaggggcttagtcttgatgagattttaatttttggctgcacttgaaatgaactgggatcaaaatagtggcaagttggatagagatttgctgtcagaattaatattcaagaagttctgatagcttgcaaccaaagtattttatattataacaaattctagatgctcataattattcaattaaaatggataaacagtaaatatatgggttagagaagaacaatgctttttccagaaacaaagttttaaaaacttgttaatatggcaattttaaaacatacatgaaagtaaagataacggtataatgaacccaacatcatctaacttcaacaattaagacatggctaatcttacttcctctatatccctacacttcccccttcccaataggtattgctccccctatcccctggattattttataaaataaaactcagactcaagttatctcacccattaatgttttactgtgtatctgtaaaggactctgcttttttactgtaactacaacaaaatgtaaataataattccaggccgggagctgtggctcatgcctgtaatcacagcactttgggaggctgaggtgggtggatcacttgaggtcaggagttccagaccagcctggccaacatggcaaaaaaaaaaaaaaaaaaaaaaaaaaaaaaatagccgaggatggtactcaggaggctgaggcatgaaaatcacttgaacctgcctcggcttccgaaagtgctgggattgtgagccaccatgcccggcccaaattgttccatttttggtcagtgggaaccccttcagtttggctcccaagcccctttgtcagggtcttgctaggatgacaaggtgttccagactcatcttacatatttcctttctcagaccttcagttggacacttttagttttttcgtgttagaatgggaaaaacaaaagatagaagacattttctatttgagagtggtggctattttaatgaatgacaggccatttaaaaagttattgaaacatgttttttaaaaacagaaaatcataaaaagtaagttttgtgtgtttattttttatattcatccttgaaaaccaaataatattgtctctaaattactttttaataatcaaaatcttattttaagaaagctgaaaactgtactaaagcaatcaaatattccttcaacacattattttttacattgtgtatgtgtattgtgtgtgaatttctgagcctatttgaaaacagatttatcatttagtccatggttatactcaaggaatgccaaatgcaatctgttcattctggcctttctctttaattcttgtacatcttttgtacatttctattcttgtacatctttttttctctattgtttagactttttggtcaaaaatttaaaaattttctgattggcagttggttgaaagagataatttattatctaaagatctggaatcaatagacaggaatgtctggcttactacgataaagggttatggagaccaacgttttatcatgcagataaagcctccaggtatcaggcttcagagagaataaattgtaaatgtttctcatcagacttagagagtctgctctattagtaattctgaaagggaggaggttattatggggcatgtccggtccctgtcccccatcatggcttgaatccgtccctcaggttagccttagaatgcccttgctgagaggaagagtccattcagatggtgagggggccttagaattacattttacagcataattaaacctaggaatagtatccaagttgtagatagatatgtgagttatacatcaaacactgccttttacacttccattttcttgccttcacattattaaattatgaagaaatagtatcgtaatatcctcttggcctaatcatagagagtagagttaacaattctcttgataagcagtagaacattgttaagttctgctgtctggattgagcgtgtctatagtaatgatgtcaaagtcggtcagttcgctcttgattttcttaactgcttcttatttatgtttgagactatatagttagattgatcttggcttattttcctttttaaattttattagggctgggcgcagtggctcacgccagtaatcccaacactttgggaggccgatgtggctggataatctgagatcaggagtttgagaccagcctggccaacatggtgaaaccctgtctttactaaaaatacagaaatcagccaggcgtggtggtgggcacctgtaatctcagctactcgggaggccaaggcaggagaatcgcttgaacccgggaggcagaggttgcagtgagccgagatcgcgccattggactccagcttgggcaccaagagtgaaactccatctcaaaaaataaataaataaacaaataaataaataaattattaacttagtttttctactgctatgaagtccactgaacccctttaaataatgtgcatgtttggcagctggaagcacttcagtcgtttttattttctaagctaatagcacaattttaagtcatttcctgtctaataatgcctaaagtgtttattgggatcatcattaacacaggtaaataactttccaaagtccaaacatatccaaaaatcctgtttcttactttgcattaatgaaacttgtctaattgcattagagtgactttacgatacatgaatttcaagggaatacctaactttctttctttctttttttttttttttttttttttttgagagtctcgctctgtcgccccagtcgcccaggctggagcgcagtggcgcgatctcagctcactgcaagctccgcctcccgggttcaggccattctcctgcctcagccccacctcgagtagctgggactacaggtgcccaccaccatgcccagcaattttttttttttgtatttttagtagagacggggtttcaccgtgttagccaggatggtcttgatctcctgacctcatgatccgcccgcctcggcctcccaaagtactgggattataggcatgagccaccgcgcccagccctaactttcttatttaaaatccaccatggtaagcagagttccaagatgaccctaaaagtacttgtcccttatttactcccatgttttcttatatagcacagttgactttatgaaaggaagttcttctgtaagcctgacctaatcaagtgaactattaacaggatgctgactttctggagtaagaaattaaactgatgggatctttcctttctataataaactgcttttttagaatataagttagataccataaaattcactcattgtaagggtacaagctaattaattttagtaaacttaaagagttatgcaatcatcaccatacaacattgccatcacctcagaaatttcccttgtgaccatttgcaaattggtagaatcttaaattcttgtgaaaaatcctgttagaacttggtgggctatactttaatatattattaaatttaatttgctgtgtttcttcagatttttgcagctttttaaattaggaaggtcatcctgtagtttcattttttgttttgtcaccagattttggcacaagttagctttccatattttttcatgttctggaacaaatgttgttaaatcttcttaaaaactttagactgcttaattatggttttgaaagtatcactgtagaatgtttacttctgtatttagaaatttatctgttttttattttgcttgccatctcttttatacttaaatgtgttagaggtgtatctcatatctttatgggttccccccagattatactatagtttactaactgtacaatattttaatttctaatgatgttcttctcatttttagaattctcttcctctgattttacctatacttgcctttttgtcttatttcttttttgttcatttcaatctttataattaggccatttatttctattctttcacatttaatagaaaatacattaagtccatgagttaacttctagcaaagattttacaacataagttttaaaatttatatatttataattttcattttcttaatttttaaatgttgtatgtgtgattttgtcttttacccagttgttaattgtagacagactttaaaaaaattctttaggtgatatggatattcaacataaaatactgttattactttttatcatagagaagtctgttcatataatttttacattttgaaatttattcttatattctttgttaccctggtacattttcagttggtggtaatgtcccatagatcctctaggtgtgtctctttaagttacccaatttactgtatattaactaagtcaaacttcattttttaacctctgcgtcctttttcattgttttgttttcttgttccttgattagtagaatgctaaaggctcccaccttcttttgctttcttttattatttagaatattttttactttgtatagttttgtataatggtttataacttagaagggtataaaaggtaaagactgtacctttcatcactataaaatgactttgacaggtgatttttttacctatttatttctaaccttttgtctttttccctctctctttttttaaatttaggagttctttgtaactaataaataatgggacatcaatctgttgattgatctgtatatctatccatctctctgtcttacccaacacaaaccagatttttatttttaaatgggagcttaatgtatttatattattatcagaacactttgttttacactttgctttcttgccacttttcttattttctttccctttctctattatgatttgagtcattttatatttggtaattatttggaaggcaaatatttttaacgtttaaattttactaatggttagcttcaagattatcaaattgttatttaaaacactttctctagctgttgtagatgataacaaaagaacctttgattctgtgatcccagaaaaattccttgccctgcccttgtgtccaaaatttgttaaaataattttagcttttattcacaacttggcactgtacacttaaagatacaatatagttttcttttttaaaaaatagtttttctatccaactttataattttacttattgtagttattttgtgtttgcttatttcgattcatcagcatttttcattaagttttttagtttggttcatgtacctgtcatctgaaatacgctttaaaacttaaagaataaaatagtacaaattctatccaatccatgatactttcccaatttggggacaattttatcttgaaaaataaaaatagtatttttcaagattaaatacttggctgctttgatggtagtgtagtctatgggtatattaaaattttcttgaaaaaggagaatcttttgagcttactgaaacattccccaaattttgcatagagttcatttacattcctacagaaaaactcagcagtctgaaaaaggatatgtgctactttgaggaatcaaatttgtggaaggagattccatttggacagtcttctacattgcctgcataattcgcatcattcctctcaaattccaggcatagatatattctccacataatttatccttctgtaaattttgtttgatggattaatgacacctactgggcaagtagcatctttttgaaactctccatatccaagctgaaaagaatgggatagcccagctcacaaatgccaagcagatgtgcacagaattgctataccttcatgcagtctagggtgatgggacttcgttacatgttcattagcagtgacataactgtggatcgttattttcctaattagccattaataacagttaacactgtaatgggatcacaatttcagaatttggagcatatattgttgacagtgaaatctaatgaaaaacaaactagcttcttatattttataaaagatgttaatctcattgatagaattactgccactcatgccagataccagctggctttcattttgcatattttgttctcattctggtgcccaaactattgaatatataatactctaatgggaagaagcttctcacaacagagagtgggttatagtaatttttaaataaacaaggtcctgaagtatgtaaaggctgatggtaagaaatcttactgtatcagttataggaaaagctttcttgtaatagctgccatggatgctcatacaaatcaatgcaagcagatcaatttttcttagctctttaaatgtttaagccagcatctggcctttgtgatgtttcttggttgtaggtaatagctgggaatttcaggtgaaggattacaacttctgagttagttatgctaccccaaacgatccattggatgtggctaaaatgctagtttgaaactatattcagctgggcgtggtgactcacacctgtaatcccagcactttgggaggccgaggtgggcagatcacctgaggttgggggtttgaaaccaacctgaccaacatggagaaaccccatctgtactaaaaatacaaaatcagctgggcgtggtggcacatgcctgtcatgcctgtaatcccagctactcaggaggctgaggcaggagaatcgcttgaaccggggaggcggaggttgcggtgagcagagatggcaccattgcactccagcctgggcaacaagagcaaaactccgtctcagaaaaaaaaaaaagaaagaaaatatattcatgggattggaaatgaatacttctttgcctgaaatcttgtggtttagctttagtacttactgtagtcagttcatttctttgaaatattgagctgtctgacagcttaaaatcctaagtttcctttaaacttgagcctggctttggaggagaagggggtggtgtaggggtggattttatgtaaggctctctgaagagaattcactgaagtgttttttgctggcagggcactgggaaggctagcaggctgcttcctctcagtccttcttgggttttgcccttagcctagatcaacatttagtcagataatttacgtcaggtccactgaagtctgtttttgtgccttggtaaagtcatcattttccttccgtgaagaagcatggaaaaggcccaggtgcaatgtccaggttttgttaagccagttggatattaggaaaagccttgacactctttatagtcttagttcccagctggatatgtatctctcatctaagttgggaactgagtttttattattagttttttaaatagagacggggtcttgttatgttttctgggctggtctcgaactcctgggctcaggtgatccccccgcttcagcctcccacagtgctgggattataggcatgagccactgtgctcagccataaaggtgttgatcaaatatcacctaacaagattattttctttgtgaacgtactatagtcaggtaccacatacaaatttagaacatattatgtggagagtactaatatgctgcagaatcattacttcatgtcaaatgtaaacatctaactgtgcactgagaattagttttttcatccataccttggaggtagttctacctgcccttacttaactcagaatcagtgggataagagtttgatactgcttatgaattggagggcccatgccacatgcaaactttattatcagtataactatgttataacaataggctttttgagcttgaaaaatgtgtcataatttaaaaaataaataatagaaagaaagagctcttcaaagaccataacagaggaggtaagatctgagctttaaaaaacatcttgacatcagaagcacagagaaggtaagggtgaacattccagagggaatatggtgtgaaaaaaatgcagagcaggaatggacaagaaacgttcagggaatggagacaaggcgatgttcattgtagattaaatctctcctttattatcaatataaaagtgaaaaatcgaagagaatgacaatattctgagcttttattccatagtaataacaaaagcctcatacaacttgcatctgaattaacttagaatgaggagctttagcgttgactgaggagaaaactaagtacttaagagctcaggaaggatacaaagtaaaattagcatcaattttctgggctcctttgcagaaggcttcccggagaaagggattttagaagaaagtgataaaggtgaatttctggaaaggatgatagcaaaaaagaatgccttgttttggagacttggggaaagctgactctgtgaatggtataaccaaaagtgaggtctgaactgtagtctttaaagactacaaggaatgttgattcagcctcactctattcatcttggtttcatcttcccctaggcaccatagccacttgaaatcctgcaggcaaaaatttcctacttattgcctcttctattctttgaagtttcctcctgtctagaaaaatggagcttatgtttagtttgagattttccacgttttcattcatgcacccagctctaatgtttcttattgtctccccaaaggaactctgtttcaaatgaaactgctgatcatttcccagcatgttgctttttctgtctttgctttctgcttttctcctcaatggagtatctttcactgtcctctcagccatatgagtttaatctacttttaaaatccaaggcttcagaaatcacttctctgaacctccctggctactttttggtttcattgaacatgtatttccttgtggtgttgtatttgcttatcttttactgcctttttcttgttatattggaaacattgtcaaggggctgtgacttgtaaccagtactacattgcttggtgtttctgaaaatgtgtttggtgatgatattgtagactagtactccatatatttatgacttagtcttatgtagactgatggttttcaattttatgtatttgttcatttttaatggaaaaccagagcttgttaaatgtgtggaaaccactagaacgtaaacttcatgagatgacttttgttttttttttttgtttttttttgtttttttttgtttttttttttggtgtagtaccatatcttcagcacttagttctagcccatatgtggcacttaatacattatttgttgaataagtgctgatttaatttacttaatctgtaggtcttcattggttcttttaaatatgtagtaagaaacctccaggatgttatctcaattaacaagatcattaggtgccatcccagtgtttgaaggataacatcacagcatctcatcattttttcctaggagaagaaaactttattttattttgctctgatttgtttctttttttgagacaagacagaagaaaaaaggtaagaaatcatagttggtgtaatctcactttagtttattcaacatttttggtcttttcattattgaaaaaaaattgcagtggaacagaagaaaaaatttgatggaaagactgctttctaatttatggaccttgaggtttggctttttaggtgtttatttaaggcttgcccactctgttctctacattgacatttcatggtgaatattttgcttattctaccctctgtattttttctatggcagcttgcctggcagtattcagaaactgagaagaatattaaagatcagaaccttaaattgttcactcttttttttttttttgtgagacggagtcttaacgctgtcgcccagtctggagtgcactggtgcaatctcagctcgctgcaacctccgcctcccaggttcaagcgattctcctgcctcagcctcctgagtagctgggattacaggcacatgccaccatgcccagctaatttttgcatttttagtagagacggggtttccacctcgttggtcaggctggtctcaaactcctaacctcgtgatcctcctacctctgcctccgaaagtgctgggattacaggcgtgagccaccgtgcctggctgttcactcttgacaaggatcaaaaacaggaactaagaagcagaccactaactttttccttttttctcttttcttttgcctttagctcaagccaggacagaacagctgcagggacagtgacagtgaaagtgccagtggagaatccaagggcttccaccggagcagctctcgggaaaggctcagtgatgtaagtttaagtaaaaaaaaaaaaaaaaaaaaaattaacgaaaaccactaggccacacacacaccattggttcaagtctgaattacataactttccctcatctttagaactttttgtctacccaagcattgcggttcacattatctttgtatacttatttgagcattgtagttatggtgtcattctaaaatgtcgtttgagcaaaaatgtattttgacaaatcattaggtaggaggaactatttgttaccttagaaacaacaaggccgggcacggtggctcacgcctgtaatcccagcactttgggaggctaaagcaggtggatcacctgaggttggaagtttgagaccagcctgaccagcatggagaaaccctatctctactaaaaatacaaaattagctgggcgtggcagtgcatgcctgtaatcccagctactcgggaagctgagacagaagaatctctgaacccagaaggcagaggttgtggtgagccgatattgtgccactgtactcagcctgggtgacagagcaagaccccatctcaaaataaataaataaattcccgttggatttctggaaggaaaaccttgtgagaatgcgtcatacctcttgagatatctgtttgccctctagatgtgattttcattgttctctagtctgcccaccaacagggcaggttccccctctattacttctgagaaccacctacccctctttggactctcttaccttctttactcatatgtcatatatcagcattttttttttttttttttgagatggagtctcactctgtcgccaggctggaatgcagtggcacgatctcggctcactgcaacctctgcctcccaggttcaagctattctcctgcctcatccttctgagtaggtgggactacgggtgcacgccaccatgcccagctaatttttgtgtttttagtagagacagggtttcaccgtgttggccaggattgtcttgatctctttacctcgtgatctgccttcttcggccttccaaagtgctgggattgtaggtgtgagccaccacgcccagccatatatcagcattcttaactcatctgtacctcaagagcaacacttggaaattcttttgtgaaatggatcaagtaaagagattttttttttttttttgagactgagtcttgctctgtcaccagactggagtgcagtggcctgatctcagctcactgcaaccttcgcctcccgagttcaagcgattctcctgcctcagcctcctgagtagcctggattacaggcgcgtgccaccccgcccagctaatttttgtattttcaatagagatggggtttcaccatattggccaggctggtcttgaactcctgacttcgtgatctgccacctcaacctcccaaagtgctgggattagagctgtgagccacctcgcctggcttaatttttgtatttttagtagagatggggtttctccatgttgaccaggatggtctagcattaacagaataagtgagagagtagcaccatgaaaaaaaagagatagcacttcagagtgtctgagtattaagaataaataaaggatatgtaataagaagcaaaatcttttattttctccattttatttttaaaaaacaccatactctaaagcagtgtgctgttcattatagagtgcaagatgattcattgagttccagaaagaaaatactagtactttttttcttaaaaaaagaaattaaactttactagtattcagtttaacgagcggggaataattgatgtctataatttttaaatacgtggatttaaggagtgtatactcaaaacttttttttactgagagatgtctactaacataaacggttggagaccactctagcacactgagcagttctctatgataataccacatccatctctccatcagccaaggtagacaattccgagatacaatcacatttctgcacctctcatgaaagtttgtgaggtttatgatgagatgttgtatgagatactgtattcttacaggaattaaatggaataaagtataattatttttatgttattttaatatattagttatagataataacctccccttcttctgtgatataatatcaaagttatataaataaagagtactaacagtattttactgtgtgtgtgtttctgtgtgtaagaatatgttttattgtgtgtccatgtgtctgattaattttgtgatggagctatacaaccataaaaccatgacaacttttcttatctaagttgttagcaataataattaatgtttaaatagctgtttttctgagatttttgttatacttttaatgtaagatctcattgactctagaaattattccagggttagtaggtcatatttttttcatagtgtagagaaatgaacgccatgttagtttaggggactagagctgccattggatcttttggcttgtttcctctaactcactttctgttagataaaaagaaattgacaaaagacattccatattcatgaatagaaagacagtattattaagatgtcagtactaccctaagctatttatagattcagtgcaatgtctatcataattccaacaatctttttttgcaaaaatggaaaagcagattctcaaatacatatgaaatggcataaggccttaataaccaacacagtctggaaaaagagcaaagttagaggactcacacttaccaacctcaaaactcactgcaaagctacagttaatcaaaacagtatggtgctggcctaatattagacatacagaccaatggagtagaatggagagcccagaagggagcccatacttatatgcctaaatgagttttaacaagagtgccaagacacttcaatggggaaagaattttctctttaacagatggtgttgagagaactggatttctatgtgcaaaagaatgaaattggactcctacatcgcactatgtacaaaaataaactcaaaatgaatcaatgaccaaaatataaatgtgaacaccataaaactcttagaagaaaatatacaggtaaatcttcatgaccttcaatttggcagtggcttattagatatgacaccaaaagcatgtacaatgaaagagaaaataaattggacttcatcaaaattaaaaacttctcacaccaaagagcattatcaagaaagtaaaaagacagcctacaaaatggggaaaagatttgcaaatcatataagtggtgtttactctacagaatgtgtaaagaactacaactcaataataaaaagataacctaaagcaaaaatgggcaaagaatttgagaaatatttctacaaagaagtacaaagaagaggtacttgaaaaatgctgaaaatcattaggtattagagaaatgcaaattaaaactgtaacgagattatcattttatacctagtaggatggttatgcttttaaaaagagaatgaaaaataagaagtgttggcaaggatgtggaaaagttggaatattcatacattactggtgggaatgtaaaatgacgcagccactgtagaaaacagcttggcagtcctcaaaaagctgaaacatataattaccatatgacccagcaatttcacttttaggtatataccccaaagaatggaaaacatgaacttaaacagagacttgtaagccagtgttcactgcagcattatttatggtagtcaaaaagtagaaacaacccatgtgtttctcaacaaatgaattgataaacaaaatgtgacagcttggctgataggcacacaatggaatatactcagccataaaaaagattggcattgtaatatatactacaatatggatgaactttaaaaatatgctaaataaaagcaagacaaagaaggacaaatattgtatgattccacttataagaggtatctagaataggcaaattcatagagacataaagtagaatagaacttaccaggaatttgggggatggagagtgggagggaggaaagctattgcttgttggttacagagtttctttttggggatgataacaatgttttggaaatagatagtcatgacagttgctcaatgttttgaatgtaattaatgccactgaattacacaattaaaaaatgatctgttaaaaaatgtaaaaataattagggctgtaataatgcttattctgctttcacttcattgaaaatatggaaaatagttataacttttaccagccttgtctactaattgtgtcacctgtgccatttctggtcctgtttctattggttgttttttctcttcattatgggtcatattttcctgcttctttgtatgcctggcagtttttcattggatgccagacattataaaatcctgtcagtcttatgtcaagccagtcaatgaaacacttccgattcatattgtttattatattttaaaattatgaaaaaaatttgtgggcatatagtaggcgtattgttcattaattattaaaattcacactttttgcaacattactgaaaaggaaagaaagaaaaatgacccaaaacgtggacatttactgaaatgttttgagatccctagtcacatttccctcactcatgtgcaggtctgaggttgcagagtcctgtgtcaagcactatggcaatctgaaatctgctgagatgaaagctttttttttttttttttttttttccgtgacacggagtttcgctcttgttgctcagcctggagtgcagcagcacaatcttggctcactgcagcctccacctcctgggttcaagcgattctcctgcctcagcctcctgagtagctgggattacaggcgcttgccaccacgcccagctaatttttcatatttttagtagagatgggcttcaccatgttggccaggctggtctcaaactcctgacctcaggtgatccatccaccttggccttccaaagcgctgggattacaggcgtgagccaccatgttcggccgagatgaaagcttttaacaaaccaacccacagaatggatcttttggataccaaagcaacacctacctgcacaatattttagagaataaagatgccccattttttcttgaaagagaattaacaattaatttatttttttacttttattttagttttgggggtacatgtgaaggtttgtaatataggtaaactcatgtcacagaggtttgttgtgacatgagtttcatcacccagtagtacccaatagttattatttcatcacccagaattatttcatcacccagtagtacccaatagttatcttttctactcctctccctcttaccacctttcaccctcaagcagaccctagtgtctgttgtttccctctctgtgttcataagttcttattatttagctcccacttataagtaaaaacatgcagtatttggttttctgttcctacattagtttgctgaagatagtagcctccagcactatctatgttcctgcaaaagacatgatcttgttgatttttatggcaatgtagtatttcgtggtttacatataccaaattttctttatccaatctgtcattgatgggcatttaggtgtagcccgtgtatttgctattgtgagtagtgctgcagtgaacatttgcatgcatgtgttgttatggtagaatgatttatattcttctgggtttatatccagtaatgggattgctgggtcaaatggtagttatgcttttagcttttgaggaatcatcatattgctttccagaatagttgaactaatgtacactcccaccgatagtttataattgttcccttttctctgccaccttgccagcatctgttgttttttgacattttaatattaataatagccatttgactggtgagatgatatctcattgtggtttttgatttgcatttctctgatgatcagtgatattgagctttttttgtataggcttgttggctgcatatatgtcttcttttgaaaagtatctcttcatgttctttgcccactttttaatggagttgtttggttttgtcttgtaaatttgtttagctccttatagatgctcgatattagacctttgtcagatgcatagtttgcaaatatttttctcccattctgtaggttgcctgtttactctgttgatagtttcttttgctgtgcagaagtgcttaagtttaattagatcccagttgtccattgttccctttgttgtgattgcttttgatgactttgtcatgaaatctttgccctttcctatgtgcagcatagtactgcctaggttgtcttccagggtttttatagttctgggttttacacttgtctttaatccatcttgagttggtttttgtatatggtgtaaggaaggggtccagcttcaatctttttttttttttcttttctgagatggtgtctcgctccgtcaccaggttggaatgcagtggcatgatcttggctcactgcaacctccgactccctggttcaagtgattcttctgcctcagtcccccgagtagctgggattacaggcatgtgccaccatgcccagctaattttcgtatttttagtagagacgatgttttaccatgttggccaggatggtctcaaactcctgacctcgtgatccgcccgccttggcctcccaaagtgctaggattgcaggcgtgagccaccgcgcccagcccagcttcagtcttctttaatgcctatcagagagtgaaaaggtagagtcaaagatgactactggtttttgtttttgttttttctttaaaaattccatattagttcttattatgcttattcttctttcacttcattgaacatatggaaaatagttattacagcttttactgtccttgtgtactaattttgtcacctgtgccatttctggacctgtttctattggttgttttttctcctcactatgggtcatattttcctgcttctttgtatgcctggcaattttttattgaatgccagacattataaaattttccttgttgggtactgggtatttctggtttctataaacattactcattttgggatacaattttgttatttggagatgtgtgtgtgtgtgtgtgtgtgtgtgtgtgtgtgtgtgtgtttttaatgtttgcttttgtactttcttggacaagaccagaacaacctttagtctaaagataatttttcccccattctgactgagtactttgcctaatgcctaacgtcttacaaggtttttccactgtagattgtgggaaaacaaactattccctgccttgtgtgggctttgtaagttcttcctcctccttcccagtggtggttttcctcgccttgggtattttctctcacagatgtgctgactagtcatcaggtagaaactagaggggaaccttctgcagctttcatgattctcgctttctgtgatgctgtctcctccttatcctctgccttggagttccagctgtctttgcctccccttattctcaactgtgtcttcaagactcagggattccacctgggtcacctcctacccggcaatcatgtggcatgaaaactctccaggcagtaaggtgggaaaattttaagggtcaccctacttttttctcttctctcaaatattattgtcctttactctgtcttacccaatttctaaaaactcctgtttcataccttttgtccagttttttagttgcttgaggtgggagaatacattcagtccctattagtccatcatgcccctgactcgtttttcagctaagatgaaaatttctgtcagcctttcacccattttagtgatatttttaggagctttggcagttgagacttactctcaagtgaggctaatcaaaatagtatattattctagctttgtttttttgaattggttaggccaaaagaataagaataaagaattccagtgtagctgtataatttgactcatgcgtaaagcttaaaaacaccaaatatgtggccaggcatggtggctcacgcctgcaatcccagcacttttggaggccgaggcaggcagatcacttgaggtcaggagttggagatcagcctggccaacatggtgaaaccccgtctctactaaaactacaaataaattagctggacgtggtggagcacaggtactcgggaggctgaggcaggagaatagcttgaacttgggaggcagaggttgcagtgagccgagattgtgccactgcactccagcctgggtgacagagtgagactctgtcttaaaaaaaagaagaaaaacccaaatatgctttgcttttctaaattatatattcccagaccatgttgcctggggggaataattggccacaaggactttcagattgtccacatcaaggagacatagtaacttgtttagattagtcactagggaagagttaaggggaataattgaatatatagttaataaatgtttatgatgagttattcacagggaaaatattgcttccaacttaaacagaattttgtaactgaggaaatttgtcaaaagttaggagcaaaacttacttaaaaacttttaataaacaagcctcaaattatgaaatgttaatgggcatttattataaacaggccaagatttaatagaagttctgctatttattgtgtgtgaccttaggcaaagaatgtgacctttcttccccgccaagatggagtcttgctgtgtcgcccaggctggagtggaatggagtggagtgcaatggtgcgatctcggctcactgcaacctccacctcctgggttcaagcaattctcctgcctcagcctcccaagtagctgagattacaggcatacaccaccacgcctggctaatttttgaatttttagtagagatggggttttaccatgttggccaggctgctctcgaactcctgacctcaggcaatccaccctcctcggacttccaaagtgctggattacaggcataagacactgcgcctggccttgttcgcactttcaaatcttcctacctttgcttattctttttatttatttaaaatgaattgcagtggcatgatcacagctcactgcaaccttgacctcctgggttcaaacttttcttgtgccccggcctcctgagtagctgggattatacacaagtgctaccatgcttggctaatttttgtatttttagtagaaatggggtttcgccatgttggccaggctggtctcgagctcctggcctcaggtaatccaccctcctcagccccctcccaaagccctgggattatacacatgagcctccacgcttggcctattttatttctgttcttttttctttctttgtttttcttttccttatgtcagcttcaacctcacttctaccaaacacttcccaacacactgtggaagtaaacttctttaatgctttatttaatgactatatgaatatgactcttttcacctttctctctgaaagaattttgggttgggttgttagttatgagaagacagaaaaatatttaacacctttcaagggttcagatcgttcaaggaattgaaacatctcagaaaataatgaaaatggatcaaagtcttatgagtctaatgctacacagttgtctactcttattattctggtagctatttacagttgagacattttttctgcttccttttgagataccccttctcctacttcaaatcttccctggtctttgggtttttattgatttgtctatcccacagtgccactgttcatccacccatgccagcatctgtcctattctttctttcttcctcccttccttctctccctccctccctccctctcttgaaatctttattgaggttttattccatgccaggttgtttgaccagctactgttaaggaggaaacagacttgagccactaccatgaatgagcttcccacattgttataattagattaggaaatctaatctcgacctgacaaggattcttggtgttttattcctctctttttaaaaaaatctgtgccacattttccttttccttaacagtttgcttatgcctttttccattcctgtcccatacatttatgaattctcctggatatgtcagtatttcagttgccaagaaatgtcaatcaaatttcttttattcatcaggtatagtctgggcatttgaggttgagtggagaacaagatgaaacctctgccctcatgaagtttccattctagtgggagagacaaatctattaagaaatagctacaattttttctaatagaatgttttctgacataaacaatatgaagggcgggagtttgttgctactttaactagtgtgattagataaggcctttctgtgtaggtgacattaaaactgaggcctaagtaaagaaaagaaggtagacaggtgaaggtctatgggaagaacattctgggcaacaggaacaacaagcttagaggccctatcagaagcatgttgtgttcgagggaaagaaaaatggcttgtgtggctacagtagagtgaagtagcacagtggctgaacacgtaacttctagcccatgctaaggaggctgggtgttgtattaatttcctgggctgctttaatgaatgaccacaaactgtatggctggaaacaacagaaatctattatctcacagttctggaggctagaaatttaacatcagtgtgtcttcagggctatgtaccctctgcaggctctagggaagaatcctttttttctcctggcctctggtgcctcccagtgatccttggtgttcctggcttatagatgcatcattccagtctcttctttagttttcacatggtttctacagcagccattggatttacagcccatcctaaatctgtatgaccttaattaggtacatctaaaaagaccgtatatccaaattatgtcattgtattagacttctccacagaaacagaaccacagcagaagataacagaaccagcagaacatgatttattatgagaaattggctcagttttggaggctgacaagtcccaagatctacaatcagcaagctagagacccaagagaacctatagtataactctagtctcaaggctggcaggtttgaaactcttgaagagctgatgtttttattgtgtctgaaagcacaataaagaactgatgtcccaggtcaaagccaggcaaaaggaattctctcttctctgggagagagtcagccttttgttcttttcagaccttcaactgattggataagtctcacccattttagggaggacaatccagtttactcagcatatcaatataaatgttcaactcatctaaaaacatcatcacagaaacacccagaatcatgtttgaccaaatatctgggcaccccgtggcccagtgaagttgcaacataaaattgaccaccacaatcacactctggggttcctggtagacataaacagggggacattgctcaatccatgacaggttattatcttaaaagccactggactatgttaaaaggattggagttgtagttcttactttaaaatgtttattttgcctttgatatgaggaactgtccatgaagacaagagcaagaatgaaatcagaggtagaagccagaaggctgagatgagagttggtgacaacctgacgtgggcataacagaaggttgaataattggtgttggaagtgacgtagcatttttcccacctgatgcttttatcaagttgttgctccatttttacttgatttcttccaacaactatatgcttatttctcaatcaaatatatatatatatattgtgtgtgtgtgtgtgtgtgtgtgtgtgtttggtcggctattagtaatcttatctccaaggtacgtttctttggattaagatttcaggtttttaaaacactactggaagatctgtgaatgagcttgttttgtgacctttgcaagaaatttacttgttcatgtgattcctggcatggtccttctcctttttactcccaagagagaaaagcataacatgaaggtgggtagccaggaatgttgaacacaattagcgatttggaagaatttaaaaatattcaatttaaattagccctagggtcagaacacacattctcacctaggggtggagtacacatgtgtcctgtctgtactcagggagctgtaacagtagccatggcctctctgtgtggatttataatgaatggagcacatctattttagatggataatcaattttgaaatcccttattgtaagtatgctgttaaaacagaaatgttaacttcatgagtttaatgagtagcttcgatgatagcttagtgaagagatggaaggaaaggcaagtggggggaaatgagaaaaggagaacaagtgtttaatgaatatctacttgcagacttgaatgtcagcagcaacattctccctcctggaaaatgtctttcaactgtgcatcccattatgttcctgcagcccgtggtagcatgaagattgagacaaagagagtgtttctaagaaagctctcctttacaatataatgagatggaggtgggtagtttgcagagattgctggagcagtggtcaaatatgaaaaaaaaaaatccagcagaatgaaaagaccatgttaaccaggagatggcttataatgagcccagaaattgcatatcagatagccagctggctagcatttcctcatatccctgtgttctcatgcaaactgctaaaatgttctcctactctattttctcagcctcttaatagttctcatttctacctactgcattgaaaatatgaatgaaatggcaactctaccacttgaagaaataagaatgaagcccttttcagcaaaagtatttgcctaaacatggatggatattatttcaaatgcttttgaaaccaaggaaacttctgtttctttccttaaaaaaacatcttaactttcaagtctcagtttgactcacagccttttcagtattctgtggcctcttttgctatatagtttggacagactttgcttgaagtctccaagcaaaaaaatggaagtcctcccttcttattggaaattgataggggaggcttggcacggcgcctcatgcctgtaatcccaacacttgggaagccgacacaagaggatcacttgaagccaggagtttgagaccagcctgggcaacatagtgagatgctatctctaggaaaaaaaaaatagctgggcacagtatcgcatgcctgtagtccagctactcaggaggctgaggcaggaggatcacttgagcccaggagcttgaggttgcagtgagtcatgatcttgatcattaaggaagagtcttgtgaaattgttcaatagttagggtattatcacctgtctactttcatggttctttaccttttggtgactgtctcttctttggtgactgtgtcttctaaaatgagaaagcagtaccaatccctaaatatacatctgtcaataacttacagcacatttgaaacaatattactgctgtttctaaacattccttttttttgtttttagcatgatctgttgttgcctgtgttcatataatttctgtcttggaaaattattgaagctaccaaatatttgcagctgtatttagatatagactttagattataaatatatgacagagactctttactgggccttttggatgcgagacctcagggatatatgatacgtgttgtgagcctcagctaaagtctgacttccctgtggctggtaacttctgttaccaatactttaatggtggggtcctgttggtgaccaggcgtaatatctcactgaatacaaggccgtagtcagaatcttggggttgtaggactagacaagcagaagtctctttatttaatagatgtcactcctgttaaaattctccagctatgactgaagggagttggcaagtagccaagaaaaatgtggtgaaaagggtttaagaggggaggaaatgtcaatgccatggacatttggcaaagtcgatcacaagagggtttttctacacatgtgttttctgctgatcctgaaatcaaaactgaataccatgcatcttttcccttaaaaaaaaaaaaaaaaaaaaaaaagagtacagtaggttggcacatgtgaatggctcctgatacgagactctgtatgctttctagcaaatgctgaaacaaattccagtggacctttaatgtatatggggatcttgtgtctgtgttccctcgtgtgtctgtgtttgtgtgtgcccgtgtctaggggaggggagttataaggcagggtgcttaaatgctttgttacattatgttaattcctcggcagtgcaatcaaattcatgtcgtaattaaagctgtcagttggaaggcaagccaatcgccatgaaaacacagcataacaaatgaagtgaaatgattctgcgtgtagctatacaatgcttcgccaggcatgaaattaaataagtaatttgatgttgacatcagaaattgaaatgatacccactgttccctcattcagtcagacctgcataaacaatagccagaacaaatatgcacaacaaagccctcttctccacccagctccctgagtaatgtacaatatatatgcaaaacgagcataacagagctttccgagacctgaaggatgtaattttctttggtatacgataagatgatatgtatgtgggggtagggaagtgggtttggtgggagtacttctctttctgggataaaatacatttgcaggaagggaaagaaatgaaataaacaaatcccatggtctctctgagtaattcatcctaaaatgagttcacttcccaggggcatgactccaagctggtggagacctaacttggcttttgctttcttctgctgctgcatggagggctgtgggtgctggaaacaggtgatgctgtcatatggctagtcactggtatgagaagttgtctccatgactactgtggatctccctccataccatttatgggattaagaatgcagcaggattttaaaaaactgagtgcagtgagcaggatcacacatctatggtgcttcattcccctgagcttgtgtgaaacgctgagatgaggaaagttttgctttgggagctgcatttaggaatgccttgaagcatactgttcttgtttgatgtagatatagttacagtaccatgtttcctcctcaaagagcttagcatcaagaagagtcaccatctgctgtatttttatagatgtcaaattctcctgagccatttttcttacacataatccatccattcatttatttatacattcattcaataagtccttattaaatgcatcctgtgtgcaagtcattgtgtgaagctctaagaagcaatgatgaaaaagccagctggttactgctgtctgaagtttccagagtagggggcaggacatgtaggcagaagagctagcagtgaacagagtaactgttgcatcagggcagaggtcattttgcttctgggaaagtataatacccaacccaagctcatcagggaagaagcctggctggtgcagggatgcttagctgagacctgcagacctattcagcatttgcttcaccttcatttcaagcttaatcacaaagaggaagaggatgctaaaaattaaataatttataaagagaggttttaggagaaaaaaagaaacaaaaatcagaatctcaggcaagtttaaaatacattttttgggggggcttcttttcccaaacaagtgatgccctgcattcctttcagaattaacatttttaaattccctgtgtgtcagaactatgacagcctaaactggtaattcttgtgacttaaacccttcagaaaaatggtgcttttcactgctcctcttggcccacacattctctgcattttagtctactaattacgtttacaaaatgtctcatttttgaaaagccctgtgtgtgtactaactgatgcctttagggaataaactggcaagtaggtcatacactggaaaagtcatccaaacccactgggctttttattttcaagtcaatctgggctttttcctcttgcctgcccctttgcggccacaaaactgagtagcttgagaccagggcattgaatgtcagcaagtcagggaggcaagctgatgcgtgtctgtttagtctcagtgcagggcgaaatgccatcattaattcattacccagctgcctgtcaaataaattggcaattacatccaccgcagaagcttggaattcagtaaatagcacgttagcatctctgagttgttgagagatgtaaaggggaaaattaagcaacacggtgtttgtatcagtagcagatgacaaggggcagcatacactggtgatgtgatgtggtgatgaaaagcctgcaaagggctggtaatgagctgtgtggattggaacgtgttaaaaaccattgctgattttccacttttgtctttatgctttattgcagagttcagctccttccagcttgggaacaggctacttcgtaagtctatctcaacttccacatatgtgccttgcattggcattgatttccttctataatgaatgctcattgggatatgaaaaaaaatctgagaatttctctctcagtcctaaagagcagactgatttccattctttattaggaattgttttatttttagaagacatagcctgctgggccctagggatcttaagtaagtccgaggtatatacctggttcctaacgcccaggacattaagctccttacctggccatgtaaggagatacagggaaccctgattagctcatgccaccatttctccacaattacttttttagtaagaagtgtcatgtgggggatggaattcagattatgcattgagataactgatttcttgaataacatctcttcatatacaatgagttgccttttttggtggggaggacggggaatggagatggtattttttaatgaatgttttccctcacagtctgggtagtttgcctttaggtttttctttcagcaataattaatatacttatttttgctaaaatgcaaagtttatttctgaaccttattctctgtcctttgggaaagatggcagtgaggtgacccttcagggattatcacaatattgtgataatcatgaatataaaattcattctcaaacagcagttgtcacttcattatatttatttatagtgaaattctcctttctggatttagtgacccttttcaagatacaaatgaaaaagagtgacaaataagcattatttgtacaataggataacatgtcaatgtaaaagtctgttgtgatgcttaaaggaatctgattggtgttctgagtgatgaacactgatacagtcatgcctcagtattttctgagaaaatagtgaaatcatgaaaatcaaataaagtggaaaataattactaattcactttagttgcttttaacttttctctccaatgctaattactctggttttcttctgcccacgtatttctctcgatacatttacattaaatttatggaaaccagcatcatttcattaataaatgagtattttccaagcttagcaaaagtggcattttctagatgttgacttttttttggtcttaatctgtaataggagaaaaagtataaggatgatttggacctgcttaatacagttagcacacttacccttgctcctacttattgtggctgaatattcatgctaacagaaacaagcaggatacattcagtatcctgcttcagcagtcgaaataacagacgtagccccatctggcatctcttcacaccaggctggatgtaggttgagatgctggaagtaaaatctggagactgcgatatctattctccatccaaaagctaaagcctccccctttgctttcttcagcagaaagaaggccaaagccactaccttagtccttgatcacttctgtactgaacattctagtattttttttttattgtcagtaggatcaccctgaaagaagaaagtcatttctagaaacattgagattttcattatgctttttgcagttatttttctctctagttccaagaatggttatttttattctctaataatatattcttatgatttaaagagtctttaattacatgtctattaataaaatggcttttacagaacattggatgagtataaaagttttctcttattttggtaaaattgctggtagacttactttgcttacataaaagtctgtcgtattattagcttacatggagaagatacataccagatgtgtattcagctttcaactgtgacaaaaatgccctgctaggatgtgtttccaataatgtgattgttatgttatcagagtgcaaaatccattgatattgttgcccagtcctcatgaaaagtatcttctatttcaactttctttccaatagtatcacatgtaataatttcagatactaacttccacactggtgagtttcatacttctaagtggaaatgatatgggcacaacttacattagttctttgccaacatattatttacactgtgctttgtgatttgtgctgtcataatagctttttacttaagcctgtaaagaaggctcagcttcaggtaagtgaaatggtaatttttcaagtctatccttactcctcttcagcatgtctttgaaatgtggatggagggaaatcacctgcagagtccatgagctattagcgcaattgaaccataacatgaattctggtgtaagaaagctgaaggcacttttaacaatctagaaccgttttcttgaacactgtcccaagccccaacttcacagacttcctttgtttctatttagagcttttgtcaacagaggtaagatgctgttcattgtgtttgttaataaaatagacacctgagtatatacatgtgcaggtgtgtgtgcatgcacacacacgcatacacacccttagccaaaaccagtatattttactttcagttcttttatctgtagtgatacattcaagggtttaaaggagaagcctttgtttttgatctggttgtatttgtttatatctccttggttttgtgttccaaagatgtctgcttaggtctgtcacttttccaatccgtttagaagcagaagatttgagaaatgagaacagcagctcaaatcagtatttacataagcatattgcaaagaattcttaaagtagacaaaatagagaaggattggaacaaactttctacatttttgggagcttttgaataatgtgggtgttatacacacagagagacacacatatatattcattacatactcatgcccagctcatattctaaatataaatgaaagtatagactagttggaatcgatttgctttttttttttcttttttggcaagaggactaaaacttgttagagtgtgtgtaggattttcttttttttttttgttttgaacgtcaatgcaatgaacacattttcttttcaatttaaacgttttaggctgtattttctccttaaacatgtatttgaggtttcaatttgcatagtgtataattaagaacttagaggcagaatgatcttttaagactacctgtatgaccttggtccggttattttatgtctctgagtctatttccttatcaatacctacctattagtgttgcaaatattaaatgagataagatattttaatgaacacagaatatcactctatactaccaaataataagtactgccttctgttattcacacaatcgtgtgtgatggagcaaagttggtctcatcaggtggctgtgcaatgttgtgcaaagtaggttttataatttgtacctgtaggatagtagtattttattcttattatattcttcttgtagctttctcaggagcacagcttttgtatttgatcagttatttacattttttctgtatgtgaacataaaacagggtattcatcctctgtgattctatatgaacatgacgatgttggaatgaactgttctattagctgtccacatattatggttgttctctgtaatttgtcagttaaagttacttgtgtattttcttcctcagaagcatttgaagtacttggagcttttaaagactgcttagcagcttttaggattgggctgagagggaaggtacacctgttcaatatattccacttttatgaacttgtatcacatttgctcctttctgacaagaaaaagaaaaattgatgccctagcatatatgaacacagtaactgaaatcagtagaatgaaaagaccagtgagaacatttcgtgttggccagtggtctggtatgtcatcacaggaaagatctggactcattctttatagcacttgactccatgtggagttgggagctacttttggggcaactaaccagccaggcagaacttgattcctgctgtaagggaagtacagccttacttttttccaagtgacatgttctgccttctctggataattttcagccctcttccaggtttgaatctaactgtcttagaaccacagcctcaaatagcttgtatcctgcttttgtaaactccataatttctcttaaggattctcaactaataattttcatcttcctcaattgggtcacatctagtaattgacatactttaaagttatcagggaaaacaactcacttctactcagtgattaaaactgccgcattatatagtaaaggggaattgtgtagtggtatacatcttcagacgggatttgtataattattgttttcctgtgcagttgaattacttaagttgtgtaggtagtgctggtaacaggcagtaggtgcaaaatattgacctgtagctttccatccagggttataaaggtcatagtgggaatattctttgcccctttctaagtttttgactataaacccttgaaatatctcctgttttcctttgctataattttgtataacttcttcttttttctttttgacagggtctcactgtgtcacccaggccatagtgcagtggtgtagtcacagctcactgcagcctcagcctttctgggctcgggtgatcctcccacctcagccttcccagtatctgggagtaaatgtgcatgccaccacacctgcctaatttttgtattttttgtagagatggggctctaccgtgttgccaaggctggtcttgaactcctgggctcaagctatctacccaccttggcctcccaaagtgctaagattacaggcgtgagccaccatgcctggctgtataacttctaaaactgatttggtattctgtctaaccatagttgctttttaaccattttcccatttccccagataatactcaccagtggtgcttgcggctgcaacatttatcttgatgtaactgccagaaaatatcttgcttttattattttcccattgctctagtatattgactttggaaacaaaagacgtcattctactcatagcattctattttcagtagtggtatttccatttataaaatatagtaatttttataaatgccaccatgcccagccacttttaaatatttctgacacattgtattcatttattttctgggggtgaattcttttattagaacattcaaattaataattttgtttggtttgcaagaaaactgatgccatcaaggaagatgaaaagttactacacaaatttcaacaaagatttctataatttataaatgagggctgggcacggtggctcatgcctataatccagcattttgggagactgaggcgggtggatcacttgaggtcaggagttcgagaccagcctggccaacatggtgaaaccccgtctctctaccaaaaatgccaaaattaactgggcgtggtggcatgcacctgtaatcccagctgctcgggaggctgaggcaggagaatcacttgaacctgggaggcagaggttgcagtgagacaggatggcgccattgcactccagcctgggtgacaagagcgagatctcaaaaaaaatttataaatgaggttgaaaattcattttttaatttaataatcccagtctcagatgccctttcattctttgaatttgcatatctctataatatttctctttcaaaattttctggttgtcttatatataataccttgtataagctgatctagcagtggctagataggatcagattcaggtttggattttggcaaggatgcctcatagatcatgttgtgtgcttcaattaggagccacatatttagttctttatttttattaatgttaacagccattgattagacccagtgttcgttaggagctgcaaaatggtgatattgcagttccatcattctgtaaagagaaacatctacattaactacaggtatttggttatcctgaggtacagttaacacactgtatttgaataagagggtttgagctctccagagaacctatcactatttataagatttcttaggggttttagtttcagaagtacagatacatcaacttggtgctgacggcagctccatccaaagcagaagaaactgtcttcttccccacttggcagtacttgctgtgatgctaggaaaggattttgtaattcaagtgttcattcatcacctgttaagtacttatatttaagataaataacattaagtattttaacacttccccccaaataaagaccctaatctttgtatttattagtaattaacactaggtaaattaatttttggccattatatattgacaaaaatctattataatggaaatatttttgaaaatctaaattttatctagaaatccatgaaggatatccagttattattagggcatttggactaattgataaggagttgagttggaaaactactctccagatggagatttcaattcattttaactcacaagtatgacttaaatatctactcttagttcttaagttgcataacgtgtaagcatggctctcaagtcaaagatatgtagctgaatttgaagcaaagcaaactgattggtctatgagaagtgtaagtagagcacttggaagtataaaggagggtcagttaaatgtagcaggcttaaattgtgcagagcttgatggatgtttagatagtcaacaggaaagaaagggtggaacaagtttgaggcagggggagcaacaaagacaagaatacagagaaattgcataatagtgtggattgaattgactgtatgatgtctctggagaaagacgggacttagattgtcagggaatgttggttgattacagggaatgtgggataaagccagggaggtagtcgggtgagtggggaagagatggtttgtagagaaggacgtcaagtaaaggatcaatgactacaatactcttacttggagttagtccccagaagaggagatttgaatgtaggaaaatggtgagtttggaagttagaatacgtagttagaaatttaagtgtgtatttaagtgtaacttaaaatctaggacattaccaatgcctttgaagctacctgtgtactgtgcagaaacatctgggcaaacgaaagttgttgctctcccttatggtgaaacattgtcacattttttaaatgtaaccttcaaaatactacccttaactgtgttttttcctcctagtaacaaaaccagaatctaaggtgcattctgacagactcctccacgtggcgcagataaactctctaatttcaagggccttagacagaaaatataattgtatttcccatgtctaattcttacccttttttggtcatgtttttgatctgttaacattttaattgagggaataggatcagtgagccaggagcagacacaccttgactaaatgaacagtacaagttaaactgtggtgagagacatttaaacatttgtagaatctctacaacaggatgacttttccagcacactctgtagaaattatcttctgcctacacactatgtttaacttcagcttcctcattcagtacaagggaactgagaaatttgacaaaaaataatcaggtgagaaaagatcaattggtgtttccagttgcaaccaataattttaaccctttcattttctcaacatttaaatgagggaataggctgggtatttttaaacatttgctgtctacaggaatctttgacattgctgttgcaaactctttaaggagataagcggaaaacttaggtgctactgatggatgtggggaaatagccctcagccgttatctctctgtcctcctaacccccatctctggcccctcagatttagagggaaaaaatgattttggagaacaaagatttaatgagccactaggcaagagagtggctaaaggaccttaatttctaatatttcaaaatttatgattccagctgccttacaactagatgtctgccatgtgcaaccattgcttgttgctggcctcactgcctttctttgctgtcctttgagccacaggaatgcaaggccatagtgctgcttagtgaacactgttcttcactgtcaacattgaaaggagtcctgatttcaacggagtggccgagtctgcttttgtttgaaagtaatgtattttaaaattcattatgaacaataatgcaattattcataatgaataatgttttatatttgcatcattcatttagggctagtacatagagatactgaagctgttggcttagcctgttccatagctagtagattgatcatagagatgaagcggtaaaggctttagcacagtgcattgacagtcccagagggaatggacaggtcattgccatggaattctgaaaataattttatcttcattttcatctttttttctgacattggctttaaggaaggttgtcttatccttgttggagatttccacattacagaaatttgttgcatttgttgatacaagctatgtaaaatgacccacaggcaatgtcaattccggaggtttactctgattacccacacaacccttattttgatagatttaactagcctggagttttattgactatcactcagaatctttcagatcagagaactcactcctttgcttaactacttaaaaaatatttttgctgaaattgtaaattagatgcctcccaatccattgcataagaaacttatagcttggtgaaacaccaagagtatcatttgaaaaagaggttaaaaaacacaactggggcttgttaaagaggaaaagtggtattttaactccaagtgtcacattttcctatagtcagctctagcagtaaacaagagttattggaggcttagatagtttgagacacttcacttatctcccagtacttgacttcagaagccaaacatttaaaatgtgttttgctcaggtaaaaatgtttatccatttaaaatacaatgtcattttaacaaaagcaccctggtgacaagctgtttagatatagcacagttgataaactgtcagatcctgtacacatacacttgaaaggaccagcgcagtaacacaaggattggcattataaatcactgttaacaaaccttaatttgcttagtaggctaatgaatgatctccaatttttcttcagtaattagcttcgctaacagccatgtcaaagggaccttccttatactgtatttaatctctgctctgaaatctttggtgtctagtttgcaggatgaataaaaacaaacaaaaaacatttcggtctccattggcgactccctggtaataaatccagatgtagggattgtggctgttttcaagtagaaacattgccaaaggtgatgactgtctattagggcttgtaaactgtaatataatcacagatttggaatggagtggtgaagccagataattgcagtgtttcctgtctaaatgtgctgctgtgcgtagtggcctctgattttaaggagctgttaaaaatgcagcaaggcataacagctgtggttcctagaatactcctaatatttcatatgttcatcacatctcataaaatcttgcccagaccaacaaatgactacttatctgtacagctggactgtcttagaaggaaattagagaaagtgtgaatcatgtaggttagcattacagagacccaccaagagctcatccaagcccgtgctgtgccatatttctcttactgctcctcagagttctccctttccatttttagtccccaaagagaacatttgcctcttaccatttgtgagcagatcttatcaataacttactttttcctacctttgtggaaaatagactcaactttgccaagagaacttagggttctggggcagagaaattcaggcgaagttaatatctcaacccaaaatcaaaaagagacaacaaatttagttctcttagaattttttaaaattaatttttaaaataactttgcaatagaactagctctgtgatatgaaaacctggtttttctgggaggaacattagtactaggacattctgggaagcaaaggaagctagtgaacccaaaatgttcttttaatcagatattaaacagctaagcatcatgaccaaatggaagccttaaactgcatttgtacagaggcataatagagtcacaagttgttttcgcctaattgtttctaaattgcccactttactaatttgataattacagtagacctattattttggttttacataggtccagagttacagaacctctaggtcagaagggacttcagaaatcaccttacccaatcaccaatctgagacatgactcaaaaagttatgtattattagagtaggctgacaatttggactgtgaccttgctcatcctggatcctgtccttcagttgttatagttgaaagtcacattaatttttctgccatgccacagtgttttcttgatgtcagtgactgttttcatatgtgatactgttacatcttttttatcaaaaagtctaatggattctgtcttaagaacgagcctttattgaaaaatctctgttgaagtttgtcatggtatacttagtatacttggcttattactttaacttatgtagattctgtcatgtcatatattgttgttgcttttagttccacactggtgaagatcatcaagtgctacaactgtctttgtggcagttaaatttcagtgctactagattttactcattgctcttcttgtaatgccccacgatttgatttacgctggctgagtattacaagtcctatgtatttctttccattggtgattcttatctggagctttaacagaaatcagacattgttcctctgttttggttatttatagatacatctggaaagagttttgagacaacctgtgggcatacttaacatactgtaccttttttctttgtagccatcgtgtacaactgctttaaaaaaattagctggacatggagaagtgtggaaaccattgttctgttacacaatggcaaaataattgaccattaaaatatacctgtgatagacttagttgtgatgtggatgcattcatggtaagcctctctgagttattctaatgtatgtgaacaagcagtattatgtaaaaatagaggaaaggatatgctataaaagaaatacagtttgatacagtatttatgttttaacagatatgcttgagtactttaaatagataaatgaaaaaactttctattatttgtagtaggtctatgttatacacagtagtgtcctgagaaattcttgagttgtgacatacatataaattttgaatacagaagggataagttcattttagaaattactgcaaattttgaattggtagagccatcaaatttgtaaagcttgggtcacatttacttctgtgcattgagtgtcattacattctgttttctttaattttcaaacaaagggttgtaccacgcttctctttgaagaggccttttggtttcagcacatctatgggtacgttgttaacactgtcatacctccagttaaggaatggtacacgtttagagactgctttttcaagtcaaggtgccaattatttcctgcctaagcactattttagtgaactcactttagtctaaaatcacttgttatttatctcagaatgttattaaacaaggataaaatcaatgcaaagccagcgatttatgtaaatcttataaaagtttgattttctttagatttttgtgactaacagcctctcagtcttccttggacaggggagtggttagagtttgggttccctaattctctcatcttacagcctaagctaagcctcaatggttgatactgaagttttgtgaccctcgttcaatgttcagaatctattattttagtacttttagtggggaaaaaaaattctgctttacttcttttcctgctgtgatgtgtacattgtgttatttttctactgggtgtgatttttgttatctttttcagcttcattgaccataattttacttattttaattaacatggatcttattaacagttttctctcctgtacgtttgtgtttgtgacatactcttcactacatacttgaattaagtaattttattatttttcatctttcagcagtatgcttattcttggttcatttactgttttgaagcaatggaattacttacatatttttatttttccttttctctcatcttctgttttccaacctctacctccatttggtcctataacatgataaaagtgcaaacatgagcctgaataataaaggattgcttcactgattgctaaacatatattatagtgctttaaaactcatttcaggtcatcgtggtggcaattagtttgattacaagcatttaagctgtcacatagaaagccttccacttcctagggcttagtttcaaatcatgaaaactgaatgctctatacttatctatgtacacagctcaattttattattttggaagaaagctatgcctgttacaaagatcactcataatttcagaacctggttaaagccagtgtgcaattttggagcagagacacaattttattaaaaaatttaaaatatgcatgtgtacatatatgtaggtagggactatcaaaagagatgtcaaaaccatctatttattctcatttttggatacagtacacattaccaagttgttacaatgtggttatttaaatatcatttgggccaggcacagtggtgcatgcttatagtcccagctgcttgggaggctgagttgggaagatcatttgagcccaggagatcagtgttggagtgtgctataatcatgcctgtaaacagccactgtactcccatctaggcaatatctcttaaaaaaaaaaaaagtaaaatcatgactctcatacattatacaatctacatgtttaaacattttatttaataatgacggaagtaggcagatgttataactttttcaaaggtaaaccaaaagaaaatccacagttatagatgaggaatattgaaatgagtgtgtagatggaggcagaactggcttcaaggaagtcagctgagtctctacctcacatgacagagtttacatgatgttagagaatgtttattttgcattgttatcacttacctacaacttccagacttgtaaaatagtttccatggaatcagaaattaattatgctggagagtgtgctatagacgatgcctagtgtttccttgaagcacatgttttcctatttgatgaaaaatagtcttaaaggaaggtttgtttatttaaatttggcctgatcatttacacgggtgtaccaagaatgttaatttagcatataagccttttaaactttgctttctctgatgtttttacaaaataaatctcctattgcacttttaaaagtattatttgctgtcctaagggtggaaagccaaacccaagaatcacggaaaggatcactgaaaggagtgatcaagcatgatcactgaatggcactctagaagtcttcactcagcccactggtctttctgtcaccggcagtacctgtaaatttgggtgaatttctttcttcttgatgttcccaaaatatcccaaagtaccctaccaagaagtgatctctctttccatctatgtggctggattctgtaaaccagctaccaggctagtttttctgggaggattggtactttatagagataaagtcacctttaattccctgtaagtgtttaatcatatctgattaaatgagcattactcacaaataggacattccagacaagatcttcaagatttttcatactcatcttggtaaataggaaggccaatttttactgaacccatgtaaataactgtgttgctatgaaaagtaagaagacttagagtttttggattctggggtgtcagaataagattccattttaaaacacttcatttcagtttataaaatcagaattgttatgagttataaatagcttaagaaaaaagagagcttccttatattctcagataatagaacactgacataagaccaacaatactcaaaacaatcatccttcatcatttcattgagtcctgtttaattaattcttgctgtactgaatcttgacttattaatctcatcaactcatctcatgaatttcttgactgaaagaagttctggaaatcttgactcagcccactggtctggtcaaagttatttaagcaatgacatcagaaacctgtacccaagagtctattctttgaagtcttaattattttaagtacctggtgcagttttttttttttattgtgggtgctctgaggttgtctttcttatttgaaaaccagaactctgttctactgtgttactgaatgcataactttcaaggaaacataaaagtaaaacaaaaaacggtgtaagtgacagactttacatggctgtggttaattttcacttacaacttttaaaagtgaaaaatatgatgagaatttataacaaaaataatgtaacgtatttgattatttctgtggcatgtaaaacaaagctagtaaagaatgttttacacaaaactatttaagcaaatgagctcatagaaactatgaagattttaacatatttcattacttttcagactcaggtattacaaagcaaggtaaataaaattcactttccatgttctgttctcattatgttctttcatattttggaacaaaataatactttacttcaagactattcatagggtgttccatgaggtcagaactacttccatagtatttctaagatgttattaccatgcagtatgctcattattgctagtttgaaatgaatcagcaagtcagcattttaaatttttttaagttccaatttttaatgttgtaaatatcaatagttaaaacccacacacactctcatagacacaaaataagctcattgaggtcctcaataagttttaggagataactgtaagcggtttggagaccaaaaatcttcagaaacattgcattaggacacaggtgttcttttccttgaaaaatggcagcatacacataattatatttcttagaaactgttgcttctagatatgatgtcaacttcttgcattagttttaatttttaaccaaattaactaacttctatttcacataaaaaaactgggggatagttacgatcttccttttccatatcagcattttagaggagatcatgaataaacataaccaactttctatagccacacacatctcttatgcaccttcataaattgacaacaatgaacacattcattaacttgacccaaagatagtcttctctgtagattataaaaataaaaagcaaaacgatgaaattttaaattatgattagtgctcagtgttttagtattctatcttaattagaaatggtgtaactatccaatgaatatctgttaattaatttaatatcagtctgaggtttcaaattacttaaaaatcttggaaattatgctcaagccaacatagtaagaagcataattactattgaagaaaagtttttgagaatattgatgcagtttggtcaaagaaaaataaagacaaacataaacataaaatagaaataatgctagcttatttggccaggaaaccagtatatttttaggtaaattatctagtgtagagttaaaatgtttactcatgtacttaaaactgataaagaagacttactgtttttattaagccaagatttattaaactaatcttatttggcaaagttacacgtaaattaagtgaacttgagttcataaaatgtttccgaggtaatgtatgcaagaatttattgtttaatttagtacatttaaatggttagagattcaattcttttctgtgaattttaggaatatttagtatatgtaagcacttacactgaataaggctattagaacaaaactcctttagtcttagagactttataatctcattattaataccatctgaggtaggaaaatattgtgcacacaatgaaaggtaaaggtacttttgaattgtagaccctcagatgtgtagaaagcatacagttccaattctagaatttcagccataggtcaagagtaaatacagaaacacaaaaagtttcactagtccaaattgcaaagagctattcctcttcccagtagacatgctgttcttaattatttgagctcaaaacagacacatagaccatcagaaaatactaacagactagaacttttttttctcaagtgttttaagtgatagaaatctaagcttactgtgtggcacatttcttaaagaagcttttctgtgtttaactgtacattttgtagttagcattttcattctcattgataaattcaacagacagcaggccagtcagcctgttttaggttctgtggatatagcagcagtaaataagacaaagtttctcttttcatgacactcatagttaatcaaattaatccctaatatgccaggtgataataggaatctaaagaaaaatattcatgaaaagagttgggctttcagtaaagaataacagggactgaatttattgttctattagaaacaaccaaaacaaaagataaaatacatgacacaatggtttgcatgacactggacataaggcagtaaggacagtgatccctgaaagaaagtaaacaaatgtagtcatctctttgagtgtcccagcttcctgccttgagagaattccaggcctccatgcagggcagagggaattcagaagtaccaagtggaactcagtagactttctgcattaggagaagatactgagagtccaggaagaacaaggtagcaaaaattcaaaggacagagtattaggggggaggggtgatgcacggagaaaggatcccagagatcttcagaggattgctttccgttattcattagagagttaattagctcatgcatttcaacaaacttcctgatgcctgggaaagaaccatccagaaggattagaggcaacagtgccttacattaacccatagccaggaacagtgctgattctcaccagcaggattggaaaaaccactagactcatggggcatagagtcaagtacatagtagggtcttgtctcagtattgagaaataatcagtcattgactgagcagtgctacagtttgccgtgacactttttattttttatctttttgagacagtttcattcttgttgcccaagctggagtgcaatggtactattgtggcccactgcaacctctgcctcctgggttcaagcgattctcctgcctcagcctcctgagtagctgagagctaatttttgtcatttttttagttgagatggggtttcaccatgttggcccggctggtcttgaactcctgacctcagatgatctacccaccttggcttcccaaagagctgggattacaggtgtgagccaccacaccctgccctcccagcacgtttaaaatgtgagttctgatagggtcaaactatttcaagtgacttaactgaattctaaaaccattttatggcattcaattacgaattaccagacattcaaggaaccaggagaataagacccataatgaagaggaaatcagtcaatcagaactgaatcagatgttagaattaacagagaatgatattttaaaaattatagtggtattccgtatgttcagacagttaagtagtataagagcaaaattgaacttctaatgtaaatactacaaggtatgaaataaaaaatatattatatgggattaacagcagattagacattgcaggagaaaagattagttaacttgaattcatagcaacagaaactagccaaaatgaaacatgaaaagattagagaatttgcagattgaacagagcatccgtgagctgtgtgaaaacttcatacagtctaatgcatgtaaattggagtctccagagagaggagggtgagaggacaaaagtaatttccaaatttgatgaaaatagtgcagaacatcagaaacataaagaaaattacaccaacacatattataatcagatttctcaaaaccaataagaaagggaaaatcttataaatagccaggaaatagtaaaaagacataaatgcagaggaacaaagactgacagcagatttttttttttctggaaaaaaaaaatgcactggagcaacatccttaaaagtactagaagaaaaaattgccaacctagaattgtatacccagtgaatataactttcaaaagacatggataagagaatgagatgataatccacaggctaggagaacagttttgcaaagtttgtatctgataaaggacttttatgcacaatatataaagagatcttaatattcagcattaagaaatcaaaaagcctagttgaaaaacgagcaaaagatttgaactgatgtgtcactaaaggcaatatacaaatggcaaataagcacatgaaaagatgctttacatctttaattattacataaaagcaaattaaaaccataataggtatatagtaatatattattacacacctattaaaatggctaaaatgaaaatgactgactacagcaagtgttggtgaggatattgaggaattgcaactcttttacacactagtgggaatataaaatgtacaaccataaactctagtttctctttagatcatgtaaatctttcccctttttaaagatacaaccaattgagagaacagtttgataatttattaaaatgttatatatgtatgtacaatatattctagccattccaatcctgggtttttacccaagagaaaagaaagcacatgtccatacaaatattttacatgaatgttcatagtagctttatttgtaatagccccaaattggaaattggccatatgttcattatcaacttaatgaatgaaaatttggtatattcatacaacagaatactacttagcattaaaaaggaacaatgtattgatacatgcaacaacatggattcatctcaaaataattatcctgagtaaaaaaagaagccacacaaaaaaggtacatattgtatggttccaatttatataaaatgctagaaaaagctgtttaatctacagtgacataaagtagatcagtggttgcttggagaggcaggcacagaattgggagggaggcattaccaaggggcaggagtaaacttttgtaggtgatgggtatgttcattatcatgactgtcaggatggctccacagatatatttataggtcaaaatttatcaaattttatcctttaaatatgtgcagtttattatatttcatttatacttcagtaaagctgttttaaaatgattataaaaactatttccctgctgttgttaacaccctgagatgtctgcctcttttcctatctttctgtgttttaaatacaccagcctactgcactttaatacctctctagctcagacagctacacacaaaacttactctgaagaatgtcaaaatgcatgttttcatcagagaaatatctcatggtcctttgttaaatgttcaaaaattcatgattgggctttataaggcaaatatgtcctgttttatagaattacgggagagaaaatgcatacaaaagagcccaatcctttttttggctggcttttatgtcagagctcaaaattgctctctgataaaatgtaggccaccagattgaattacttcattgaaccactgctgtcctctgttaatggtaattgcacagatatagcagtctttctcggcaacatctcagatatttacctcccactgtttttcaattcaaacctttgatgaaaatattcccagtacttctttaaagcagacatccaactgtctttcttgacaaaagcaaggtctctaaatcagatcctgacaatttgtgacacagcagtctatccaaatcaccttttacctatgtcactatgtcatttcctgaagaaaaaagtgtccatcagacaagcaatttctgtaggttttgggggctggaaggttggtatgccagcaaaaatgagagaggaaaagggaaaaataattttttcctttgacttgtgtggaaggaattcagtgaggggttgaccagatctaataagcaaaagaggggttttgtatatttaaaagatacatttttataaagagagatctatagatatttgttattttcaagatggtaacaattgaaacttgaatctagtgatttctgaaagctgctccctttaaggagacagggaaacaaggttagtttttttttaattcttaactttttctgttagactactttaatatgacaatatttagcagtttattttctcgtcagggattcagctcagtttctggtctacctcctgtcctgaactgagcagactacatttcctcacatgaaggttgtaggttgtacaaacaatgccactggcatgaaccatgatcagcgctctccacttgactcatggtgactttggaggctggagtgcagcacatggtaaccaggagatcagctggatcagcctcagagtgaaactcgctgctattatctctttggctatggttggttgggtgctttttttttcccttttagtattggaaggatataattgatacttgctttcttggatcaaattgtagcatcatatgtttgactgatgggttagttgtaggagctgtcagagcccccctgggacctgctttacaggtttggtgaatgagcagctgacagcacagcaagcacactttctgctgccagcctggttttgttcttcccaggtggatgtttcattataggaatgggcctcaaaataacatttgcccaggaatatttctagagagtggtcatctttggtggcactgttatggtggtatgttgctcatttagagtggtctcattcaagcaagacccatacatcatttggggagaacagtgaggaaaaccgtgggctgagctctggggagggttcgatctgggaataaggcatgtcctagaatctcagtcaggattctactttcaagagacagtgcaaggctcctaggaagttggggccaggaggtaattaaagaggtagaaagagaaaatcttttaaaatcaagtttctgactgcatgggctcttgaatgtggtctttactttgattgtggcctcaacatacaggtggtagcagagtccttgaagggcccttgacttttttttttttttcagagatcagggaatttgtaatttagaaggagaaaactggcactcttgtgccagtaaagcctctgctgatagctgtgtgccgtttgtttttaatcctttctcggtatccgtctctggccatccttatctttactagaaatcaaaggctgtgaagggaccaccagaaaaataaataattcatagcttttcaaagcctgagccccaaatactcaactttcaaagcatgagccccaaatatcccttcccttgggcttgaatttgctaaactggagcctgtgtttactctactagggtaaccaagtattcaagagctcagagaaaaaaggactggccactatacctctttggaggtaagagaggagcccgtgtgagttcatgtgtagaagaatcactttcacctggaatagaatgtcaatcccagaatctcactatctggcaggcaggaagtgataccagtttctggcttggaaaggacatctgaaggatcctgttggttttgttttgttttgttttgtttttttctcctgttggttttgtctgctgacacgtgggtagtgctgacccagtgtctgaccggattgtctccatccataacttcatctagccctgtttacaaaagaatgaacacaagtgacagcctcagtgaacctgcaccatgaggatgcccttacttctcccacactctcactttcttctcttcttggctcctcttcccctgtacttctctctgttgacatagaatatgcaaagtccaagagatgtggcaatgccagtaagagctaagttacttgcagctggcggtgccacctgtgcctatcaaatttcagccaaagcaattgctttcccagaatgccctgttttggggaattggaaagtgaatctgtaggggcggcaatggctgtatagaagagagcttttctctgggctcaaatatgaggacaaaattgtgaagtaggactgtagataatcccaaatccccacttttgcatcttcctgagctcagaggcaacccaagagatttccgagttaatcctttggactttaggtgaactctcagctagaaccatcgtttgcaagcagatctcctgtggaggtgacagttccataacctatcctggtggttgtatagttgagaatgtttgtgattccttctctctccacaagacctcaccacttccagttatgttcattttatttttgtttagtcatttttgtgcttagggaacaatttttcagctttgtactctcacctcataaaagtcctttgtatcattgtgaaaaagcaagtcaaggcctggcgtggtggctcatgcctataatcccagcactttgggaagccgaggcaggtggatcacgaggtcaggagtatgagaccagcctggccaacatagtgaaaccccatctctactaaaagtaaaaaaaaaaaaaaaaaaaaaaaaaaaaaaaaaaaattagctgggcgtggtggcaggcacctgtagtcccagctacttgggaggctgaggcaggagaatcgcttgaacctgggaggcagaggttgcagtgagccaagattgtgccatttcactccagcccgggtgacacagtgcaagactccgtcttaccaaaaaaaaaagcaagtgaaattgacattttaatttagtctgactgcatttttctataattttctaagaatttgtcactttttagtattttctcttttctgataaactgttccagcttttcatcactttttaatcagctttcatcagttttatcatactcaacctctggtatttttctttgtatgctctctttttctcctttttttgttttgttcatgagacaggtcttgctctgttgcccaggctggaatgcagtggtgtaatcttggctcattgcagcctcaaccacctgggcttaagcgatcctcctatctcagcctcccaaagtagttgggaccacaggcacatgccaccatgcctggctaattttttattgttttattatttatttatttgtttatttatttattttttctttaagagatgggggtctctccctatgttgcccagactggtgttgaactcctaggctcaagcaatcctcccaccttggcctcccaaagtgctaggaggcatgagccaccacacctggctcttttctgttgttcattctcttcacccttgtttagatcctaaagtgacccaggcacttcaggatctgaagatagctggatgatgatgagtcttcttaaaaggtagcattttatagcaaacatgatgtagagccactgaagggttttatagttgctgtcctcaggggctggatttttaaactggaatatccatggggactttgaaaattccacctgctggggctctacctcatttgagaaccactaccttaataagttcatggccttacaatgggagtgggaggagaggtgactttggagcagacaattacaatgtgagtgacagttatctctttcatgagtactgctgtacaaactgggaatgcctgatctggttcttggagagggagtggaggttaacctgatttatgtaaagttgtagtggtcatggcgggggaggaggttgcattccatgaagcaccatttggaaagacccaaagtgtggggcctggttatttggaggacctggagatgttgttggaatgcttagaaattacaggaatgaggataggaaggagccagatcccaagtggtcttgacaagtcttgttaaagagttttcatttcatagtgcaagtgatgtagagccactgaagggtttcatgttgtagaatttattagatgtgtgtgagagatagctcactcagttagttttgtggaagatggctgtgtaagcatgagattggaggcaagaacttcaggaaaaattatgatgatgactgggagagaaggtggacaattctagagatgtttagaacacaaaattgacaggacaaagtcaacgagtcaatgtggcagtgatttatagagaggcctcaaggataaccaagtatctgctttattcaaccaagtgagtgctggtacaattcactaagagaggcagtataggggagtgaataagagcacatatttgaatcctagacctgccactcgcctatgagttacattttgggtgtattcatttttaagacgtccatgggatgagcaaagaaagagatcctgtgggagtttgagtctggagctcagagaagcagcctggacctctggtgcacgtgatccatgcagtccatggatcagaactctttcaggaaaaaaaaaatgcggttattaggacaagtgttgagtatgtgtgatttttatttctttgtgatttagctggaggactatagagctgaccagaataaaggcaataaatatataaataatcatctacctatgatatactcaaggcaataaatatataaataatcatctacatatgatatgagtatatcattatctgctgtcattattattagtgaaggcatgttacatatttgtttggaccacagcatactttcaggaaactcttgataaacagctttcttttttatttattgccctgctttcttttgattgcttttgccgtagcatcaacctgcatcttattttaatcatctcctctctgaacattgatgattccgcagctttgttagaatacatcttgggagattccattttttaaaggctctttcaagggcatatggcattagatgattatgatatggcgcatttagaatatgccatgatttctctcctgctgaatccctcacacgtgtttgaagtaattattatcctctctgctagctcatgagacttgttagatcactatttgtgggtgtcataaaatgttggcaagaccccagtgtgaaacgcagtgtgaaatacatgtggttaaacttctctgattttgtatgtcaatcaaaacaaaatggcttaaaacagtagatgaatttcaaaagaaacttcaggattctagagcaaaaatgacacatggaactctttaggtctgtgttttgatatttaattcagggagtcatacacaggaggacgtatgcaatatagtagaatttagatgtgttatgattatatctgataatgttacaaatactgagcagctttttgttacatcatatttggtcccaaaatgtcatgccatgcaatgctgggggtgtttaaataccaaatttatgcatattttcaaggaagaagcagataatcttctaactatacagactgtgttacttatcagaaataatagtttatgaattgtcaaacagtgaaaattttaaaccatgtatccctgataatacttttatgtcttcattaagcatcactaatactgaatatgagtatctatctgatgaggaccttagaatcttattatagttagatataacaagattttatttattgtttttatcatggtgaagggtatataatgtcagcatgatctctcctttagttttacctcttctggtgttttgcagtcttaaatgggtgtctttaggaatatcccttatttctagttttagagctcttacttctagttttagagcttctacctaataaaggtataattagattggtcttttctgcatttattaatcaaagactattcttttacatgtgactttttagcaacatccataatttaagtgatatttgcccaaatattatctgtactcccacctttacaagaggatttaataacttaatagagtatgttatagtaatgagttggatgaccaaatatatttcaactaatagaaagaccatgatgtagctgctgaaatacctgagaaaggtagcttaccatataaagaaagacagctaggattttgatcaccttcttgctttagtgaatgatgctagatcttcctccaacgtaaatctttctgctcactttaattctagatgtgtgaattcttgacttgaggactttgatgtcagatttcacctacttgaaggcccattggaagaataacttctaactcattaaacaattccccatttagccaaagttagtctcatagatgtctgtgatggcttgttaggtggcacagtgactaaatttgatgctcagaaaagatggtcttaacaaagagttctttcttttcacacaagtgtaagctttctgacagttatcacccaaaatgcatcttgttattgttgtcttttctactcatggctgtgagtgtcagacactgtgcttccattcactaacatgaagacatttgtgaaagggccttcatcaatatctgacactggtgaattgaagaataatatactagctacataaaactgtgtttattcttcctaaaccaatcattgctttttgcagcatttccaatgaaattgtgattttttagcagattcttctttgatggagctgtgatttgcaataatcttgtcatgccaggctcaaaatactactaaatgaagacatttgtggaagggaatgattgtaaattgcatgcaaatttcaactcggctggaattaatcaatatggaaacagaacttgtgcgttcctgatataatgatgctgaaactaatcccatggagttctatttccgtgggaattaggcagttattttgctttaaatctatctctctctctcctttttttacccttgaagacaaagtcctgtttttgagttttttaaaagtaacttctttggggatttagagaggttataaaggaaacaggagtaaaatcaagcatctgacttcccctgtggggacatctgacatttcctatttaatttgctgtgcttgtttaatgaatctttcccccaatttttcttgctagtttttttttttcactgaaaattctaaggcttatgagatagtaggtgatgcaatctttattctatgttaaatatgcgacactggtctctaaatgggatgttctttcttttacaccagtttcttagggtgatcccagcttatccttgatgaaagctttttgtttttgttttttaagtcgcttttggaggaacaggtcaccaaccttgactttttaatgcctgcttacattcaaatttctcattttctttgattggcaagattaggtttatggccttttattcttacacttggcaactagatcggttaaccttagattatttgttccccaccttttcttcagctgtttaggtcacaaatttgtagaaaggtcttatcattggcatattttgtaccaccagtgcatcagtgctatactcatatatccttagaggctgacaacttacttcccagcccctttggagtactttaagaatccctttatttatagcccagcttaagccccagtgggtaacactccataaacctgcagtgacatccagtggcctcgtggtgtaattttttacaaacttttctaaaaggaattacaggggcagtatttcctgtcaaagaaaaatactgttggagttattgaagggggtttcctaaatacatttatgtacaatagttactggcatactccttgataggattactaggagaatgattattcattttttggtttttgagtgaaggattaacggcctctgatgaaatcagctttattccaagatcagataaaaaatataaaattgaggacaatatttttaagaggacaatttttaattaaaaaaaatcaacagtgtagaatttcctattctggatagatttaagaaataaaggagaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaaaaaaaaaaaaaagaagtaaaggagaacctttagtttgtgcaactgatcatgaagtttaaaattctatgttgttccccttcttggttcttgtgcagtcaatgtctttgagagtcttcttccactgtgttaactctttaattttctcaaaccacctaagactgctactataaatcagagccaagagattcccaatctgattactgtctttaattgtattattaaacgaaaacatatttttataaaaatgatgccccattattataaaatatttacgtggtagaaaaatgtacgaagaaaatgtgagcacatcagtgcaaatcttacccttttcacagaaataaccagcgttaacatttggtaaacctctttgaaaatgctctctatatgctcttttatattctttccatgcatatatattgatagaacgataaataaattggaagctaagaaataatttcatgatactgaattgaacgacttataacggctgtgtttatttggtttgtaattaccgcaaaatgttatactaggtggggagaggaccaggaagaggtttgctttttttaaaagagatgactttgcctttcttgtgacagggagggctggctaggcaggatcaggtttgggagagggtcaatagagaggagtggtgtgcagccacctcatggctgccagctatgaggtttggtttagataagttaactgaggctggaatgggacagcatagttcatatgtttaaacacccaggacgagatgttcccagagctcagagagttcatacgagtaagtctagcatgtagaaactaagccagtagaatgttccaaactgatgctaggcacattcataccaaagatgagtgttaggttgtggtggtggggggggggggggcagagggggagggagaaggagagggagagatctttagatatctttagcaattgatactgaaccagaaatttgaaatttagatttcgctctgtcatgcccattccccagacacttctcagatacaatgcaaaagccatatgctactgggagagaggcaagaaacctgtttgccattctagtcctaacaaagattagctgctgtgggggaaggactatgaatctccccctgctttgcaaagaaatggggcaaacgtcgtttgcagttgagagagatcattttgcccatgattctgcactaatgcactgatcctctacctctggtagaggaacaggaaactttctcatgcccaagatattccaccaatacaaggcaaaacttggcttccccgtgggagggatgtggggaagaaaactgattgtatttcataccctgaactgagtaggaagcagagattacatgtcattggggtggaggaagaaatgctaagaaagtcatgtacttgagtcccagatgtgcagggctaggctaagactgtgcttggagcaggagaactgagaaattctccttcccccctccaagagccttcaaccataacaaagaaacagtaacaggcttgcagtctactgctagaggagtggcaagagcatgggaagaaacgcagacaccctgcaatgcttatgtgcaggtcctacttaggtcctactgtaagtttagggtggatcctgaacactgagaaaacctttttgacagcaaaaaataaaataaactttcatttctatatagatttagattacaaagttatgcaggtagaattctcgtataaaatcaatctagttttccctgttgttacatcttacacttgtaagatgtagttgttataagtagatgtaattgttataagatgtaattgttataagtagtaaaccaatattgctacattattattaaatgaagtacatactttattcaaattttcttagtttatactttactgatctttttctgttgtagtatcctatctaaagtaggatactatgttgtatgtttagtcattatatctcctcaggtgcctgtaagactgtgacagtttctcagatagtttttctttttgatgatagttttaaggagtactggtcaggtattttagagaatgttcttcgattggttggattaaaaaatttttttgatgtttttctcatgattagaccctcagttggcctctgttttgaatcttctagactcacaaaagactatgtcacagcagtctatcagaggaggaatttttatcctgtggtgcatcaacactagttatagcaacagtaaaatacagacacaattcaactactgagtagatttattcagtccccccatgctaacagcttgaaagaagtagttacccatttccaggtagaaatattatttacctgagtttcttttatacataaagtttgggttcaattaaaaaaattatgacatagacacactcacgtaagataaaaaaaaaaggtgactgttcaagatgtaaaatagtcaacaaaatctgacatgcaaacttcagacagggaccttgaaataactatgattactgtattaaaaggtttaatggaaaaggtggacaatatacataaatcgtgatgtggaattttagtagagtgatggaatctgtaagagtcagaaaaaaatgctagaaatgaaaaacacaatatcatatatgaaaaaattttctgtgggtttatcaacagacttgatacgatagaggaaagaataagtgaccttgaggataggctaataaagcctttcaactgaaatagagcaaaaagagtggaaataaaaaatggagcattgccatagaaaatttcctgaccgcctaacatacttcaagagagagaaaataggctagaagaaacgctagaagagataatggctgagaattttccaaaatgaaagatagccaaccacagactcagaataaatatgaagaaaagcatacctacgtacactgaagtcagactgctgaaaatcaaagataaagaagtcttgaagacagagaaaaaaataaatattcatgcagaggtataatagataaaagctcagtacattttatgtcagaaattatgttagtgaaaagagttggagtgacatctttaaaaaactgaaagaacaaataccctcaacctagaattctgtatccaggaaaaatatattgcaaaacggaaagtaaattaagtcttcgtcagatgaagcaagagaagttttgctagcagaacaggtctatctgaagagcttacaggaagctcttcagacagtaggaaaactcttcagatagcaggagtacgctgctctatagaaagaacattttgttctacacaaaggaatgatggacaccagaaatataaaaatatgaataaacagacaagacattttttcttctaatcttttgaaatgagattagagtatgggttgacaatgagcctggtatggtttgactctgtgtctccacccaaatctcatttcaaattgtaatccccacgtgttggaggaagggcctggtgggaggtgattggatcatgggggcagttccccactgctgttctcatgatagcgagtgagttctcatgagatctggtggtttaaaagtgtgtgacaattcctgcttgcttgctctctcctgctcccctatggtaagacgtgcttgtttccccttcaccttctgccatgattataagtttcctgaggcctctcagtcataatttctgttaaggctgtggaaccatgagtcgattaaacctcttttctttgtaaattacccagtctcaggtagttttttatagcagtgtgagaatggaccaatatgagtcaaatctaacatcaggcttgttttgtgcagcccatgagcaaataatttattttaagggttgtaaaaaatttttttaaatatagaataattaatgcatatgcaacaaagagcatatatggcttgcaaagtctaaattatttactatctggtgctggtttaaagcaaaaataataattctatattatggggtttataacatgttaaaataaaattttggcaataataccttaaaggatgggagggaggaaatggaaatatactgttgtaaggtttaaatggaaatatactgttgtaaggtttctgtacaatacatgaaatagtataataacatttcaaagtagactatgataagttaagaacgtatattgtgaattttagagcagccattggggaaaaagataaagtacaagatataattaacaagccaataaaatgaaatcataaaaatgctcagctaatacaaaagaaggcaaaaaaattaagaaaaaaagggaacaaaagaacagatgactttttttaaagtataatagtacatagataccatatcatccttagcaataattacactaaatataattggtcagttaaaaagcagagattataaaattggatagaaagtaaaacccaattttgtgctgcctgcaaaaaacccattttaaatacagagccatgactattttaaagcaaagaggatggaaaacagtatgtcatgcaaaccctaatcaaaagaaaactggagtggtctgggcttatgcttataatctgagcactttagaagtcggctggatcacttgagttcaggtgtttgagaccagcctggccaacatggtgaaaccctgtctctgctgaaagtataaaaattagccaggtgtggtggctcatgcctgtaatcccagctactctggaggctgaggcaggggaatcacttgaacctgggaggtagaggttgcagtgagccatgattgcaccactgcactccagcctggatgacagagggagactctcaacaaaaacaaacaaacaaaacaaaacaaaaacagaagtggttttgttaatatcaatacagtagacttcacaatattaccaagtataaagcatggtatcacacacaatatagtgataaagggatcagtccatcaagaaaacaagaattcatcaagaaaaaggcctatgtacacaataacagagcttcagaatacataaagcaaaaactaatagaattataggaagaatagacaaatctactaataaagtttgagatttcattgctcatccctcacattgatagaacaagttaacacagattaggaaggacaccaaaaacttgagcaacactaccggtcaccttgactcaatcaacatttatagaatgtgcccttcaacagcaaaatacagttttttgtccaaatgcacatgccatactcattgtagacatattttgagctattaagtaaatttcaataagtgtaaaagcattgaaatgatgcaaattatgttcactgaccacaacagacttaaactagaactcagtaacagaaggatacccggaatgtcctcaaatttttggaaattcgataacatacttttaaataacccatatcaaagagtaagtctcaaatctaatttgatttttacagtttacatgcctcttttttctaggcatttaaaaaatatacagaagtacagtctagactgcacatgtgtatataattgatgacagtgacattctctcggaatttatattaatgtagtgcacaatatatttgaagtacatttggcataaggacgtactaagtcacaagacttgtttggggaatgtgatttctttggataaaattaaattccttgaacttgacaactaatcaggctgaaaaaatacacttgaagctttctgatacattattaaggaagttacagaatatccatgaatttagttagctttacactccagtggtactcctgagtattttgtaattgaactcgttgatcttcagatgtgaattggttcttcagatctgtgaccatcagtctgtctacaaacatttatgcaggctctctgagcaagatgcctttcctcacggtggtttctaaactctcccaatattttcagctgcctgggtaggaagcattagggcagacgcccaggctggaatgcagtggcgtgatcttggctcactgcaatctctgcctcccaggttcaagagattctcctgcctcagcctcccgagtagctgggactacaggcgctgccaccacacctggctaatttttgtatttttagtagagacagggtttcaccatgttgactgggttggtcttgtactcctgaacctgaggtgacctgcccgccttggcttccctaagtgctggaattacaggtgtgagccagtgcacctggcctgctctgcttttaaagaagcagaatttgtctagatgtttttgaagaacattatgtaataaaatagcagtaagagtatgaattctcgatatgtattgaaaattagagtctttaaaagtcttggtgtttagaaattaatattagttttaatatgactctttaataatgaagaatataaagttctctgtgtgctggtgagaggactttttatttttactcctggaaatacatgatttgtaccagtcacttgtgtggccataatatttttgccctaaatattaggtcatcatttcctctttattgttaggtaacccagaatgctaggtattctctaacagaagaaaaaaaaattggtttgcagtcctggtaagctgttggagattttaataatcccaataaaatatttccatttttcaaatgtgtttagatgtccttggcagatttagattagttacatgagatggatagaaaacaggctcagggcttagggtttattttgatgatttttaaaatttgttgaaataagagttgttttatttaaggaaaaaataatatttctggattaagtatttcaaatgcgttatttttggagagatgctacagagcttatgtcaaatgattattaatatatatatattttttttgagacggcatctcactgtgtcacccaggctgaagtgcagtgtcgcgatcttggctcactgcaagctctgcttcctgagttcacgccattctcttgcctcagcctcccgagtagctgcggctacagacacgtgtcaccacacctagctaatttttttgtatttttagtagagacggggtttcactgtgttagccaggacgcttttgatctcccgacctcatgatctgcctgcgtctacctcccaaagtgctgggattacaggcatgagccaccgcatacggcctattaattcttaaaaacaattgtgaccatgatattagcacctaaagcactattccttttcttagccttgggaagacttcatggtcatgaatactattaatttgattttttaaaattatgagtgccatatggctgtagaatgcagaggtttcatgaaatatattcagtgagaaccagaagtgatttactaatgcctcaaactcatttaaatatctaccaattcaacatataaaattgtcttcacgagaaacattacggggtatgattttgtatttgatcataatgcttgctaattatttcctgttagtattactggtaaaatgggggttggcaaattctagatagtgatgccacatatgtgtggtgtgggttccttacaaaactttatttgctgcttaattttgtaacattgcatcattccctaaatagcctcaagatccaaatacaattgcagtaatacttgctgaaaattggaaactattaaaaacattcatttgctgggaatcaggagaggggagggaatttcaaataatagaggtttttttttattaaaaaaaaaaactcacaaaatctttgatccactgtctctcaaaaggcaatttgatagctaaatgcaagtattttttttttttttttttgagacagggtcttacttcttcgcccaggctggagtgcagtggcatgatctcagctcactgcaatctctacctcctgggctcaagcgatcctcccacctcagcctcccaagtagctgggtctacaggcatataccaccgctaatttttgtatttttgtagtgttggggcttcaccgtgttgtcaaggctggtcttgaactcctgagctcaagcaatccgcctgccttggccttcctggtgggattacagggattacagccactgcgcctagcctaaatatattaataagttttaaagttttatattatttccatttctattttggtagtaaaggtaaatgaacaagcattatagatcacagacatttaggttaaaaggtccaagctctttgagatgggatatactagggacacgttatcttttttttttttttttttgagatgaagtcttgctcttgtcccccaggctggagtgcggtggtgcgatctcagctcactgcaacctcactgcaacctccacctcccgggttcaagcgattctcctacctcaccttgccgagtagctgagattacaggtgcctgccaccacgcgtggctaatttttgtatttttagtagagacagggtttcaccattttggccaggctggtcttgaactcctgacctcgtgatccaccttcctcggcctcctagagtgctgggattacaggtgtgagccaccgcccccggccggggcacattgcctttataactctatttaattcccttgcttgcacgttgaatagatctaaatgactgggggaaaagtaaaaacatagtctttagtccctttcattgtggtaaattcactgaatgatagacggaaatttcagccttcttgggtctactgccaggttctgtagttatttgtatgtctcatggagaaatcctcattgattacactgtatggctaaactgacttaaaacagataactgagcctatttcaaaattgaaaattctttaaaatggaaagttagtactctattgttcccaaactgttggattgcatgccattttcccaaactcacagacgttgataagatttcaggcaaggggaacaaggaaggggtcacagtggaagcgaattcttcccctttttctgactgtgtttgcccacctgtcctttacccttcgcagttctattctgagaggtatgtgaggaagatgggagccactgctgctagattgttgccattaaccagctttcatggcttttgtgggagcctccttttcattagtatttgcaacatgttcaccagcaaaatgattatgttaggcagagacatcacatcacttacatttcatagctcagtgcaattttcataaactgcgaggcaacatccaaaaaaaacatgactcagaattagagtttcagaagattattatatagacattatttccctcaggtcacgggctttagtcaaatttggaggagaatgaaattgccaacagtgaaaagcagacagaaaggtatgagttcatgagcagagaaataacattttcatttgttccttccccatgggaaagattcagcattccggtaaatggagacggttataagaaatgaatttttgtcagcagggatgtgattttaaggctcacttatccattggcaatctagatttctaaccccaggaatctgggaaattgctacagaatgtagtctttattataaacaagtttttttttttgggggggggtagtttttccctccttcttttcttggtcagagctttttaagacgaaggactacatttctttctgcatttctggggtcagatgattgcagatttcccatctgccctgagtttctctccattgctgttgctttgtgatggaaaccctttctttcctcctcaccaagcttccctcactctgtcgttgcttttcctaacccccctgtgtttatccagcacgacactgacaatattgaaagctgcaaacttcctatatggccatggagtggtggatctatggcctgatctctctgttccccagcatttacaggatgtcttgtgctgctgctgattctatatcctcagttcttttgtgtctgtggacctgaaagagcaaggcaggaaatacagctttccaggtagctctcattttaccaggtataaagagcgaggatttgcaaggtttctgtaaggtaatcccagacaaccttcttcgtaattaaagaacgttctttcatgggaaattttattttccttcttcgatttcatcagatgcttctcagcccatcactcattcagattctatgcaatggttctttttctagctagagtacatccttgagagtagaaaatatttcatataatctaaacccttcatttctagagatgcagatagattctgtaacattaatctcacctttatattttttcaatttttaataacttgaaaatatgtatatctaatgccttctttccctatgcacttttgcttattttaatatttctcaacaccataagctatttgcccagctgcatccttattagacagtgctattgcctgccaaagctttttgagagcaaattgcattgccttcattattattatgtctacaatataatgattatgaaacatcattattatagttgattaataaatgataattgatgactctcagttcataggatttggcccatgaaattcatcacaatttgtaaacttttctccaaaccttcaaggattctaaaaggattgattttgctgcaaagtatatgcgattacattttttgatacctagtaagtagtagtggttgaggattcactggcctggccagagtgagggtgtatactaaatgtctgtggggtttcaatttcttcctattgaattcttttaaaatgtagagtctcttaccactgggagtttggggaacttcgcacagtggctcatgcctgtaatcccagtactttgggaggccgaggtaggtggatcacgaggtcaggagatcgagaccatcctggctaacacagtgaaaccctgtctctactaaaaatgcaaaaaattagccaggtatggtggtgggtgcctgtagtctgaggcaggagaatggcgtgaacccgggaggcggagcttgcagtgagccgaggtcgtgccactgtactccagcctgggcaacagagcgggaccccgtctcaaaaaaaaaaaaaaagaaagagagaaagaaaatgttgacggaaggcattctatctcagtctctgcaatgagccattcgcattttgtggaatcctttctggcattaattgggggacagaaacagcatctggcatatttacatgacagtagcatgtacttctcttttatatgtcattcattcgtacttccaataagttcttttctaatatgagcatacattgctttattgtgcttggcagatactgtattttttacaaattaaagttttgtgtaaaccttacatcaagcaagtctgtcagcaccgtttttccaacagcatatgctcacttcatgtctctgtgtgacattttggtaattcttgcactatttcaaacttttttattataattataactgttgtggtgatctgtgatcagtgatctttgatgttactattttagttattttggagtgacataaacctcgctatataagaacagtgtgtgttctgtttcaccaacctgcctttcctctctctctctctccttccctggccttcctattccctgagacacaacaatattgaaattaggtcagttaataacactacactggactctaagtgtttgagtgaaaaaagagtctcatgtcactcacttgaataaatcaaactctagaaatgatttagcttagtaaggaaggcatgttgaaagccaagatgggctgaaagctaagtctcttgcacctgttggccaagttgtgaatgcaaaggaaaagtgattaaaggaaataataggtgctactccagtgaacacatgagtgataagaaagtgaaacagcccttttgctgatatggagaaattttaggagtcttgatgggagatgaaaccagttacaacattcccttaagccaaaacctaatccatacaaggctctctgttcaattctgtggagagtgagagaggcaaggaagctgcagaagaaaagctggaagctatcagagtgtggtttaagaggtttaaggaaaggaactatctctagaacagaaaactgcagggtgaaacacaagtgctgatggagtagctgtggcatgttacccagaagatctagctaagatcattgataaaggtggccacgttgaataacagagttttactgtagacaaaacagccttctattagaagaagatgccacctatgactttcaaagctagaaaggagaagtcccatgcctagcttcaaaggacaggctgactcttcgtaggaggctaatgtagctggtgactttaagttgaaaccattgcttattttatcattccaaaaattgtagggcacttaaaaattatgccaaatctgccctgtgctctagaaataaaacaacaaagctgggatgacagcacatctgtttacgacatggtttactaaatattttaagcccgctattgagacctactgcttggaaaaaaagattccttttaaagtattactattcattgataatgtacatgatcacccaagggctctgatggagttgtacaaggagataaatgttgttttcatgcctggtgacagaacatttattttaccattcatggatcaagaagtaatttcaactttcaagtctcattatttaagaaatgcatttcataaggctttagccaccgtaattagtgatttcctctgatggatctgggcaaagtcaattgaaacctttagcaaaggattccccattctagatgccattaagaacattcatgacatataggaggaaatcaaaataccaacatgaacaggaatttggaagaagtttattccaaacttaatggatgtctttgaggtgttcaaggcttcagtagaggaaattgctgcagatgcatggaaatatcaagagaactagcattagaattggggccttgaaggtgttactgaatttctgcaatctcatcaccaaaattgaacagatgaggagttgcttctttatggatgaacaaagaaagtgttttcttgagatggagtctactcctggtgaagatgctgtgaatgttgttgaaactacagcaaagaatttagaatattccataaactcagttgataaatcagtggcggtatttgaggattgacttcactttttaaagaagttctatgtgggtaatatgctatcaaacagcttcccatgctacagagaaatctttcatgaaaggaagagtcagttgatggagcaaacttcattggtgtcttactgcaagaaattgccacagccacccaaccttcagcaaccaccagtctgatcagtcagcaaccatcaacatgtatgcaagaccctccaccagcaaaaagattatgacttgccaaaggatacctgcaaaaatccatccaccagactcaggtgtttgttagcatatttttagcaataaagcatttttaaaattaaggtaactacattgaatttttagacataatgctattatacacatatagcctaatatgtctattagttttagacataatgctatcaattatgttaataacttaacataatttttgtgttcactgggaaaccaaaagttcatgggacttgctttattgcaatattcattttattgtggtggtttggaaccaaatctacaatgtcttaggtattcctgtattttcattaagaagtagtatgactatctcacataaaggctgataacctggaagacacttagatttcaatatagtttggaacctgtctggattccatgtattacttcaacaggagtgaagaatcccatagtctgatgaatttttgcaggtattctcttcaccataatgaggtttcattagggttactgctagaataggattgtttgttattagtttccaatgaaggatggaatattctcaatgtaggaattcatagtacgtacaagaaagctatagatattgttagtataataattatacaatagtagtagtataataaaatattcaagcaatcacttaataattacttcaagtctcactgtctgccctccagaatcaggagcaggatgtctgaactcctcattctttacacttttactcaaaagctcttaactctagagacagtctttaactttttggtatttggtttcttcttttgtgcaatggcaatgattctgcctgtgcaaacaactgtcaactgtttttctcagcagtgctagtgtaaatgaagttgaatattaggaataattaaccttccttgcttacatatgccatttgataatgctcaatcttctttgttaagaaaacaatgcagtaaaatctttgttaattgagatgaagtgttgtttatttaaatttggatcattctgaaaaatatatttgttccaacaggcttattcctgaaaatctttctaaaatatgttcagtgtctgtctgccttagaatggtccccaaatataattgaatctctctctggtgatgggttgtcttgcacagcctaggacccatcatactggagtgcttttctctctgaatcaagcagcagataacggaatttggactgctttgatctcagatcataccctggaagttgtgttttaataagtaaatttcttatatgaattgttttcttagtgttgtacctcattcttcataaaagtaaaaagtatattagcaagttacagaacaagaagtatcatgttgcctaatcaatgcaaaatatcatcatttcctagacaacttcacaggagacatagcatgattagaaggtcagacttgattaaatcccgtgctttgcccttagttttttgaaatttcaaaggaggcaatctctctgtcaataaattttcaaattttataaataatagtaatcctgatgccagcaagcagttattgagctttgtgtgccaagtactgttctaagcatgtttcaagtaataactcacttcttcacaatgagcctttcaaggaggtactgttattgacatcatttttctagtgaggagcctgaggcttagattcagaaacctgtgagtcgccatatagctagtagctggccgagccatgatttgaacttagctgtgctcaaaaccaccacaccatgatacctcagagatgaatgtgtgcgtggtggttatgggagaagagaaccacatttacttattttttgtctgggtcttgcatggtgttttagatcatttcatttctgttatttcattttgaaacatttctactataattattatccatattttacatatagggaatctagtctcagaaaaactgaagcttataaccaatattttacagctagtgataatgagggagcagacatttgaacttgacaacctaaattcaggttctggctaggggtttcgttaaggaaaggaaaaattccctccaacaaaggtcatttttatgatgtgtaagtgatttaagctttctgtataccaccccaccccttacaaagatttgtgttttcatttttaattaaatctgtctgttctgcattctcattgtttggacttttttcaaatcattgctaatacactggttcttcttcctgttagtggtttgtggttgactggttcatcttctaccgttaacataattctgttttttttttttttttgaggtggagtcttgcgctgtcaccaggctggagtgcagtggcatgatcttggctcactgcaacctctgcctcccgggttcaagcgattctcctgcctcagcctcccgagtagctggggctacaggtgtgtgccaccacacccagctaatttttgtattttttgtagagacagggtttcatcattgttcttatttttatttgtcattcctggaaattaattttgctttgagtttgggacccctaacatgatgtcctttagccccgtgaagagtgaatgtccctgtggtgccattagccacttgtacagtgtcctgagaatattttaagagaaatatgaatggcagtaccacttggataccaattaaaaatacttttttttttcagtgaaatacgtctttaaacctgcaagacacagagggttggttctcttggtttccttagtcattattgacatcatctataactttctgttgaaataacaaggatttttatggaaagctgtttttgttcctgttcctgttgccagttttcacatccttatatattattaaagatacagaatgggcttttaatagatcctacaggccaggcacagtggctcatgcctgtaatcccagccctttgggaggctgaggcgggtggatcccatgaggtcaggagtttgagaccagcctggccaacatgacgaatccccgtctctactaaaaatacaaaaattagctgggcgtggtggcaggtgcctgtagtttcagctgttcaggaggctgaggcatgagaatcgcttgaacccagtagatggaggttgcagtgagctgagatggtgctgctcactccaacctgggcgacagagggagactgtctaaaaaaaaaaatgtaggtcttatggagtcacagagtcttaatgaatctccattgttatatgacagggtcttatggatgtcttttggaatgcccagcagcaagtgggcagcttcttaacaacccactgtgactcatgaggaagtgtgtctttgtgttgtttatgactgtgtttttatgggtaggacttcccactgtctcactttcctggcttgccttctcttctgtttaccctggccccacctttggctcagctgggcactacgggttttaccagagtcagttggaatgcaagtgcatcacaccagctctccatctccctgtggcattttatggctcagagaggattggaactaaaccttgggtggctcatgatcggttgtacccagccaagtctggagaaatggagaaaatgcctgggtttgttagtctacatgtccttcacattcttacagacacgtcttttgagtccagagaaatgtaaatcttttcctttttgtttttagtggtttatttctcaggccctgaagcatgagttttggtcacccctacagcaggggagatttcttcaaaaacagctgtgattatccgaaggtgttacattgtgcttttcttttcatgcatttttagcacctgcacatcatagttttcccgggaacctccagcagtgtcacctgctaacttggcagactggagagactctcaaagccatgtctgacttctgtgtccatctggattatttctgtcacatgatgatttggcagatgttttctgcagatctctagctctggtaaacaatggtgaactgggcccatatactcaacttgtaaagagtgatttccccaaaaacaggagacagacatttagcaagataggggctccttcatgtgaaagttgatctctaaggttagtataaattttctgatctagagggaattataggactctgaggcccacccttactagcttgccaccaggcttggtataaccttcattgcaaatgctaggattcatgctttggttgtacatgaaggggattatttctgggtggtattttatctcctactctcagactctttcagatctagctggatgttcaacataagccttttgtgtaattcccatgggctgtagctctgtggcttgagtagtggtcacaggagctctaatgccagaataaatgatgctgctaacagaaaaaagtagggctcatttctctgcaaaatgctgcacaaagaagactttctttgcttcttctggtacatgtggtaagcgtagaaatagtttattatggaagtctttcagccacaggtctttctaaggcaaaattgtatcctccagggaaactaaaataaataccagcctaataaacttcagattttaaaaaataagttatcatattgcatttctgtaagaagaaaaatatgaaaggttgatgtgtgtttttattccactttgatttacttcccaagctgtcctgtcccaattcaatcttaaaatggaagaaaatactttatcatttgaagaaggatgaatgtagtacagaattcaatttttaagaattcaaggtaggggaagtaaattttgatgccaactttcaagtttttaaagaataaaataaaataaacacatacacacacagttggctttgtgttggaagttaatgatagatgtcttctcggtattctttgcaaaggaagtcttccatccaggctttccctcatttgtttttaattacagtcatggtctacctggccttctcactagcactagctccctatgccttttgctttgctcttaggccgggcttttggtccctccctcctcatctctggttctctcgctattccttggctcctcttgtcttgctgcccagtttggctcaggtacatgaactgcaacctacattctgccatccctgcagctgcacaagcctgtcgttttccatactattgtattttcaggtctaacatgtcccctttttactgccctttctcagtctactttagtggttattatcttgtcatcaatctctttaaatatggctaggctccgaagattcctctattgactattgtgtttgctttattttataaaatttattattaaataaagctaggaaatgtaatataataggcttccatttacccaccacccagcttgaaaagcaattctgaatttgctatttatgttactaatttctttatatatttttcacatatgcaaatcaacaaatatatagtatgcttatattttggaaaattgtatcttattctttatgtgcttttttaactttttaaatggaagatgatgcttgtgagattaattcaggttgctatgttttgctcttccactactgcatagtattctattttaagcctatgccaccatttattctatttatgagcattcagattgttttcatttttgttattacgaacaatgtttctgtgaacatgcttgtacagatctccttgcacttctgtcaatttattatttcagcatattttattgagcacctattagtgcttggcgtgattgatacaagactgctaaaacaagtcgtatcttgaagccatatgctttagagagacaaacaggcaaattctgttgtaggagtcttctcacctatcttcttatttttatttcactcctcctttgtcatatttcacagttctgctaaagttaacttttttttttctttttttttttgagatggagttttgctcttgttgcccaggctggagtgcagtggcgccatctcggctcactgtaacctctgcttcctgggttcaaggattctcctgcctcagcctcctgagtagctgagattgcaggcactcgccaccacacccagctaatttttttgtatttttaatagagacggggtttcaccatgttggccaagctggtctggaactcctgacctcaggtgatccgcccccctcggcctcccaaagtgctgggattacaggcgtgagccaccaagcccagctgagctaactttttttttttttttttttgagatggagtctctctctgtcacccaggctggagtgcagtggaatgatcttggctcactgcaagctccacctcccaggttcacgccattctcctgcctcagcctcccgagtagctgggattacaggcacccgccaccacgcctggctaatttttttgtatttttagtagagacggtatttcatcgtgttagccaggatggtctcgatcgatctcctgacctcatgatccgcccatctcggcctcccaaagtgctgggattacaggcgtgagccaccacgcccagctgagctaactttttaaacatagttttaatcattactgttattgtcaaaaacattcaaagtctccctgttgcttatgtgataaagttgatactcctcagcttgccattcaagaaccatcctagcttaaccttttctcctgtttacatctcacccatacacctttcagatgccagtgtcatttccctttcatgcctctcagtgatatttctttacccttagctatcttgcctgttttgaactttatccaggatgttgaggctttactcagttttcaagatccaaatgaaatagtttattattcctcttatacccttcgtctaagtgtttattgcagatagtgggatatgcatttgtttagctgactaggagcaggaaccatatggtaattgcctccaacatagtaggacctcattaattaaaataataatttataatcaaatcgaactgaatggatcatttggttctcagctttgctgttaaaactctttaatggtcctaatgggaggagggagtagaaatagagtgaatgttttagttttctgttgcttttcaaatgtttctgactctcaataagtgcttgtagcttactaaccgagcaaccattctaagcgggatccttaccacatcaaagtgggataggttgagaagaaaactggctttagtaagagagacagattcttcataaaaaaaaaaaaaagaccatattctcaccttagtaggattgaactaaagcatacttaaaccagcttccattctcatctcttggtcacctcctttctgccttttgggtggcaatacacgttgatggcctgtcacctatcatgcccttctacttatctccagtccccagggtagaaggcagatgtggctgcatgtgaataaggggaagcccgagtccactgtgtccgcgtttccattttgaaggaaaatgggagaaatgaggccagtggtttgataaattatatcaaaaatagtcccttcatgctaatggagtgcgaagaagctgatgtactggagatgatctataatatttcatatttctctgaggagaaaaatgataaacttgatgatgtgcaatttattcatgtttcttcagatgagaaaaaaaaatcctcaagtcaactaactgcctgtttctcactcctggaagctggcatgtggattttacactgggattggaggctgggcttgtttagagaaatgcctagagagactttgattaatcaccagacctttggcagttggttgggagagggtaattacgctagcattgccactattttatcatcgctattttatggctctacaccgccaggtgacaaatgtgttaattattgcatttcttatcctggacttctcttgcctgccccctcccctcatggttttggcccttagtccttctctgcagctcagccctggacggcagtaacttgtgcaatcaaagagctgttctttgggagccatgctgagagggacagggctatcagccctgctgtgtgcagacgctaaccacggggagctggttaattccctttcctcttccttctgcccatcaccctttgggtcaagtgctgctcagagccagaagctccactggcttctttaataactgaaaatagcacccctggactgggccatttcactctaaatagccccctggaggaggttagaaacagaggttgtcttaggcaaagagatttaggaggtaaaattgtcctttttctgtctttttcttttttttttttttttgttgccccttctgtctttctgttacccagagaaagcttcacaagcatgcctgtaatttagttgcaccattttattacagctgaaagaattgaatgtaaagaaggaagtttaatagaacatataattcagcagatttattgatggggaggtatctattgtagtttggccagtgaaggcaggtcatagaggaaaatttaggtaagtcggattttctttaaaaagaggcccaagagttagtacctcaggattttgttttcttctgttccttgggcatgctggaaatttgttagctcttaaatcaacaacttgttattgacagtcatctttttgctggagaacgtattaaaataagtataattatggtgcctgacctcaaaaagaaaaccagttggttatataactctaaaaagatgagtagccacagagtgtagaaagccacagagaagagcaaatgccattgttgggaagcagagcctatgctgggtaaagtttcctgggagtttcatcctccaagaacaagaatttcttcttctgaccctccaccttctctggaaatggggtgccacatcttttgccttctggctaaatttttgtttattatatgcctctttcactagaatgcaagaacatgactacttggttatgttcttgcttgtaatccttgtttttagaacaagacctgacaactcgattatggtcagtatatatattttttggatgtatgaatgaataaatgaaatgagatcttaacatgtaactatcttcttttagactacacagggttttgactataattgaaatttttaggcttcttcagctctctcttttttgggtccaaaggatgtctcaaaccaaataagaaattccttcttattgatctagtggttacagacaagagacgccagccttctttgtcttttggaagttaggagtgtgtccctgaggaaactatgccctgggaaggttctttatttataatacaaaatttcttttttgtggttgagctagatacagatatttttcaatttttcctttcttcgaaggctatattttggcttaatctgtacttacagcataactattcatgctaattataattcatatatgaaaatgcaccaaatatgactattagaagcttttgaaatactgtttgatactttgcaatatagttatttatgcatatctgcatttgattttaaacttcttgaagtaatgttttatttatttttgtatctccattgctcagcaaagggtggcacatagtaggtccttcatgaactaatattcactagagcactgtgggaacttatttgcaacacccttggcatctctcttatccattggggatagcaagtaatttgaactgtcaaaaccagtggtgttgctttgggcctaaatgacattaaactttttttttttttttttttttttttttaagaaacgaggatcttcctatgttgcgctcgctagtggtcttcaacctctggcctcaagtgatcctcctaccttggcctcccaaagtgctgggattacagttgtgagccaccgcacctggccccaacattcaactgttttttctgacagtaactaagaatgggataaatgcctctctgaggcctttcccagtttgtgaggccacttgtcttattatttgtgattgcaggaggacatgcatcatattcatctaaaggttgaatacatttatttaattgtggcttgtgaagaaagaagagctaatatgtggtcacgttttatgctatttaggatcgaaaatcagtcagtcatgaagccatttcttttcattctacttttggagatcatattatgataagcttttcagaagcattaataacctagactcaagcctatgtagtttggaccttcatgtctttacatgtgtagaatcaaagagcaataggagttggtgtatatgtgacttgagaagcctcacatcattcttggaatatgttgtcactagtgtcatcagtggggcctacgtgccctgcctgccaactcaggaaaggcgtgagattgagggatctagatttagcatttattgaggaaaaagtgttgtataaactattgaaattttacataaaaaacaaatagatctgttttgggaaatgaagattttcaaaagaaatatggtccattttgaaagagataattgcaggatatattttagtgtggcctggagcttaccaatcagaatgatattttgacattcatggtgtcaaaaggtaatttctttttgccttgaatcttatgcttgaagtatgttattcatgtagctatatataatgggattacattttaggggaacttcgggatgatatgtaaaaatcctgaagaagttgtctttgtgttttaaaacaagaaaaacttgacacaaactggcttacaggaatgtgtttcttgcaggtttcccttagaagccacacaggaggcagttttcattggctgatgatgtttatgggtataaaaaagaaactttgggaggatttgataaagtctcttttcagcttaagataacatcattttactcacgttagagcgtttgtgtgtgattggagttttgatggtggttatatttttggctttttttaatgtttgttgcttactgccattcctgaaccaaaagataagttgttcagataattgcaaagacagattatggtaatagtgatactaatatctaacatactacattaaatatgtggaatttaatttaattttttgagatggagtctcactctgtcacccgggctggagtgcagtggcgtgatgtcagctcactgcaacctccgcctcctgggttgaaggattctcctgcctcagccttctgagtagctggaattacaggcgcccgccaccatgtcccagttaatttttgcatttttagtagagatgaggtttcacctgttggccaggctggtcctgaactcctgacctcaggtgatccacctgcctcagcctcccaaagtgctggcattataggcatgagccaccgtgcccagccaatatgtgtaattttaattatttagcacttatagcaattttataagatgggtactttgtttatccctattttttagataaggaaactgaggcagcagaggttaaagaaacttgcccaaagttaggtagctaataagtagtagaagcaggattcaaactgaggtattctggctctgtaatccatgctcttctatgcactgcctttgcaaatctaatttcaacttgaaatgagttcagtggattgatagtagattagtaggggagccattccaaagagtttcttataattaagtgaacttgagaatgtaactggcaacagtgaagagattcccactctatttcatctgtaactttctgatcttaccgtggtggtcacatttgttgtaagaatatttatggtggtgtttaggataagtttaaggaaatgttgatcactttttgtttgatctgagatattgatagatatttatatactttataaataggtaattaggtatatatgtaaatatgtaagatatatacctattaattacctattaaatcattcatgctggcctctgggtatttacatgaatttttttcagtaagtcttgcctttcagatatatataaactagattatgcttaaatatttatttggacaagtgttttcctctttagttaagaggccatcttctgaaaaattagactgcagtaaagcagtaattccgcctcagttttccatgagggaagatttgtcatggctactcctacttttggcattataatcacgtgaacttattattcaaattaatggcttcttggcataattttcagaggtctctactgcaaatctcagacatctacaaatcagtacatgtcataataaaaggaagaatacagactgtcagacatactcaactagtcttctttttttttttttttttttttgagacggagtcactagtcttcttttggaatcacatcaggaaagggaagttgttagtgcttatgccaggtagctggaagacatctttgtgatatttatgaagatcagccctgttgggcaatcgttgcctctgccagaatgacttacccatttatctaataaagggaaacatctaaattcttgaacatgtaataattcacttgataaaattcaggtttttataaacaaatcatattaaaaccccaaaagttaattaacaggtgataaaccttgcttttacttccttgtcccatcacattcattcatagtcataatacactgacaattattgagtgcctttgatgtgccaaaagcacttgctaaatgctttgtttggaaagggatgtttgttaattggggtggtacctcccaaataatgaaacatacacacttttgttttattgaggatagggttttatcattccacagctgttccttgagtaagatccgggcttgaaaggccaagttcttctacaggggcggatctttgaggaggaagaggcaggtagctaggaagggctaggaggctacagaggttaaaagtggtctgagattagggagaatggctaaaagtgagtgagattttctctcgtgtgtgaataattgtaggaagagattctggacaacatatgcagaggaacaaatggagggatggtctttagtcagtggaagtggaaatccattggatcatccatgagcccatctgaaatcagcagcccgttaggtagaagcttgaaaaaaagaactgttgtgtttggtgaatatatcacgattttggagaatgatgagggcagaatcctgcatcctttctagctttcttgagaactttgtacgagagtcactcttaccatcatctaaatataagtgatgtgtcctgctgttaaggaattccaccatttgctagctagtggacataaatgggcatcttgttttcttttctttctttctttcttttttttttttttgagacggagttgcgctctgtcgcccaggctggagtgcagtggcctcccaaagtgctgagattgcaggtgtgagccaccgcaaccggctgcatctttttttctttattaattatttatatgtctggaagtctagatatatatttgtcttcgggaatggaaaggtaccaataggaaattttgagtaagccagagtattctagcaaatataggaattacgccaagaacagccagaattgcccagcactagtgataacctggtgaaaagaaagaccatcaatttatgtgttccaaaaatgatgtcagcattgcaagaggagagctgactgcgtaggctcatcctcatttctcaggagagtgtgcctgtaaatgaccaaccaattacaagcagatgataatgaagcaaaatgatgtaaatcaagatctgaggagtgacatttatggccaagacttgataaatatggaattggagaaagaagataggaaacaccagaggaggacagcaaggactgtagttttttttactgtggataagcccaactccctactgtggcattgaatcttggccaggcaatagtttgattgctgatttccttagaagggaaggattcttgtgtaggattaaagtaaaagtaattccatgacaacttgttactgaggaagacagccaaatacatatttcatgagtaagcaacagtcattttggtggaatatggtgtgttacgtaaagcttggtgctagattaatgcccaggtgaccacttggaggacaatcagtgtagccctgtgaaagatacaaagtattgcctgcctaagtctcagtttctttgtctgtaaaatgtgtgtttaagtggagctgtgagacaatgagaatatatgtaaggtgcctggcacttaacagttgttcagtttctctctcttgagcatcctcaaagctccttttattgatttctttgatgctgaaagaaagagaataaattttgactgcacgatgagcttcattttttgaaggtgctgattctcacccccatttccagctacattgactatcgttagccacttgttacccatctagtgaagccatcttctatagtgcagtgtgtgttagtaggaaaggcttatttggccttgaagggctcgtttggccttgatccggtactgattgtggtttgaggttgagcatgttaaggatgaatagtagctggaatggtccatgatgtgtgcttagtatccttcagaatgtttacatagtcatatttagattgcttctgagaacaagagaatacagaacaaaatgttatgttccaaataaagatcacaataagaagaaatattgcccttctagcttggcatcctttttctgccatgatttccctttgcattttcttcccataccttagctttagccaaggatacagcagtaagtgttgcttggtatttaatcaaattaaaacctgtgctaggtaatgcctcatagattttattttgccaagatagatgtttgaacggaaaaagaaatagtgtatattaaggactaaagggggtactcttgttttctttcaaatatgataattagtataaaactgtctttttcctgccagttggctcatctcatctcctagcagctgttttaaattccttaattgtctattgcttactcagctatcatttcacaaatttcctcactgccgcattttcgttgaagcaaattctgacagtgggggatgctcacctcacaggctgggttgagctgagttctagttatcctctttgagtaacaggattaactatcattagacagtgcattcgggtaaggtgatggttccctaggtctctttggagttgattactatagaaatgggcatctggtggagcctcaggttgccaattgcattactcttcattttactgatgtttcaattctgtttaacccaacgtagacttttttttatgcttataaagtaataggagtttcctagaggatttgcagcgtacactattgtataatctcattgcttataattttttttcagaatgaaggaagtgggtattttaaccatagcattttcattccagtatcattaaccatttaaatacactttgttaaatctatcacattttctgttaaaataatgtaaaattctagtagaaattttaacagtatcttactgtaaaaatactgtaggtaatagaccctgagataagacagtctgctgctttcagaagcatcaacacagagcattcctcaagcatttgatttaagtaaatattattgaagccttactaaattcaatttcagatattgtgctctttgatagcacaatgacagcttacatatgatgctttcaaatgtcatccacttatttctttttttttttttttttttttttttgagacagagtctcctctgttgcccaggctggagtgcagtggcgcaatctcggctcactgcaagctctgcctcccgggtttacaccattctcccacctcagcctccctagtagctgggactacaggtgctcgccaccatgcctggctaattttgtttttgtatttttagtagagacggggtttaaccatattagccaggatggtctcggtctcctgacctcatgatcctcccaccttggcctcccaaagtgctgggattataggcgtgagccaccacacccagcccacttatttcttaatgatgggaaaactggtaatacaagaccaaatttttgtttatacatcaaattatcaactttcatgtcttatttcatagtcatgcattgcaggaatgtgcgtactgcataaagtgacttgctttatcaggtttgaaattcataatacagtcagaagatgattaacagatttgttcaaatttttatgctacgatatgttcttgtccccatgtgaataaatgcaacagattgtttgtaaccattttaattgctctgattttacatggacaatagttttgtataagaaaagacaaaaaaggccaggcccggtggctcacaactgtaatcctagcactttgggaggccgaggtgggtggatcacttggggttaggagtttaaaaccagcctggctaacatggtaaaatcctgtctctactaaaaatacaaaaaaaaaaattagctaggcgtggtggtgggtgcctataatcccagctattcaggaggctgaggcaggggagaaagaaaaaaaaaaagaaaagagaaaagtagtcacttggtttaaatgcctggattttgaaacctaactccttgttttacctctgtagttttaggcaaatcacttaacttgattgaatctcagttactctcactataaaaatgggaccagtaataccttcttcaatgtgatcttgagaagattcactggaataatggtgaaagtaccctatcacagaatttatagtaggtgctaaaaatgttgtgtaccttcctttccttcccttagaaagacagtctcttttatttattgattgtacttttgccaccacagggggaaaaaaatccctgtttcttataaaactttctaggaaattcatgaatttagtgtgggccctctaattctgacaaatacaatattgattttgagtttgttgctttaaatttgccaaatgaaacgaaagttttacggttttccttttaagtcacttctgatatgtggagcaaacaagtctgtatttaatagtaagtagtttgctaattgcaaagcactaccaacttaacacaacttaaaatgagaagctgagagggggccagagcatgaaataagtaagtaggttaagaactgccacacagtccatcatgcttgcagagaagaatgtgagactgtccgaggctacagtgctggtcaccttagcctgtgtaaactctcactttctcagttatcagtggaagacaggggttaatccttattagtctgaacacatcacattgcaatgatctgaaagctaaagacatggcataaaggaactctgaagaaaccacctccactgagactgctgatgcttcgaatggaatttgggcagatggaatgctcatttaaggagcaaatgacatggacggggggagtcaaaatgataaagggagcctccttgcatttgttgtatcttacttctgtgtgagttctggcaaaaagcaagcatgactagaaccctagaaaaacaaccattaggtagatactagttatagtcaatcagagaaagccagtatgtgcgaagagagaagagaagaaaaccacatggtaaaaatgtaatcaaccagtgggattcttttagttcataattgtaatcatagatggcattccactacctttgtcttccatctggaccaagtatggctgtgtctagaggttctgttgtactatttctgtggtccttgaactctgatggcaacctaccttgacaaggccaaaaacctacacaactctgagcctttcttggtagtggcattatctaaacgtatgcatttgtaccttatcaggcttaatgagggaaaagaaacggcttttgaagacactaatgggaaattattataagtcaatgaagtaaaaatgcaaatagatttgtatcttaaaacaggaatactgctagaagctaaaactgagtaagatcttgctctgtgccaagcacatgctattttgcattaaaagagacccctgccttctacatagtatcctcattttacgggtagaaatcttgaggtttagagacgtaaagtaaagtaactcacctaaagttacatagctcatgagcaatgtggcagatgtttaaggacacctcgtctgatttcagcgcctaaatgaagagccttttacaaggatgatgatttttgcagcaacaagacaaagatgtccagcaataggaaaaagattgtaaagaaatgttaatccctgtagagggcactgttcagatttaactcatccaacataattttctaacatgataaagcagacctgcgccagctcctgactgtttcagataggtttgcctctggggaagaaagtgcagtgattcgtgtaacctactgtcagtgttatttaaatctcagacctaatctagaatttactttaataatcttttattattttcctgtatattcttatgatttctcccttctcaatgaataatgaatttagcataatgaattcagttagttctaggcttcttcatatctatatttaatattcaaagcactttcttctcttttattcctgatttaccaaaatctgtgattgtgccatgaaaagatgataaaggagaccatctcttggatctggaaagtgctgcgtgttagtttataactgggcaaatgtaagcataacgtttggccagggttgggtgcggtggctcacgcctgtaatcccagcactttgggaggtcaagatgggtagatctctttaggtcaggcatttgagaccagcctggccaacatggtgaaaccctgtctctactaaaaatacaaaaattagctggatgtggtgacagacacctgtaattccagctactcaggaggctgaggcaagagaatcacttgaacctgggaggcagaggtggcagtgaaccgagagtggcactgcactctaacctgggcgacagagcgagaccctgtctcaaaaataaataaataaataaaaaataaaaaaagtttgaccagaggactacctccattgtctttcttttctacaatccagtttagatactttctggactaaccataacttacatgcttgtccaggagtattggccagagttagagtggtcacattaattctaggcaagggtgaagatgaaggagtagagccatgtttccttgaaggacagtgatgatgctttttagagcttattacgtgtttgctatctctcccatcccaagcagtcaggggttttaactttgaagataataataactgtcttcagtgggtgaatttacatctgttttgacccaaaagataatttaggatgacttatggaatctgaagctaaatgtcaaatgtaattaaatgttactgttgtgtcttgccttaagaagagagctggtgagttctagcagggtttgggaactatttggattaactgctttgattctttcccacattatataagaggtgttatctcagacagcacagaaattgtccctgggggacagggaggcatcacatttcagaagtacctataatatttcttcagcatgtctttgggcctggctttctcaatatttctaccttttcttgaaatctccacttggatatggctctggaagatggcagaaacgccatcttaaaatatacataatatttttaagaaatcagttttgaaaaacaagaagtctcttttcctgacggtccttcctcaatatgcttaaattattgaataggaaagcttcagtaagacacaactattaacataagtgctaaggattaagaaaaagatctgtcacaaattatgtctgtctgtaggaaggtaaagttgtgcctttgatatgacacctacccctggaaatcatattcttttccaagatataaacccaaatcagaatagggagtgagctgttaatatgaatactgaatctggacaggcacggtggctcacgcctgtaatcccagcactttgggaggctgaggtgggcatatcccttgaggtcaggagttcaagaccagcctggccaacatggtgaaaccctgtctctactaaaaatacaaaagaaaattagtcgggcactgtgctgtgtatcagtagtcccggctacttgggaagctgaggcacaaaaatcgcttgaacttgggaggcagaggttgcagtgacccgagattgtgccgctgcactccagcctgcacgacacagtgaaattctgtctcaaagaacaaaacaaaaccaaaagaattctaaatctgctctgaatagtagaagacaatgggagacatttatctttggtagcaacatattccaaagacttaagagtttaaagaaatcatcattttcctatcgcttccttcctttctctctcaatcctaaaatactctctgggcaatcaatttcggaattctttcaaggaaaggaaaccttgattcgtctgcctgttaactactacaaaatgtgtagattcctgctcttccatgttactactcagagtaataacgaaacacctattattgtcattatctggagaaaagaagctcctatactggattaaatgatgttgctgtgcccataagaaaggcaggtattgggcagtaatgaaggtatggcagcaggaatttatactttgtctctttcatcagagtagctcccccctcccctttttatcctgtaggaggaaattgtggagtgagagaagaggtctgatctgtttggggaaaaagtatcacagcctattagttagaagcaatgaaattgagacagctttgggactccattaagtgtgtggtgtttaggcagactgtgtccctgggtaaagtgtgctgttgaagaggatagtacacaatgaaataattgggcttgggaaatcaactgggcttcagcagcctcatatctccttgtggggaatgggtgagggagctacagctttccctcccttcttttagcataaaagctataccgaataaaatagaagggaatttcttgctgagtagatggactgtgaatatattttgaataacacaaacaatggagataattaaattttgtctggcacaggaaggattcagagcatgtcacttggaaccccctcatgccatgttcttctctaggcgtctggatatatggttgcagcaactgaataaaaataactcagatttgatcagtaatggcagcatctatagggacatgttttaatgcactgatgtgtatgaaattaggttcttaaataaaacattattcctggatattttcatttcaaaggataagctgaaattcacgaacagtgtgaactagactgacttttcccactgagatttactgataggcaaacttttgtgcacattgtggacactggttgagggtaggctcactagttttggtactattaatggtcagttgcctgtagaacttgtgaagtaagaaaaggtatatctatagcaagttcaaggttcagataattgttgttctctcttaagaaaaaggttttgagcggttgtcttctttacacttagtgtatgtaatgatagtttggctaaatatgaagaagaaagagaaatagcattactactgtttattaataacttttctttgtgccacacatttagctattcaggcactttgtgtttgtgtgtatacatatacattctcttatatacatttgcgacatgtggtaaaaggccctactttttggagtcagaaattgtgctcatttctgtatctgccaccttgtagctgttggctcttgaacaacaactaagcctctactttgaacatcaattttctcagtaaaatgagggaactagactaaatagttgccaaaattcttagtccacacacacacacacacacacacacccattttgtacttctaaagacactggaaagaagtttacggatggaggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaatagataaaaccacaaagatggggaaaaaacagaacagaaaaactggaaactctaaaacgcagagcgcctctcctcctccaaaggaacgcagttcctcaccagcaacagaacaaagctggatggagaatgattttgacaagctgagagaagaaggcttcagacgatcaaattactctgagctacgggataacattcaaaccaaaggcaaagaagttgaaaactttgaaaaaaatttagaagaatgtataactagaataaccaatacagagaagtgcttaaaggagctgatggagctgaaaaccaaggctcgagaactaagtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaagggcaaccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatattctttgaaaccaacgagaacaaagacaccacataccagaatctctgggatgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaactcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagacatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatctctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaagaagtttacggataaaagaatgagaagtagactgacattgtacttttcattaacgtgttgaatgcctaaagaatggaaggaaaataagcttaaaattttgaatctatgataaagaaaactattgattaaccatatgcatatttgacattaaaataattcataattaggactaacagatttctggcttaaaaaatctaacaattactttaagaagcaaaagacatttccagaataaagtagggggatatatagaaaagttggtaccttttttaaacagagtcttcttttgtaaggaagtagaatttattcatcaaaggagatttatgaaaagtatggtggtatagtgagtggcctcactagttttaatgattgatatttgaatatagcttagtcttataacaactccccaaataaaaatttaaaattcatttgtatccctttgattttcagtgctaaaaactagattgtgaatgtcaaggaaatatttaagttatttctgaactaatgtatttgtagagagaagaagggagtgtgcacgtgatcgagaattatgttttgaaaataaatgaatgattggctattaaaaaaatttttaagccttaaaaaaaaaaaaaaaagacactgtataaatgttagttgtttgagcatttttgtatatacgtgtatgtccacacacatatacacaacattttaaaataacatcagttattttccctcttttatgtttttattttcctaataattcataccagtgatgtaagatagtggtacccagaccccataatctaagaggaatttgttgccatttgaacaaggaatgtgttgcctcattcatattttcaaaaggatataaatacattgttgtatatctttaggggaaatatatattcagtattttaaccagagttctcactgctgtgttcccacattgttaatatcaggtagtttgcctagatgttcacagtagaagtacagggatgtagaaacatggtctttcttcccaaagaagtcatttttctttaaaatttgtgaaataaatgaattaattgagtcagcctttaacatagtaatccattttgcattattcagctttgattgaaagagacagagaaaatatgttttgtcggggggtggggagaatgggagatagagatttctcagaattaacagggtgctctatagctcaataagaggccctgtatatacagcaggatagatttgtagttagttaaggaaatcttaagtctaaaggttgtaattcccttagaattcctgtaagttaattgtttttcccccactgtaatgcatacccttgaaaggcaggaaccttctgtttatcattgtatcccaagggcctatcataagcacctggtaaccaataaatgttgaactgatatatgaaattttcctgatcttagagattaagtattatcctcatggtctaggggaataaaacatccacacgtccaaaccatagtaattctgtttccatattctgctatctatgggtttcattattttaagtattctaaacttacagagagcaagactaatactttaaaattttattttggtctatagggaaaaaaaaaggttatttgagtttggtgactgtgtccatcactttggtttaccactgaattcacagcagatactaagaagtatctgcattgttttgtttggtttggttgggtttttaaaacagggtcttgctgtgtcacccaggctggagtgcagtggcatgatcatagcccactgcaacctcaaacccagagtgaatggatcttcctgcctcagcctcccaagaagctgggacttcaggaatgcaccatttgtgcctggctaatttttatttttttattttttgtagacatgggatctcactgtattgcccaggctggtcttgaactcttagcctcaggtgaccctcctgcctctgtctcctgagtagctgcaatcacttaatcctttaatagtcccaccaatctattattatctctgtttgacaacttatgaaactgaggtcagatagggcaaatgcagtcatgcaccatataacaacgtgtcagtcaacaacagaccacatatatagtggagatccaataaattataataacatatttttacagtacttttctgtatttagacacacaaatacttgccattatgttacagtactgtactacataggcaactatgctattcagtacagtaacatgctgtagaggtttgtagcctaggagcaataggctataccatagagcctaggtgtatagcagactgtacaatctaggtttttgtaagtatactctatgaagtttgcacagcaacgagatcacttaacaatacatttctcagaacgtatgcccattgttaagcaaagcgagactgtaattgacctaaggtcacacagttaacaagtagtgaggttttaaactaaggcctttgaccagtgctcttgatcattacagagtggtaccaacatggtagcataagctttaagaggagggaaaacttggttcccgtggctttatcagggaagacttcttagaggaggtagcagttaagctagcccttaaagaataagtcttatcttgaactgaatgtatgctagagtcagaattatagaggattagattcagaataaaaggccatctgtttcaagttcctaatttgcagaggagaaaactgggatctgtgaggttaaataacttgttgtaggacatatggctaattaagtggcattagaactgttctcttccctcctctatcctgtgttattccctgtccccctccgttaatgcacactagctcatgttaagtctgttttttcatcaacactttctaataagagttcctaaaaacattttacagcttgaaagtggaggctttcttgtgtatctatgtatggtgatgaggttaaaccaggaaagggtcagggcaggcatggaaggagatactagagatacgtggagacatggagagacagaccttttctatctgttttttgtttttttttcctagcattttactttattgttacatctgtttccttccataagtatagataattgagtgttgagagaaaggggacaaatgaaattctaatgagaaaaaaatgatttaaaattccacaaaatctatggaatttcagcctcttaagtaacctgggatgtttttaactttcactaatgtttattagccagtgtccttcctgccacccacctacaaggatgtctcaaggatgaaatgaggtcatatatgtgaatacacacttaggatacaactgccatgtattggcagtcttgtctgttccctgggcctacactgttccttgcctcaaaatgtagtactatcaggtagtgttgatgtttcattagccaagtggttatatcagatttatgtactgctaaacaattgatctgggacttgggtaaatactcattggaaaaacatttgttgtattctgagtgctccctgttaatcttctcctcctcagatagcaagctagatctgggacttaaggtggatttttttccttatttttttttcctttgttttacccaatgattgaaaatataaaactaaacctttttcagtaaagtctgaatcagcagatacttacattactttggcataggctttttatagactagctagaagaatacagtaattagcatatgcatttcctcattaaaatgtcattagtgaaggctttgttcttttaaggtccttcaaataaggtttattgcattgcattccatcactaatattttaccaggagtcagatatcttacttaggtgtgttgaagcaagggttactttggactttctatagggtaatgacctaagagcagacctggacacacataaatctctatgcttacattgggtgggccctactttatgtactagtaataattaccagtctcttctcacactgtccattcagaatcctttggatatatagacatttagcaaacctagacttgtttgaaagaataaactgttatctgcactaaactgttttccttggttatcttggtaggatttgatttgaaaaaaatgtatgaagaattagaagaaaagaaatttataatgtactataatcatttgagatacagtattatgcaggagtaagaatacaggctttagaatcagaccattgaggattcaaattcttgcttcatcatttactggttgtgtaactttgtgatacttagcctttataaacctcaattgtctgaatgtaatacggaaatatgagtggtccataccttataggaatgtttgagaattcagttagattatgcatgtaaagtatttagcactgctgcctggaatatatgatctattattacattaccggctgggcatggtggctcacgcctgtattcccagcactttgggaggccgaggagggtggatcacctgagctcaagggtttgagaccagcctgaccaacatggtgaaaccccatctctactaaatataaaaaattagccgggcatggtggtgcatgcctgtaatcccagatacttgggaggctgaggcaggagaatcgcttgaacccaggaggcagaggttgtagggagtcgagattgcgccattgcactccagcctgggcaacaagagtgaaactccatctcaaaaaaaaaaaaaaaaaaaaaaaccaacaaaaaattatctttataatagaaaaaaggagtgtgtgtattttcatatgtattgtatctgctttctacacatctttgacttaagaaatcctaacatgaaatttcaaaacaagtaagaaggtatttaaggagtggtcattaatatcattaattggcttaaggcaaactttctttaaaaagtcacacacatggtgtattcaaaataaactacttcacttaatcattttaacatttctgctatgcagcgtgactagcaacttgaaggagcaagttaggaaatgcctttgatgaccccatgacatcactatgttattaaataactggaaataaactgaaaattatgggatagtctttaaggctttcatgacatttcagcattttagggttgcagtattccaaggacttttagagtaattgcatgtcatcctttgtgtgttgtgggcaaatttgggttagctaaaagttggtcagttaaaaaaaatttatattaagcatctactctgagccaggcattgttcttttttgctgtgaatatagtgctgaacaagaacagaagccttgctgtcaaagacgtaacattccagggtaagaaaatagataactcataaagaaggaaatgattaattcagatacttgtgaggctatggagaagataacctaggctaacgtgatagagatgggtggtgaggatgtgagttaaggggaggccttttgcaggttgttgggaggagatgcaagtgttccaagcagaagaaagaagaagtacaaagtccctgatacactaacaatcttggtgtgttcaagggacaggaaaaaggccggtgtggctggaatttggtgttcaaagcaagagaggagagataaaggaagatgagtcatgcagagccttttgaaggctgtgggtaaaatgtatgttatacggaacttagttctaaatctagttgcagtggattaacctggagagtgatgcaaactgagttttactctggaaaaacactgtgactgttgtgtggagaatatgctcccaagtgtagaaactagatcaccttgcatgggccaagagagatggtggtagtttaagactaggattgtagcagtgaaatgtaaagtggttgcattcggacatattttggatagagatttgacaggaggtaggtggattggacatgggatgtaaagtaaaaagaggaagcaaggatgacttccaggagtttagcttgagcagctggatggctgatatcatgtgtaggcatagggaaaggttgtatgaggaagaatttatagggtgtgagggtgtgaagcagggaataattttgttttgacatgttatgaaagaaatgccaattgacggctaagaaaagatgtcatctgggcaggtaaagaatctaggagattgggaaaatgtccagcgtggaggtataaatgtgaaaaccatcagcatatgggattgaaagctatggggctgtttggattccctaggaagagaatataaataaagaagggggctgagaacagagtctcatttataatatcctgataaggaagaagacccagtgaaggagatgaagaaggagaagccagtgatgtaacacaagcatggatcatggcaaaagagaaaaaggtgtttcataaacaaggatgcttggtatggccacctgtgtcagtactgtgaagttgaatatgatcaggacaaataatattaattggggctttatatttctcctttactacaaccgattaatgaaacaaaaaattaacctagcacccaaggtgtttcttatagttggtctctccagtctgttttagtatcatttgttagttatttccccaaactaatgtttagcttctttctccaaaaagaatatattttttttcctggttctgcttgttggaatccccccctccaccatgatataaaagtaatggggcttattgtaagaaaacagaaaatacaagaaaataagggacaagatttttaaaaatggattcaattctgggaacaacaaatgacattggggtataggaattaaaccgtgtgcattctgtctctcaccccaattttatagtcatttgctggggaccttttctccccagggtacttgcatagcttttgtcaagaataacccttctcacttccccacctccttcttctacatgcagatgcagcacttttctgggtaaagttttagcaatgccttccttctaaaatgaaagcattttctcctcacgattagcatctgtttatagaatagttcgtattttcgtaattagatcctgcatagaaatgcaaaggctgctgtgtaaaaggataatgaatctttattgcacagttgaaatcagatttgtgcaaaaggcactttgaaaacagtaataagcagagacatgtattaaatcacccagataaggcacccactttatattttctatttataaatggaaattatgactacccagtggattccatatgacatttcctattaccagcaaaggtttttagctttgaccataaaagttatctaaattcaaaagcctctgtggattcatggctctaagaatacttctggaaggggccaagacagagtggaaagggtcctttgtctttttcttttgtgtgtgtatgcactctgcagaggggaaggttagcaagtggtagaagaaagaagccatttgaaataaccatgataagatctaatcaggaaacccagtgtccattacacacatgtggtaacattttaagactcttctggttgggctccttgagaaccaagctcgtgttcttataagctcatccttatattttcccattgtatgcatcgttgcatggcaaacacaggatttattcccaagctaaacctgtctcttggggtttcttatcttttacctccttggtgagcctcgggaagctagagcattgctctatggagaaaggagggtggcattgggaggaagggtaggaaaaacattattgggaagcagagaaagtcaatgtcaaatgaactgccaaggatgaatattatggctgctgggagcctcggagagtatcgtgtgtcttatgtgtctatttcacagtcggtgcttcatgtgagatggcagtctcgcctggaccgtgcttagtatcgatttactctcaggcatgccagaccattttagcattgctgaaggaaggaaatcctatgtatttccccttataaacagacatatcaaaagtgtatcttttaaacctttttctttctgtcttcttactgttctttctgtcttactgtaactcctcctccctccctgatttaaaagaatttttttttttttttttaaaagaaaaaagactttctggccgggcgcggtggttcacgcctataatcccagcactttgggaggcagaagcgggcggatcacgaggtcaggagattaagaccatcctgattaacatggtgaaaccccgtctctactaaaaatacaaaaaattagccggatgtggtggtgggcgcctgtagtcccagctactcggaaggctgaggcaggagaatggcgtcaacctgggaggcggaggttgcagtgagccgagatcgcgccactgcactccagcctgggtgacagagcgagactctgtctcaaagaaaaaaaaagaaaaaaagaaaaaagactttcttattaagagagcattatacaggccaggcgcggtggctcatgcctgtaatctcagcactttgggaggccgaggcaggtggatcacgaggtcaggagatcgagaccatcctggctaacatggtgaaatcccgtctctactaaaaatacaaaaaattagcggggcgtgatggcgggcgtctgtagtcccagctactcgggcggctgaggcaggagaatggagtgagcctgggaggcggagcttgcagcgagctgagatctcaccactgcactccagcctgggcaacagagcgagactccgtctcaaagagagagagagacagcattatacagagaacaaattgagtagacttttttagaatgatagagtgtcagtaactactcatacctgtgggggaaagaaaaaggcttcaaactttgcacacttctagcccttccatgaaaatagaaggaccttatttgaggctagttttgtggtggtgggatctgagcactgctgagtgttaacaaaagggaataaattgatgccaaatttagagaccaaaaatgccatcattttcacctgcctgaactcttctgttgttttccctagttgctgccttgcgctttttccgcagtacagggagagaaatcagttgtctggctgtctaaactcacggcatctgcttagcagtttcaccagctcatagttgggactcatccctctgtcagaatcctttgctccattagaagggagactgggaccacgttcctgaattgatttgcatacttctacgttacctagctcagacaacatatggccatgtggagcacttggatttatttctgtttcctcaaattaaattcctaaaaaattggataactccacagtttgtttggtgttacaaaaaattttagttccttttttggtcggcaaagcaacacaattttggcattaaaaaaaaatctctggattactttaaaaagagtgttgatttgatttgcttcccctcttctcttacccctttcaggaaaaaaaaaaatgtatgttgaatcttaaaacactgcatcatgttgcaaaatgtccatttaggcacactgaatagaaagtatcatcgagtcatttttattcttgtaattcagtaatcttgtatcttttgcctttttctttttccttaatgttaattgtgtaactaaatgtctcaaacttgggacttttcactttacacatccatgtgtaaaaatacatagatacatacagtcagatagaagaaataagactcagtgttaatagatcagtggttggggtgggggaactatacttaacaatagtatgttgtacatttcacagtagccaaaagagaacaattcaaatgttcttaacataaagaaaagataaatatatcaggtgataggcattctaattactctgatttgatcttcccacattatataaatgtatcaaattatcacgtactccccattaataatactgtatatcaacgaatttttttaaaaaaagaaatagatatcatacaatgaataactggattaatgtgaaatgatagaaaaagttaccattttaggctggatgtggtgacccacgcctgtaataccagtactttgtgagtctgaggcagtaggattgcttgaggccaggagtttgagaccagcctggttaacgatacaagaccccctttctaaaaaaaaaaaaaaaaaagccaagtgcagcagcatatgcctgtagtcccaactactgagggcatagaggtaggaggatcatggatcactggatcacttgaggagtttgaagttgcaggaagctatgatcctatcactgcactccagccgaggtgacagagcagcaagaccctgtctcaaaaaaaaaaaaaaaagttactattttaaatgcacttcaactttgaacagtactaatgtatgaaaatcatcttgtcttctttaggaaattctttgttgcctaaattagggataggtatcatacactggaatgagctctaaaacgatggctcttgctatgggaaacagttttatttgggtactcatgtcttctctcttaagggatcttaggaagaggctacatggtaaagaagaaatagcatgggctttagagtcaagaggcctgagttttaattctcaggctttatttgtccttctgcagtggccttagcaaatattataacctccctaaagttagagttattgtaattgtcgtacatacaatgttatcataagaaaacagtgagataacagatatcaaagtacctgggcagtgtttgacacttggtggtctataaatataaatatcatttcattcctgaaggtaactgcagcacttttgaaaggctggtttgatgctaacacaggaggattagacctaattatatatttctaaggtcttagaaatggggagctaggtttttcagacaatatactgtattttgtttttcctcccttttgctttaaaacagaaggcaatttgtttcaaactctgtgctccaaactggtggcttaattaggcaagtttattgactgtcacagaggctgtggttaaaaactggcaaatatcatgtgactatattagtatctctgagcaaataaagggaaaagacaggattccacccaaccacatttttttctttctcttttctcccaagctcattcttgcactgcaacattccacttataatctgttaattaaatcatttcactccattttatataatttttaatttagcattcattttcaacttagcttttggcttcatttactgataataaacagtgttgcatacaacacatgttccacaaaacactcagtcacacacatacagatgccaataattttttccagtatgtcaggcatattaaaattaaaggcagcatctcccctcaccctttccattactgaatgtgcaccctgtttgaataatacatactccccgacagccagcagtggtctaatgtgtaaaaattatgtgtagcgtgtcactagtacctttttttaaattcgtggttttctcagacatgctctgtggaaggtttctggaatggtcacttcgataccttggatctgtatatttggcttaatgtatacaaacagtaatattttctagacttattactttatgggtttatagctatgtgatagttattgagaaagaaaactctagtgtagcattcaaattacttttcttgtagcttattttttgaatcatagtctgaattctaaatatatgaatatctttaaccgtagatgatatccagaagtttccaagactgcaagctcaggggtttatggaccacttttaaaagatagatactaagccaggcacagtggctcacgccagtaatgccagcactttgagcaagcaagatggactgatcccttgaggccaggagttcaagactagcctgggcaacatactgagaccccgtctctacaaaaagtacaaaaattagctaggtgcggtgacatcttttagtcctagctactcaggaggctgagaggagaatcactggagtccaggagtttgaggctgcagtgaggtatgatcatgccactgcagtccagcctgggtaacagagtaagaccctttctctaaagaaaataaaaataaaacatagatacctgtgttgttgttatagctgttcatatccttagaattaatttaccttgtctgctcctgcatattatttgtctcctcataattagcaaagttccacagggccagatatcaccaaatatgaatagtagattttattctaaggtcagtgagaactgaagaatgttaggggctgactcaatcagatttgtttgtatttatatttggaaaaatattactctccggagaatgttttggaatgtttggcagggtggttggagagacatactacaggaaagaaatgatggtaacttagttggcagtgggaaaagtgagtagtgaattactcagagctctttgggggtgaaatggactggacttatatcagttgaacttgagaaaaggagaagcatcaaggatgatgtaacttttaggtttctggcttgagcagttgtgtaggtggtagtaatttttcatggtgaagatgatgaaatactttttgtacctgtctcatgattgctttctgtacatcaaggtcagaggtcataagctcataaaatgcttggtattagaattcttacataaaggatgtcttctgttttagtttagtaatacaatttggcttaaatcacagactttctctaatctttgttttgattgtcatctgccgagagcttaagacagcaactcacaggttggcccattgagaatctgacaaatgaaaaattataaaaaaaattcagaatccctatattgtagcccaactttctttagcacttctatccttgaatgctagggcagtgttgtatactgtgaagatctttgtagatttttctactctgtaacattttaatagttccattttggggtattacagctgttcagtcctccccatacctcaaattatagttagtctccttcaagtcccaaatttccagtgtacatatgtttcatcttatgtttaatctggacagagtgttggaacgaaatatggaccctgaaaggtgtatgacgggcttgaagtctcagccctactacttgcttaatgtttgatttgctaatccaaacaattataatctgttaattaaatcatttcactccatttcatataatttttaatttagcattcattttcaacttagcagatgctcctggtgtcccacccatacccctctttcccttccactttagttcacaatggccctccttcctcccgctaggccttatattcattcatcttcagggtttgtctagtcaatgaattctgctttgcctaaggagtaggcaggaagtaggtgaaatgaactgctacctgagcaacccacagtcaatgactaatgagagttgttgtataaatacaccagcttccttgcttcttaagtgggataactttgaggtatacattctacactggcttccggagtcctcccagtggcatttgcttctagttgcccatagtggtagttggctgaataattacataccctttattccctgtctgctgtcatgatcttactttcccagtctcctgctattgtttacctcctaaataaacttctcattgtctgcttctgggagaaccccagactaagacaaccactgcgaacattggtttcctcatctttatttattattactgttttttgagacagaatcttgcgctgtcacccaggctggagtgcagtggcacgatctcagctcactgtgacctccacctcccaggttcaagcaattttcgtgtttctgtgggacgtcttacataggcgtattttttttttccggctactaccactatttggactaattattctgaaattttacttgccaagtttcagcttttattagcaagaaaaaatgttatgtccacagtttagaataaaatcacagagaagaaaagttggatgaggatattggtttgcagtcttctgtctgtgtttctgtcttctgagcattcacagatgttcctatccttctttccactggtgttcacataacctgggatcttgtgttgtatgcagtcactctcaaggtaggaactggaagataaagtatgtgggtgacatggactacttagaaggaaactgaagtttacatgttgagcccaattagaagcagctgaagagaggagagaaaaaattaactgagaagtttaataggcacttagagcatggcgaataaagctgagtggcacccacttttcatttcctagttcattctagttgtgcttttttaactgcaaagactaaaaaacgaaagcctttatttcccagtctgtcttgcagctaggattctgggtgtgaatcaggtatatttgctcaagatttggaaggtcgacatgaggtaaaggttattcatcttcagctttagctctttttatctgattagccagggcaggagaagtatgatttttctgtggtgatgtttcagttttcaactcagcttcctagatgttgaaaggcagttatgatgcgatttcctgatcccaggttgcagcttcgctagtgcatttgtagctgggctgctgcaacaatggacttctgtttatggcagaagaaaggccatactttaaccttgtctagtgattttttgtaagaggttggttctctgtattaaatcacttcctacagaaaatttcttaagtgttttctggtttttgtttgtttgtttgtttgtttttaccagaaccctaactgatatagatggttgaagcaaactttatgctgtaaaggtccagacccagataaaaacgagagacaggaaagatgcagcaagatggtctgcaggcctgcccatgcatacactactccatgatctggtgtctgcaagaaaacaaagcaactgctcattaagtaacagggcagctaatgctttagctcttgaggccctgtgtcatataacttctaattcctctaattcatccaccaagggggcagtgaggcagttctctgtttgaatgctacatcgtttctgacttagtgctttgaagtggatgacatcttacttttttttcttatcttagagataaggtgaacagaggaaaaggagaatgatttgcccaacctttggctaaaggagaaaggaaagatttagagtccagtgcttctgacttccctctgatgcggtaacaaggataatatgagtatctaatatgctggggcacagtaagatggctctgaaggtatgcacagtagagaaagccatggtccttgccctcagggtctgtgatcggccactgaggcacacatttccacttcctgtgttccattaattatgctaattttccaacaagccccagccccacctctgtcaattatttttgtctcagccttctaattacaacattatatgaccattcagactggtactaattaaatcattacttaattcacaaagtgtgcgataatgctaatgcttcttgtcagctgaaattacaacatggcacctactttcttcattcttggtagatggggccagggggttgctcttttaccaaacatcttttgcttaccctctgatagccacctgaccatcagccagaacctaccttcttccagaactgggaaaacagtgcagtagacctagcgatatgtacctgtaattcatcactatcatatgaaatcatcatcccagttttgtttgtggagtaaatcttgatactcaagaaaaaaaaatagtagtaagatttagagtactatttgctacattttttgtcatttgttctgcgtattatttttaacagagtaaacagtagcttgtctctttttctcatttctaaaacagatttgttttccactcaattagacttgtgatcacgagaacacaaagtagtatttttctccttctggagagagacataccgtatgatgggcaaattgtcaggaataattataccaaatgatggaataaaatccaatggaaaacatctctctcattgctagtgatacatttttatttaagacacaatgagcatcaagcacatttatgacaaggtgaaattgacaagtggccctctgccatgattttatttttaattgctagtaaactaattagccagaacaacatgttgtataatccacaaaactgtcgctcatgcgttctccaataaaagcaagatatatgatgtggaaaagttctctaagagctagccaaaaaaaaaattatttcagaattttgagtgtatagacatcacagtaaaagatgtctcctcaccagtggaagaacatttgtatataacatttgttttgagatctgaacagaaattaaggacaaacagtaaatttttttcttttccttttttttttttttttgagagagagtctcgctctgttgcctaggctggagtgcagtggcatgatcttggctcactgcagcctctgcctcccgggttcaagcgattctcctaccgcagcctctcaaatagctgggattacaggtgcttaccaccatacccagctaatttttgtatttttagtagagacagggtttcaccacattggtcaggctgatctcgaactcctgacctcttgatccacccgcctcggcctcccaaagtgctgggattacaggtgtgagccactgtacccagcctgttttttccctttttaagatcaaagtatgcatcaaaatagccaaccactttcttacatgtaattaagttttatgtagttgagtcacattaagtctaagacatacattctaggactaagactttacagtcattcagtagttacttatttgtgcaaggcttggcaaccttttcctttaaagggacagataatacatatttttgtctttgtgggctgttcagtctttgccacaaccactcagctctgatgtagagcagccgcagtcatagataacgcaaaaataaatgtggcagtgttccaataaaactttatttatggacacaaaaatttgattttatgtaatttttatttgtcacaaaagataattctttgatttttttcaatcatttaaaaatataaaagccattcttagctcatgggttatacaaaaggcaggggtgtggatttggcctacaggctgtagttgccaacctttcctctgtacctgctgcatgccagcgtcactcctcattctttagtatcagacgtgtgttaggcagggtgctaagcatcgagggatattcagagatagagcaaagtcccttccctgatgaagcttacagttaagctagaaaggaaccatagatgggacagagacacataatattagatgttaaatggtgtccctctgtgacaaaagccaccattgctttacaagtttaagagagagggaagtcacttcagctgatttaggtgatctgctaagtaagacatgacctggctagctacggatgcatggaaatgatgggatatcagctggatcctgaagaaaaaggctgtggacctttgaaaaggtaacagggcataatgcctccttttagaggaagggggaactgaggatggcgaaaatgtcaaccatgagtcacttattcctatcatttttcccccaattctttctttcatgtcttctcatgaaaatttcaaacatatagcagttttaaagaatgttacagttaatacccaaatactcaccatatagattctaccattactattttgctatactgttttattgtatatctatcctatcctcttttgttttagaattctggtctcgctctgtcacccaggctggagtgcagtggtcactacagcctgcaactgctgggctctgcctcctgagtggccaggaccctatgtgtgtttcaccaccatgtttggctaattgtaaataatgttttgtagagatgaagtctcactatgttgcccagagtggtctcaaactcctgggctcaagctgtccccctgtctcagcctcctgcattgttgggattacaggcatgagccaccacacctggctgctttattatatatctgtccttctgtctattcattaatccattttatttttggtttattttaaattaaatttcagacatcaagatacattttcataaatatttaagcatgcatatcattaactaaaatttaatgttggcttatagtttttcttcttttggtgtaaaatttatatacaattaatcgtaccaacattaaatgtacattctctgagatttggaaaggctgatccttttgtagcctaaattggaagatacataaagttttcatcacctcaggaagttccttctgtcagtccttgcccccagcctacccctggaggaaccactactctaattttctctgctttaggttagtttgcctgttctagaatttcagagaaatggaatcatacagaacctatcattcggtgactcacgcctgtattcccagtactttgggaggctgaggtgggcagatcacctgaggtcaggagtttgaggccagcttggccaacatggcgaaacctcgcctctactaaaaatataaaaattagccgagcgtggtggtgggcatctgtaatcccagctactcgggaggctgaggccggagaattacttgaacctgggaggcagggattgcagtgagccgaaatcatgccattgcactccagcctaggtgacaagagcagaactgtgtctcaaaaaaataataataaataaagaatctatcatttgggtttggctttttatcatcatatattttgtctttacttgcttagtatctagcaagaatataaatgcaattattttgccagagaaaagtatatgtttgattaaggaaaacataaaatacaactttgtttaaatatctgtatgtatattcttaaattattgtaaaattaaattacctatggattaaatttttcacattaacattacttagtctattatgctccagcattttacatatttatgttatttaattaaaatctttgcagtagatatttcccattttgaagaagaggaaactaagacagcgaataaaataataaacaatattatttcttacctcttactgttgccacttcagtgtcagggaggaagagggatagcaaatgtaggaagggtgtttgcaaggtgagtgaaggtgaagctgctttgttacaagttttcttatcaagaaatggatagaacataggagtagagaagttcaataggaacatgcaaaatttgtctattgtaaaagaaggaagaaaactggagaatttaaggactattttttaacatctatgattaaaatattatgaaacaatatctttttaaaaagtgatatttttcctctagtataacacaagttgttagaaactaaggaatcaccctatcttctttagtaaaagcctacaactggtagagtttttttttttttaaggatctcaagatacttcatgaacctcaaaagactttaagttctctgcaatgttaggaaatgacttcatgaatatcacagttcaaggttctgctactgcttttagaagcccccaaagtgtgaagacatctagtacagtatacagtaagaggagaactggcttttattgctcacaataggaatgttcccatctatctgtttgcaaaccaactcataaaatatttgaatattcttcactctgctttatgataatatttcttggcttggaaatttgctttttttttttttttttgagacaaagtctcgccctgtcacccaggctggagtgcaatggcgtgatctcagctcactgcaacctctgcctcttgggttcaggcggttctcctgcctcagtctcctgagtagctgggattacaggtgcccgccaccacacccggctaattttttgtatttttagtagagacggggtttcaccatgttggccaggctggtcttgaattcctaaccttgtgatcctcctgccttggcctcccaaagtgctgtgattacaggtgtgagccactgcgcctggctgaaatttgcattttcattaatagatcatccttatttaacaatgaacttcctatgtgtttgtgacacatggaaaataagtaggcagcatttaatgtcatttgggaagcagtgcttatagtagttcggtttacattcctcatacagccatgtgccgtatagtgatgtttccatcaatgactgcatatgcaacagagtcccacgagattataatggagctgaaaaattcctattgcctcatgacatcatagcctggtaaggttatagtgcaacaaattactctcacttctgtgctgatgctggtgtaaacaaacctactgcgctgccagttgtataaaagtacagcatatacagttatatacggtatataatacttgatagtaaaagactatgttactggtttatgtatttactatactgtaattttacacttattttagtgtagtccttctactagttaaaaagaaaaaagttaactttagaacatctcaggcaggttcttcaggaagtatttcagaagaggcattgttatcataggggatggtagctccatgcatgttattgcccctgaagaccttgcagtgtgacaagatgtgcagctggaagacagtgttattgatgatcctgttcctgtgtagtcctcggctagtgtgcatgtttgtatctttgtttttttttttttttggttggtttgtttcttagaaggggtcttgctattttgcccaggctagtcttgaactcctgggctcagtggtcctcttacctcagcctcccaagtatctgggattacccacatgcaccactgcacctgtctgtgtcatagtttttaacaaaaacatttataaagtaggccatgtgcagtggctcacgcctgtaatcccaacattttaagaggctgaggcaggtggatcacttgagcccaggagttcaagatcagcctgtgcaatgtggtgaaatcttgtctctacaaaaaatacaaaaattaagtgggcatgatggtgtgtgcctgtagactcagctactctggaagctgaggtgtgaggatcacttgagctcaggaagtagaggctgcagtgaactgagatagtgccactgctatccagagtgaagccctgtctcaaagtataatacaatacaatacagtacagtacaatacaatacaatacaatacaatacaatacaatacaatacaatacaatacaatacaatacaatacaatataataccatacaatacaatttaataaaagaaaggttatagaatatggatataaaggaagaaagtatttttatacagctgtacatttttaagctaaatgttattaaaaaggattcaaaatttgaacaatatataaagtaaaaaacattacagtaggctaaggttaatttgttattgaagaaagaaatttttaaataattttagtgtaaccaacatgtacaatgtttataacatctacagtagtatacaataatgtcctaggccttcacattcatgcactgctcactcactcactcacctagagctacttccagtcctgtaagctccattcatggtaagtgccctatacaggtgtaccattttttaatcttttatactatatttttattacgtcttttctgagtttagatatgtttagatacacaaatacttgccatcaggttacagttgcctacagtattcagtacagtcacatgcaagtttatagcctaggagcaataggttatgctatgttgcctaggtgtatagtaggctataccatttaggtttgtcgaagtgtattctatgagttcatacaatgacagaatcatctaatgacacatttctcagaacatattcccatcgttaagcaacacatgactgtgcttagtcttctacacaggcttagtcttccttgttaattgaaactctatgtttcttctcagtttaagaagcttatttcaggactaattttcccccttttagaataagtttcccacatcacttggttacatgacaaaacaagttaaatcactgtccctttttgggtttaatatgtccagatgcaaattaaagaaataaaatcccttagatttttctgtatcttgtctcccttcctcattttctgcagaacagtttttaaaagttaatttaggaaatctccaaaatattagattagcatgacttcagagctataaggttcctgaaaagtttatgtagaaatgttgtttttagtgctttaatttctcttatagcatcttgatgggtagtcattctgcctaaaggagaactgaactcatcctgtgtcccaggagctttgtcatatgaaaagttgtaatccattctggtgcttcagatgttgaaggcccagtgaaattctacaagatggctgccacttgagctttggccttgcaagtggttaggaagatgttggtcctttaatctctgtacaggggttcagaagtagttgatagtttactaatgaaaaatgttatatgtagcaaaacacaagcaaaaaaatcaaaaacactgatgacttatataaattattaacttaaggaagattatggtacttgaaaaattattttacaaaaaaagattgtattaggaattttttctgctcttttttctcaagttagtaccaatgtaacatggctgtgttcatgtaatttcttttctcaatttggttcaagatttgtgtagctcccagtggtagattttgcggttgtattgcatgattaaagtgtccatcaaaatcttacagttggtaaacagtattaaaaatccatctccagcctctgtaaactgtacagagagctatgaatactagaagaaatggaagtattttaattaacccaagtaggactaatcaaagcagagcaaccagtttattcaattgaacatgtaaatgtctattcattcttgacatggcagaacatttatgtcatctattaaaagctattctgttgcttgtatgattataagctattgttcaacggggaactgaatcttgtaaaggcttccccaccccactttttgtttttttgagagggagtctcactctgtcacccagtctggagtacagtagagcaatcttggctcactgcaagctccacctcccaggttcatgccattctcttgcctcagcctcagcctcccaagtagctgggactacaggcgcccaccaccatgcccggctaattttttttttttttttttgtattttcagtagagatggggtttcactgtgttactcaggatggtctcaatctcctgaccttgtgatccgccctccttggcctgctgaagtgctgggattagagtcgtgagccaccatacctggcccccccttttaataattacatattacagattattttttaacatgctttttgctgtattcaggccacttcagataacccagcttcttgcatgaaagaatacagacttgggtaacttggttcagctaccctgccatcacctctttccttcaaagggttttctcttcttcatttcttcataataattcttagtaaatatctactacatgctgggtacatgtattctaagcatgttatatgcagtatatcatttaatttttgcaactatattgttattttttccattgtatgatgaagacatggaggaagagtgttgcatagtgctgtaagtggtagaaataggatatgaacacaaatctcagaagatccattgtgttgaaatgaatttgagttgtaccaaaggtgattgacattagacaccaggaagaaatttttgaaatgagtggatgctctaaggagccttttaagtgagtacagctaaaaggggttggggtgaaggtagtttcctgggattttttattaccattaagacacgtaaaaacagtttgtataaaatcccatttttcatgaattagttacattcttaccttgagccaggaagttaaactagatggctgtctgaagacccgggtaatacatttaatacagtcttatatgtgtataaaaagtggaaacaatgattcttttaacttttaaatatgaatttttattgcaacaacaattagaaaatataaataatacttacacccctgccattctaatgtaacacttagttttgggcctacttttttctggtcacttttctcatgcatttaaaaaaaaaaaaacaacctttttaaaggttttaaaaacgtttcttaaaatgtagtgtattatatttatgcccaaaaatctatccatgttaagcatataattcaatgagttttagtaaatttgcagagatttgtaaccatcaccacaatatgatacagaacatttgcatcattccagaaaggttcatgagcagtctctcttcttctccattctttgatttcttaaggtggaagtgtctgttactggtttactgtttcttcctttccaacataggtgtttatggaacttctttagctgaagtcatgaaaatttgtatattctatttttatttctattccgttcaaaatatcttctgatcgctcatgtgattcattctcttaactcattggctatttagaagtctattgacatatttcaaaatatttgtgaatttcccagattttcttgttgtttgtttctaatttaattagcaatacagaaaatatactttatgtgatattagtcattttaaatttatagatagttatggcctagcatatgatctattttgatgatgtaccatgtgtgcttaaaaggagtatgtactatactcatttggggtggagtgttcttaggtcagtttgtttgatagtgttggtcaagtctactatattcttgttggttttctatctaggtgtcctgtttattatttagagtggtatatcacagtctccagttatttttgcattgtttgtgtctccctttagttccgttagattttgctccatctgtttcggggtttgtagttaggtatatccatgtatatcattgtatcttcttggtgggtagacccttttatcattataaaatctctttgtctctagtaacagttttgctttaaagtctgttttgtcggacagtattctctctcccctttattattaaactacatttaatttgtattaaactacatttattgttcacatactgtttttcaatcttttttaaacttatttttgcatttgtatgtaaaatgtatcgcttttagaaagcatatcattgggtctcttttgaaaaaaatccagtctaacaatctcttttttttgaattttaaatttatttatagttaatattattattgatttgattggatttatgtctccattttgattttcatctttttttgttcagttgattttcctttactgcttcttttgtaactaaataggtgtgttttagtgtatcatttttattacttagttcatttttgctctatgaaaatatttttttctgaatgggttagggtttatacatgcattctaccttaacacagtctattttagtttaatactgactttgtattaaactttgtcagtttaataatgactttgtattaaagtctgtgcagtagtatgcacaaactttgcttcactatagatccatgtcaccatcttttatagctattattatcacatacatctatatatcttatatacccaacaatgcagtattgtaattattgctttgtataacctatgcttaaagaagttaagacaaagacaagaaaatagaaaaatgtatgtatgatttctttcaacatataaaaacctatatgcttactgtttccattactcttcattttttaaatgtggaattgatttatggcttggtagcatttctttggcacacataactatattctttctctctttctttgtgctactattattatatatattaatctttctatattatatgtcctacaacacaattttacaagtactgatttatgtagctcttttttaaatcgttagagacaagaaaagacaaaaattatatagcctcctatagttacctacatagttacctttaacaatgtttatttttcttcatgtggatttgaattaaggtctgttgtcattttgtttaatcctaatgaactttatgttttgtaaagcaggtgtgctaacagtgaattctttcagtctttaataggggatttcttaattttgccttcattttgaggaatatttttgctagatacagaaattttggttgacatctatttgtttctttgagcacttgaagacatcctcccactgtcttctgccttccattatttctgattggaagttggctgttcatcttattttgggtgccttgtacatagtgagtcatttttacccttgatactttctagatctcctctttttctttgcctttcaacagttatatatgaaatgtgtagatgtggatctctttgtgtttatcctacttagaattatttgataattttggaagtttagattaatgtttttcattaaattgggggaggtttttaccattatttcttcaaatactttttcagaacctttttctcctcttcttggaatctccattatgtgtgtgtttgttatatttgaggtgtgctacaggtctgttatgttctgtttattttcttcattttttccccctgttcttcagatttacaacctggatcaatctgtgttgaaatgcactgattctttcttctgccgttcaaatctcctggtgaggttctctagtgaattttttatttgttactgtactttcagatttcagaatgtccaattggttctatttaagaatttctacccttttattgctattctctatttgatgaattatgacatcatgcttcccattaaatctccaaactttttcggaaggggatctttgaatgtgtttataacagctgatttgaagtctttttctgttgagtccatcatgtaggctccctcagagatagtatctattgacttttttttccttttggaatggtaaaattttaattttttgcatgcctaatatttttgctgaaaactgaacattttagataatatattgtagcaactgtataatctgatttccccatctcttccctcacacatacctagagttaatggttgtttcttttttgttttttgtttttgcttgttttgggtttattactttagtttcttactggaatggttctgtgcagcatgtttccctcataatgtgtggctgctgttgtctctactccattgagtttgccaccacccttaccacttatataagcctagctttctagggaccacccctgaaatcaaaatagttgagtgctcagttaaagattggctagagattgtatctaaacacttagaacccctaaatcactgccttctgcttttatgatggatccataaatgatttggggaatgaatcagcagtcagcctatttaccagtctggcccaaatcttaatttttgtgttgtaaggcctcatgctcagcagaaataagtagcttactaaggctttctgcaggctctctgagcaagtgtgcagctttgtgcatatgcacagctttccaggccatcagagataagtaggatcgcatcaatgccctctttcagttcctggatctgcctattaattttctgactggcctactggtttgttgcttgcttcagtcagttatgagatttcagggtagctgcagtgttgtcctttcctgattgtttgcattaagatcactattgtttttgacaataccctttgtcatagaattttccacataaaatcagtcatttctaggatcagagccttcatcttcacagcacacccaccccgacagcacttctgcatcaggaagcaggggtggaactagggagtgggagtagcaccgcactaaagtgctatagactctcactgttgtcaatgaggttcggtgagttttcttgaagaaacacttctcagtttattgcatgcctttggtcaatttccagtgtcctttagagattgtttttgacaattttgttctgtttcattgtttatttttgtggcaaggatttgccaacctcctcactcagccattttggaaggtctgctgtcttgggtatgttgttgttgtttagaaacatacatgctacaaagtacactcttgagtatacagctaaagatttcttacatgtgaaaacacactcgtaatcaccacccagattaagatacaggacatgtccagcacccgttaatctttccttcctagccttctagtttcatcccagagttaaccactgtcctgacctctgtcattacagattactttttgtaatctgtgtggtttttttgttttttgttttttgtttttgagacagagtctcactctgtcgcccaggctggagtgcagtggcacgatcttggctcactgcaagctccacctcacaggttcacaccattctcctgcctcagcctcccgagtagctgggactacaggcgcccaccaccatgtccaactaatttttttgtatttttagtagacacagcgtttcgccatgttagccaggatgatctcaatctcctgacctcgtgatctgcccgcctcagcgtccaaagtgctaggattacaggtgtgagccaccacacctggcctagatatgaggtttttttgtttgtttgtttgtttgttttgttttttttcttgagacagagcattgctctgtagccaggctggagtgcagtggcgcgatcttggctcactgcaacctccacctcccaagttcaagcgattctcctgcctcagcttcccgagtagctgggagtacaagcatgtgccaccatgcctggctaatttttttgtattttagtagagacagggtttcaccatggtagccaggatggtctcaatctcctgacctcatgatccgcccacctcagcctccctaagtgctgagattacaggcatgagccactgcatccagcctataatctgtgtgtggtttttaaacttcatttgaatgaatatttaaaatatgtcctctttttcctctagcttcttttactcaacatagtaacttttgaaatttatccatgttttaggtgtagcagggatttttaattttttaattgttgtataatactttattaatagatatgccacagtttccttattgtgggacatttgggttatttccagtttgtggctattattaatgaagctgctatgaacatcctcctctttgtctttctatgagcatacatacgtacagttttaacgtggtcagcaacataatgcatgtgtaatttaggctcttgctcttttttttttttgagagacagagtcccactctgtcacgcaggctggagtgcagtggcacgatcttggtgcactgcaacttcccccttccaggttcaaatgattctcgaacctcagactccccagtagctgggactacaggcgcataccaccatgcccagctaatttttgtatccttagtagaggtggtcttgaactcctgacctcaggtgatccgcttgcctcggcctctcaaagtgttgaggattacaggtgtgagccactgcgcccagcctggggtcttgcttttttaaacttagcattatatcaagtgtttttccttatctctgtcattgtcatgacaagagtcattattttttcaggtaggtataccgaaagctatttccatttctatttttagaaaaagtcaaaggcctgtatttaataattactcttgacaacacaggtagcagttgatgctcaattcaataaatatttgttttcaacttttaaagaaaaactccagaatcgtatgctttttaaaaatagtatttgattgaagattaaacaaaacttactgctttttctgccccttgaaatgttccataactctatgcaattcacatattagtagtatcactttttaaatgtacaaaagcagacattactgagagccttggcctcaaaacattcatttgattgcctttctttaaaaacatatttcatactgggttatggaaaactcagcatttggttttggatataaataaagccatatgacctttcatatttaggagctgaatccctcttgtagaaacttgtgatgttgctttgcccactttcctaccctccctaccacgtcatccaacacatgtgcacttatgctcattcacatacacctcgcaggctctctgtgtcctgggacctacacttcacatagtacttggaaatattttctcttgaggaaatggatattagagttgcaatggtataggaactgtatacgtttttcctatctatactgtggtttttcttttcaaacattgtcgagatttctgatggataacagtagttgtgaaagacacaaggagaatgggagggaaaggaattgcttaatggacctcacataattgtgactatgactccaggtctgctgcgtttagaaatggaattgcgggcagatacatttgtcaaatttaacttaatcccttggcttttatctgatgtatatttttccattaacacagtatacctttcatctctactttcacacagtcaaacagcgtctaatttttggtggactttcttttcttcttttttgatgctaacattatccccgtagggtcctaatcaggttttagactatggagagaagaccataagaatcaccaaagcggaatttcccattgctggtaaagagatgcccaagatgcagaaggcttgaaataaatcgggcatgaaataagtggcgttacagccctatactggctttaccgcaagggttaaatttgctcagtgtctgcaatttcacctttcctgattgtcatacagagtgagatcattgtccaaaggttgatcatgtggaggatgtatgtgcttttgaagtgatcaaactaaaagagaaaacaaagctcatggctgaagtcatcacacctgaataccatcttgtgatgtcatggttttattggtatgaattctaaccaagctgtgggcatttaagtcatatttgtggatcagaagccatagatatttgcgcttctcataggctgtgcttttctgatactttgatcattattatatggtaactaacatatattaatatattaatgtattatatcatatttatttagaccccagtatggatactaaatgggataaagcatatgccaagattttttaggtcttgggattatttaatttttttagaactggcgttcattgattgtcattcacgtttctcttcacttccttatgaaaagtttctcaactcttctctcagtattttcttttcccctgtgagatatgtttccttttacactttttcattcctctaccaaatagtaataattgcaaacatttattgcatgtttatgtgtgtaccaggtgctatgccagttgtttttatgtgtattttctcagttgctgtcttaacggctctgtggtatttttatccttggtttacagatgaggagactgagcctcttttggtctctttccccctttaaagataaactcctcctatctccttaaactgagcttgtaacctggacctctgattcaacagcccacaccccaatttgtatttggctatttgtattgggctatttgggtggtggtcctttgaatgttgttgtgctaatggaggcctaaacgttgaatcccgtgaatggaaacctcttcacatctttactgcttgtcctgggatcttcacacctggaatattgatcttcaccgagtaatttgggaaaaacagaggcagaggctggaagctgctcaccgtcctatggcagggcaggtaatgtccttaatgagatgggcttattccagtggagcagtggtggggaagcaaaagcttggtgttctctcctcatggttgcgaaaatattcacataaaagattcactagctactgttaataattgaaggactttcctcaaaatccatgtattataacggtttaatatactaaaatgatttggaggaaatcggcctcagcattggtgaatgtgttgacatatgaagctattatttttataattcttattttagagatggagtctcactgtctcacccagcctagagtgtgttggcaagatcatagctcactgtaacctggaactcctgggctcaagtggtccttctgcttcagcctcctgattagctgggactgtagtcacatgctaccacccatggctaattaaaaaaaaaaaaatgtgtggagacaggatctgactatattgcccaggctggtcttgaactccgggcctcaagtgatcctccagccttgtccttccaaagtgctgagattacaagtgtgagccaccccacccaacctaaagttgttttaagcttattgtgtgcatgttggttgtgtcaccagccgggaggggcttataggctgcaacactgttttctttcctatactacctttattatcacgtaataactaaaatacgtactatctgtttttaggtggatgctctgcttctcttgatagatatgaaagcaggatacctatcttccacccctgtgtttttcttttttcttttcttttctttttttttttgagacagagtctcacactgttgcctgggctggagtgcaatggtatgatttcggctcactccaacctctgcctcccaggttcaagtgattctcctgcctcagcccaccatgtagctgggagtacgggcacccaccaccatgccgggctaattttttgtgtttttagtagagacgggggacgtgatttcactgtgttggccaggcttgtctcgaactcctgacctcgtggtccgcccaccttgggctcccatctactcagatgtcctgtcttcacaggggccctctttgaccaccctctgtaaaactgtactcatattattcactattctttaccttgaccctgtattttcttagcacttatcactattcgatataacattttatattcttcaccaccaacccagactagaatgtcaggtccctgaaagtgaggtatgtgccatactcaccactttctccccagtatccagagtggtgtgtggtacatagcgaaactcagtaagtattattgaatgaatgaatgaacacagatgactagaaaaatttctagaaaattttaaaacatgggcatattagccatgaatttaatttatagttttgttgttttcttttgggtattcaaaaatataatttcatttgtttatatctctaatgagatagtacagtatttgtgattcttctagtgtgatggcatgtacagtttcattggtgagtatatgtgacctactgtgccaggtggaaatggagtgaatgaacattttggggggaactaaaaagcaattttcaacctttttgataagctaggttaatactgtcttctcaataaaaagtactttttcttcctcttataatgttcatggtcttcatctgtatgtgtatattgccgatttaggaactaaagccgaaatggatctcagactatttcccacagactggtagctgtatcccctctgtcagcaagtatttgatatcttcagtgaaaattgtttctttttccacttttagcttctgtttagttttacaagtctaaacaatttttggcaagtgctaggggctcacctgatgcactttttaatgcattccactcctcgttgttattttctctgtccagtacacatggtgctccttccccctcattgccatcccactttggcagaaagcattatggatgctgtgtatgtagactcatcacccaagccagcatgcatgggagagggggcctctagaataataattgttacttggtgttctctgtactactctgtttaatctccctgcttaccacttactgccttcgtaaagtaagctcaatacaattatttattgcaatttgtgtagaatgtcagatgtggaacagactttgcacactcatcagatccagcccctttgttatttagatacaaagactgagccctcagagaggagtcttgcactagactctagacctcccttgggcaggggactttcttgttcactgttgattcctgcttgtctaatacagtgtctccatgtaataggtgctcaataaaaaatattgcatttttcaaagtctcatatgtaagtagtgatggcagggccagaacttgaaccttgcatctcctagttatttgttcattgtcactgccacaattatctcattgtagtttaaagagagtcagcttccagtcttttaaaatacaattacctttaattcatctgtggtaaacaaacagcagctgtctctcattggcatggccgcagttccaccactgagcaattctagaaactgacactattaaccattctgctaaaaaggactcttctactcatatgatatcctggctgtgtccaaagtgtaatatttaattgcattttcttaatctttaccactgtattgctaagctttctaataccttcaaaataccaaatctcaggcttatcctaattaaagaatctcaatttaatccataatgcatgacaattcaatttgttgattgctttttctccccctctttgtgaaattcccgtcaaatgtattaattcaacatgatgaatcctgtattcaacccactggagtgaataattaaaattagctgataaaactttcagcagaattactttgtgaaattgctgaacagatgtgtcattttaatgaaaatccacagacaagctccttctccccctcggcaggataaaaatattatcccctcggcacatacttaatttggtggtaaatacactcggagcgattgctggaagggaagaaaaagcaacttgtcacacttagtaacttgatttttccccagcatgcagtaacagctatctacagtaattcatagtgctctattgttgctgcaagtcccaaagagaacttattaaaatgcaataatctcctatttaaacagaaacaataaccattaaatttcctgtggatccaaaattgagcacaagccccatctggtaagagtgattagaggcctgatgagggaatttaatttgcaacattcaaagactaaatctgagcagatcttgtcacctgggactcgagtgctgcttgctgtcttcttaaaaatctcgacctaaactgaaaatggaatgtagaagtgaaaatgttacccaggggccacccccaacagtattgtgtttcattatgtctccagcaggcctagtgagcagaggggattttagtgctgtccgctttagctttgccggcaaggccttttgacaggaccaacactaatgctgtcatttcctctactgccctgtgcatctgtcatgtggctgcccctcttagatcgtggactgcctgctccctcccttcttatttactttcctcttttagcttagcaagtcctctctctaactttaagagttctctagatctcaccagtctccctttcctgtccaaggagtcagatgctttcagcaggctactttgagcaccactgtatcatgctttacattttatgtctcctccttgcctatagacagtaccccctctgagtttattattagtgttttttttttaactgtaggaggactaagatttattgcatgttattagtaaatacaaattgtcattttcctcctcttcttagcttttctcttacaatcccccaccttatttatattacttctgagctccagagaaacaagatatgcgtgcactcatcatcagagagatgtgtttctgtgtatgtgtgtttgtgtgtgtgtgtgtacatgcacttgtttgtgtgtggttataggcctgatcagacagatgtcagtttatcaattagtagaactccctaattaagtatttgctttgagcaatagagctcttattggttgtgaggtaacttggcaggagggaggcagttaccgatgtaatagagatgcctgagcagatagtttcgttgagcagatactatttgatgtcctttaatcatcagactcctccacttttccttcttctgggctcctgatttatccctaaacaatcagagcctctcctccataattttatgaactacaaaatttacaaaaatgttttacaaaccctctgcctccccagtatcttctccagcccccatgtcttggggcaggccacatcaggtctctctggctgcttcctttcccaggccctactacctactctggcccatcatatgtcttttgagaagatgatttttcagttcttttctttagtttagaaaatcagaattaattgattaatttttaaccccttctacctttctcctcccctaccatatgaattcatgcagagccagccctgcaacctaattttttttgttttgtttttgagacagagtttccctctttttgcccaggctggagtgcaatggtgcgatcttggctcactgcaacctctacctccggagttcaagggattctcctgcctaagcctcctgagtagctgaaattacaggcacccaccaccatgcctggctaattttgtatttttagtagagacagggtttccccatgttggccaggctggtcttgaactcctgacctcaggtgatctgcccacctgggactcccaaagtgttgggattacaggcgtgagccaccatacccggcccctgcaacctaatttttaaggagaggtggtaaggttcattccatgaatcataccacttggaattcttgaaaaattaattgcatttattgcacacctactctctgtaaggcaatgtacataagaatggaggagatactaagaaaattgagtcccactcctattgccgatcgggaaagtacggcataagcacatgaatatttagaggtcctgtggtttaagtaacggtaggtaaggaatcattgggccagatgggatcagtgactcactgaatattataatcagagatgtgagtgcagaataaggaggagatatgactggggactggtgtagttcttagaggttgcctgagctggctagcgtgacattcctactaagcaatgagcctagcaaccagaatctcccagccccggtagccaaggagcacaggtggtaggctatagaaggagatttaatgcaacacagctgggttcaatatggtgcctctttcagagccctggctacaattgatgtaacctggtaactagtagctttgactttgatgtcagacacatctggttgtgaatattccctgaaccactcttaagagtttctcaactctttgagtctgagttttcttgattgtaaaatggtgtttgataatacatatgtggttttcatggggattttgtaaagtgcctggcatatggaaggagctgggtaaatgatggtagtacacttataatcttaagggcagaaggaatgaattaaatacagagtgaggcctagggactcttgctatgctccctcctgactccggtctagtattactaacatctttccagaaaccattcttctttatgttggttttggccctttgtgtccccatctctagccctttattcagttggtctgctcaaggcttgcatgccatttttggcattgaacatgtgatcctctagtttaatatagcatgtgcaatatggtaatttaagaaaataaatgtctgtatgcatagaaaacacagcatcctcctttaattcatgggtttatgggagattacagttttcttttagtttaagcctacaaagtgtttatagtaaaaaagtttcaatgaaatgatttccaatttatatttccttttcactcaccaccacaagtcagaaatcaaatcttatgcttagaagaaagcaactccaggactgtatccacttcgggttttgaataacaacagtaaggtggtctgactccaagattaggtccttgttgtttggacatatctaacaaggaactccatccccaagtgctggagaatccatgaagtcagtggtgtcttatgaagcttgagcaattgggaagccttcccagtcagctttttggcctcctctaggtcttaattacaaagcggattcatggtcctgcctgaaatctgattgagacatagactcctctatcccaaatgatatcattatcaacattggttccctgtggtacacatttgtcatattcattatgatttgtacctaagattccaggccacaataatagggtaagagtgtataatgggaaaaataacacaaatcgttttgattttctttaaggaaattcattgccttaacattacatacttgcctttgttttaaaactcactctatgccttatctaagaggagtcaatataaaagattttaattttagccccatatgctgtagctatatataaatgttctgtaaaatatatcccctagataaaagtacttactacttttttgaagttttttttaaaacctttcttttggtaaataaaagtctttttagctttgatgtgactattacacccttggtttgggttctttctccattccttcatccctagcccctgtgggacccctgtaagaaaaatgggaggggagagaagcatgaattccttaataagtcccaaaggtaatcaaaagaaagaaatgcagtatgaacaaactcacaaaatattcttgtgcttctttggggaatacttaatgcacataaggtcaggcctttgtaatgttaatttgagagtgttaggaagaaagccatcattttacaggcaatgttgctctctgaaaaaagctttgatttacagagaaatgctgttctaacacacctgcattaaaccagtgcctgccgactttgagaggcctgagttgcttgagcagaggaaatgcttcattgaggatgcttagggcatttggctgaagtggtaggaagtttgccagaggtcctattttcctgtggtcaaaacaacctgttcagtttggatatggtacagcccctattctttagacatgtgcagagtgacagcacaattccgcaatggcctcctttccaagattggccttagggagggaagtcttaccagacacagtggcaacatagttagtataggtatcttggttatagaggttagacatgaatagcctggtttccacctcaggtggttgcccgtgccttctcatcaacttgtaaacctccatactgtgtagaggagattgtgtggctagaaggaatggattcatcccaaacccccaaaacaggattcggataagtgaccatccagcctgcaccagagcattgccagagactggccattaattatcttcagaggcctctcagttcatctttggctctcctctctcatccatttctgtttcttccttcttccatccatacttcccctgctctttcctcctgccttttatattggtctgtattctacttttgggtgttatacaaatcagaaaacatttttatgttaaaacaaattaaatatgaatactctttgtgaagtgcctgacatgcagtaggcactcaattacttcctctcttccatcctactgtgtgataactcttctagtaattgagattatgttatcatgagactacatgaaaatattatcatgccccttctgagttaatcttattcaacctggtttctcatcccttcatcttcttagtctccctgccctcaaatagtccactgtgtgtgcacgtgcgcacatgtgagtgtatcttaaagtacagttttcaaaactagctgcacttccctatgttgggtctgatttgccaattttttatgaaggaataagcaaaaagaaagagagcaagagaggaagaggggagaaatgccgtgcttttctagaggagcaaatatatggaaattacccttgtttcttctctaaagtagtaaaggtcacagcagtagttgcaaaacccgtaggccgcctactgccttccacacattcagcattactattcttgcctattttacccttaggcatcctttatttcttgcacagatggtctcactcaggcctaacaaaatgttttaagctttgcataaattaaaacgaggtctctgagtacaaaagtgcaacttgttttttacttgaaaacaactatgctggcatcttttacaaaattacagcctcaagccaggtttccataatcagttttcctttaaaaaatagagaggaaagaatgtatccttgtgtgtgtgtgtgtgtgtgtgtgtgtgtgtgtgtgtgtgtgtgtgtgtatgagtatatatataatatatgtatgtataccaaacacaaatggtcctaatcaatgggattatggcttttatgatgttctgtgttcctttgaaggttgatcaggcatgagtggtggatgattcagtttgaataaatagatttggaaatattattttgggggtccaggatttctgagtttcttcattagtttagtacatgataacaactgttgagacatttcagtgtgcggagactccctcctagaactctttactatgtaccttataacagggttttactcaggctaaccttgactgtgctcaattgaaagaaagtgatgagtcagctcaaagagaaatagtctgtttctcccaactctgcgataatgtgtcccaaagtagtgacacatggcatattccattcttaagataactggcagacaatttgtacaatcttctagacacattgcttccctttgattcacacatcatcaccaaaagggtaatgctacaaatcttttctctattcatgactactcttaacagggatatggcttgtaaagaagcttattgatgtgctttgcttgaaatagaatcattagactgggcctgccctctcatttttaccttgacagtaatagtaagagtatgggagatactcttactcttattattactataactataatagtaatactattacagtatagtaatactattacagtaatagtaagagtatgggagatactcctattcttactgttactgtcaaggtaaaaatgagagggtactgtgtgagttattttttatatattgtcatcttttaataaccctatgtgcccactatagagaagttggaaaatatagaatagaaagaagaaaaagttatttttttattttccacagttaatattttcacatattatttcattatgtttatttcctcacacactagtgatcatactttcaacagatcatactgtagatattactgtagatgttatattcatttgttcacttaaactaataatttgaatatactttactattattaagaactctttgttaaagatcaaattgttttaaaacttaagttagagaggcatttatagcattagataatgccagccaggacatatacactatctttaaaaatgaatctaacccttaaatgaaatccagcagccaatctaatgtttctttgtaataagcaaaatatttttctgtgttattgcatctcacaggaatctattcctaaaggattcaatagtaaagatgctcagtaatcatgctctagagtttctcatccctctaaagaacacacagcagttctgtgaatgactaaggatcagcaggaatggatgtcaggtgaatgttggcactactggatacaattgatatgctttatggattttttgtttcaatgtgattctgcatagatggcacctgtaattatgaccatttggatcatgtgaaaaatgataaattttcggtgaaagggaatggtgcttgatccttttctttgtctttgaactgtttagaaacactaaacttaactgataaaagtaagtgcaagatggccgggtgcggcggttcacacctataatcccagcactttgggaggctgagacaggtggatcacttaaggtgaggagtttgtgaccagtctggccaacatggtaaaaccccgtctctactaaaaatacaaaaattagctgggtgtggtggcgcatgcctgtaatcccagctacttgggaggctgaggcaggagaatcacttgaacccaggagatgaaggttgcagtgagccaaggttgcaccactgcactccagcctgggtgacagagtgagatcctgcctcaaaaaaaaaaaaaagtgtgtgtgtgtatatatatatatatatatatatataaaaaataaaaaataaacaaaaattaaaaagtaagtgcaagacatcttagaagtattgcagttttttaaagctcttgacagagtaactttattcatgcaggtaaattctagctcttttgagcaatatgttaataagtcactgctaatggcctaatagtttttaacttacaattaaagacccatgatggaaactggcagcaatttcataacccaccagtctaattgtttcacagtgaacaattatttgccttgcgaatacttacagtaaacatttctgtaaagtttatctttgtttcctaaacagtgatatttgttttgtacattctgtagatggaatatattctgcagtttggtttttctgctgcttagttgctgagaattgactgtgttgttgcacatagctgtaatgcattcattttcactgccctgtagtgttccattgtatgaatatactatggtttacatataccttgtattgatggacagtggacatacaggttgtttccatttttgatttgttagaaatagtgctgtatgactgttcttttatgtgtctcctggcacatatccttgaaatttacttagcattagaattgcttgggtttagggtatgcacataaggaacattactagataacgctaagttgatttcaaaattaattgtaccaatttccactctaactagcagtgtagaattgttgccatcgtttccacattttcatgaatactcttatcatacttcatatgaaataatcttgtgcacatgtgtatgtgtgtgtgttcaacagcctcattgtggttttaatttgaatttttctgccctggtttcctcttctgagcatgttcttttgggttttttaatctatgtctttattttaatgttgaactttttcttattcagttataagagtgctttatatattttgatcactattcctttgtgaataatgtgtgttccaaaacatttcctaagttatggtttatcagcgcattctgtttatggtgtcttgtgataaaaagttcttaatgatagaatagttgagtttatcaaacttttcctgtatagtttgagtcttgttttgagaattcatccctactctgaggtcataaaagcattcttacatgttgttttctaaaagtgttctagttttatcttttacacttaattcattgctttatctggaattaatcttcatgtatgatgtgaggtaaggtaagggttcaactttatttttctccatatggacaagcaactataataccattaccataatatattttaaaagtttcttcatctctcagtgatctgatggaccaactgtcataaattatgcctccaaatttgcctaggtttatttctgagttttctctttcatttgtttgctaatttatataacaacacaacactgttgaaattattacaacttttaattattgcttgatattttaaaattcagtctccctcccccacctcttattatttttcaggtacacattggtgactcttgtcttactactcttccgtgtaaattttagaatcaactcatcaagtttcatattctcaaaaaagtgaaattttcattggaattgcattgtttattggataatttagaaggaattggcatctttatgatattgattcttctagtccttgaatataatatttatctttatttatttaaatcttttttctccttccggaaaattttatggtttttctctatatgttttttttattacctatttgcaaatttctattagatttgttcccaggtacttgattttttttggtcctattataaatggtgtcttgaaaaaccatgttagcagcagttctcgttcttcgtatatacccaaaatcattcatagcagggactcaaacagatatttgttcaccaatgttcatagcagcactattcagaatagtcaaaaggtagaaataactcacatatccattgactgataaaaggataaacaaaatgtagtatatttatacaatggaatattattcagccttagaaaggaaggaaatgttgacccatgctacaatatagatgaactttgaagacattatggtaagtgacacaagtcagtcactaaaagaatactgtataatttcacttatatccagtgcctaccactgtcaaagtcatagagacagaaagtagaatggtgattgtcagaggctggtgggaagagggaatgggctcttattgtttaacaggtatgaggtttcagtttgggaagatgaaaaaatttctggagctggatggtggtgataattgaacaatattatgatataattaatactattaagctacacacttaatggttaaaatggtaaatttcattttaatgtatattttaccacaataaaaattatgtgttctaaaatttactgctggtgtatagaaatacacttgatttttgtatattgattttgaatctagcaaccttgccaaacttaccagttatagtaagttttttgcagctcgtctagatttctgtatatgcagtaatgtcataatgagcattttgtttcatcttttccaatcttcatacttttatttatttatcttgggttatccagttacctatgacattcaataatgtcaaatagaataataatagcaggatttcttgccttgatcttaaaagaagcgcttagaatgtttcccattaaatatggtattttgttttgttttgtttttaggtagcttttatcagattaaggaagttcccttcatttctagtttgctgagatttaatttttatcatgaatgactgtcagatgatttattgaaatgatgatgtgattttcttctaatctgttagtgtgataaactacagtaattgattttccaatgttaaatcaatctgtaattcgggggttaaacacaaattgattatgacatattatgcctttcacacaatgctagattcagtttgctgacattttacttaggatttttcatccaagttcatgagtccagttgtcttgtagtgtttttctcaaatcatcattttgaggattggtatcaagattctcccacctcagccttcctagtagctgggactacaggcacccactaccacgcccagctaatttttgtatttttagtaaagatgttcagtaaaaaaacatcattttgccatgttggccagattggcctcaaactcctgacctcaagtgatctgcctgcctcgacctcccaaagtgctgagattacaggcatgagccaccgtgcccagccatgtctctgtgttttaggtatgtttcttataggtactatatagattgattttttttaaaatttttttctcagacctcacagggatgaagatgttttaaaaagctcttctgaccagataatatttgtctgttaaatggagctttttgtctatttataattatagatcagttagaatttattttgtgcattctatttttgccctttctacattttttttctgatttcctgcttttctttgaattgtttcttcttacttcatttttttcttctgcaatttcagaaattctgtaaaccattttcattcttttggttgttactctagaaatttaataaaaacatttcaaagtctaaagttactcaggaggaaaggaaagataatgatgaatacagggacttttgaacactttaattcccatcagtttgttatcatttaccttaattctgttgtatacacccagcagatgatattgttcagaattaaccacatattttcccatgttctactcttcatttttattgctttcagaccattcatgttggatcacttttattctagataaattatattttttagagaatttttactatggaaagatactttttactctatgatattttaagttaacaagtttcactttgaatattgaagatgtcattctagtgtcttcaagattctacactgttactattgaaatataaggtgttatttaattgttgcttcctttaatgtaatttgttctttttctggctgcttttaagtctttcttttgtctttggtgttctgcagtttaaggtgcatttaggttgaaattattttttgcgtaacctgcttaggatttgttgtcttctttttttaattttaaattacgttttatttaacccggtaggtccaaaatatcatttcaatatgtgtcatcaaccacgctgcaagccctcaaaagccacatgtggccagtggctaccacactggaaaccatatgggacagttctatagaatggagtttagtgcgcattagaataaatgggaaatcttacttaaatgcaagctcctggggcgcgttcttagaggctatgattcagtaggtcagcaaagagaccctgggatcttcatttttaacaagtttccccaagtgactccaatgagagtggtctgcagaacactctttgagaaacactgatgtaggagattgttcagggcaaagcagaaggttcacctgactctcagggaaccagaataacctagtaaccatgggatcattgttacaggatccacatccctaagaggatgttccactgcagttttcatttttctctgactcaaactcagtaagtggattagatacatgcaggtgatgatgcaggtgcccatatgggacataaaaatttcaagttgggtccatttgttcttgcatcaaattatgttttaagtaaaatattaatattttaagtaaaatattttaagtaaaatattaatattttaagtaaaattttattttacttttaaaatattaattttttacttaaaacattaatttacttaaaatattaatattttacttaaaacataatttgatgcaagaacaaaatattaatattttacttaaaacatttaatattaagtaaagtattaatgatcctaataaatggggaaggagctcagacagaaccccattcccttcaaagcaagacaactttgaatagctgtgaatcttcataatggcttctctttatgaagccattgttttattcaaggatctactaattgggtaacaccatctcctatgcacaaacatgccctaaacttggactcagttacaaatagggatgaaggtaagaatggtcagactgtctggattttccttctcttagtgtttctcaaagcatggtctaaggaccagatagggccatgataccagacatgcaatagacagacctgcacatttgcagcattctcctccagagacagattcacatggtcaggtacagacccagaatctgcaaggtctgccacccacctccattctctgcccctggataattctgatacaggggattagggtgaaactagtggaacccatatataccacgctgttctcatcagaatgaaactacaaaattcactaacatctctcttgtttttaattttaattatacatgtactatttacaatagcaaagaaatggaatccacccaaatgcccatcagtggtagactggacaaagcaaacatggtacatatacatcatggaacaccatgcagccactaaagaatgagatcataccctttgcagcaacattgacagaggtagaggtcaccatcctaggcagaccaacacaggaacagaaaaccaaatactgcaagttctcacctatgagtgggagctaaacaacaacaacacacagacactaggaggggaataacagacactggggcctacttgagggtggagggtggtaggagggagaggatcaaaaaactatcaggtactatgcttattacccaggtgacaaaattatctgtacaccaaacctctgtggcacgcagcttacccatataacaaacctgcacatgtacccctgaacccaaaacaaaaattaaaaaagtatacatgtcatatgaataaatttccagttataaaatatttctttttttttttgttgagacggagtctcactctgtcgcttgggctggagtgcactggcacaatcttggctcactgcaacctctgcctcccaggttcatacagttctcctgcctcggcctcccaagtagctgggattacaggcgcctgccactacacacagctaattttttgtatttttagtaaagagagtgtttcaccatgttggccaggctggtcttgaactcctgacctcatgatttgcccacttcggcctccaaagtgctgggattacaggcgtgaaccaccacacccggccaatataaaatatttcaacaaatacaagtaaattaagtaaaaagttccctcacctcttctctaaatgtactcttcccccggggtgaccacttttatcagttaaatttaaggatttcttgtcttcttgtatctttggattgatatttttcatcagttttggaaaattgtctattcagtttcttttcaagtattgccaactcctcattctctctttcccttcctcttctctgggaactaagattatatgtttgttagaccttctttctcactgtctcttccttgactgtcataatttctgtactacattccagatgatgttttattttagcttccagtttgcttgttggctcttcaccagtacctaatctattgttaattctgattactgagattttcaattttgattaatatagtttttgtttttataatttttttaaatttaactttttatttggaagtgatttcaaatttgaaaatcattgtaaggtcagaaactgtgtgaataataccatataccctttacctagagcctctgattcttatttcactccatttgatttataatttgttttttctctctcggatatatttttttctgaccatttaaagataaatttcatacattatgacctttttcactaaataatttaggttatatatttcttaataggcatattctcttacctgattacagtatagttatcaactgtgaatattgctgcaacgaacatgagaatatagctacctctttggcatactgatttcagtttctttgaatttatatcagaagtaagactactggatgataatgtaattctatttttaattttctgaggaactttcatactgttttccttcatggctgtattaagttacattcccatgaacaatgcacaagggttctcatttctccacaccactgccaacccttacctttcatccttttgatatctcattgtggctttaactttaatttccctgttgatcagtgatgatgagcattttttcatatgtctgatggccatttgtatgccttctttggagaagtatctatttaggccctttgcccattttttgactgggttatttgttttattgctattgagttatttgagttccttatatattttggatattaaccccatattaaatatatggtttgcaaatattttctcccaatctgcaagctatttcttaactctgctaatcgcttttttttgccatgaagaagatttttagtttgatacaatcccacttgttaatttttgcttttgtagtcatattcaagaaatcttttcctagaccaatgttgtggaacgttttcctatgtttttttccagtagttttacagtttcagatcttacatttaagttttcagtccattttgagtttatttttgtaaaaggtgtgaagtaagcatccagtttcattgttctgcttgtggatatccaattttcccaataccagttattaaagagactatcttttctccattgtgtgctattggcatctttgtagaaaatcagctaaccaaaagtgtgtgggtttatgtctgtgttctctatcctgtttcattggtaatttgtctttctgccagtaccatacctttatgatcactgtagctttgtgatagatcttgaagtctaggtaacgtgatgtttctttttcattttttctttatgtagtcaatttatgaattcctattttcctaagcagtcttgaattcattactaaataattttagtactcatttcatatttggccagtggtgtccacatctaaaatggctcctgtaacctagtgatgtgctcatgtcattgatttgagcagttgtttatgttatggcataacaagatgtcattttgtatctactctgccttagtcctggaatggaaaaaagaaattttttgaattcaaaactgttgattctttatttaaaatctttaactctgttagtacatactaggtggtgttgattttttttgagactgttattcttcttgagacattacatatacttagcgtgtctgaaatttcaatgtctgaagcatttccaatgatttatgtatctgattgttgttatctgccagctttcactcatccttttgcctttccttacttgtttggtaatttttactgtgaattgcttatttccctgagaactttgtgtgagtattgcttgtttttcctggaatttttaggaattctttgacacctgggagaaggtggtttttaccagatatttgattatttcatgcctctagtgaaactacctgtgtgagaccatcttatattctcagggtgaggtttttcttttcagaccattttatgtaaattaaggctttaaaactctatgagagtcagcttgtcattatgcattatcagaagagattttttttttctgccggcaatactatttgagatgagaaattttcattgcaatttacttgagggagagggtagtttatttttagttcatctagcactgaatgtgtagtaggtcttttgtgtatagctctgttgggatcttctactagatgtcttacctggggtgggggccatgtgctatgctcttgatccctggatttgtgaagacttgaagccaaagctgaagttctaactagtttgggaaatattcataagaggaaacaaaaactaaattttttttcttctctttgctttatttttgacctgagtattgcttactttctgtctagctcatggatgtagattagaataatattttaaacttcattctgtttagtttttaaatcgttttcagtggaagtatcagtcttagtacctaatctcccatggcataaggctggaaatagccatgatcctgccaaacacggacactctgcaacctggaacaaaatattctactctaaaaatcaagtaattatgtcttttttcaataaaatataaagtataatcattaatgtaatttacttctttcattccagtcttcactcatgctttcaaacatagattatattattccaacccttcttaagtggaattagtatttcattattccataaggttctacaaatacctacaaagaccatcatgaattccaggtgctctgtaacctgatcaggttggagaactgctgatgcaaccaaatttaatcacttaatgttcttactaagcactcatttgtttttctgcttctatgacttgctctcactgcttgctatcccaaacactgtccgtttgtacatgttccaatgtcaccattcctttttcgggcaaatgcttcaaaagctactgtttctataaaactttcctttacccttctcttttgacttgttatgagctccttttgtagtttgtaatctccttaagagcaaatttcacaaatgttatatttgtaatatcttatgtagcagagtattctcacagtctagaacagatggttcttctgtatctgttgaaagaaatgggaagatagcaaagcaacataataggataattttatttttgcctactagactatctcaggatgtatgtgttttaaatcctaaaactggttagtggtatttcagttgaaaaggtcttgaccctttcccttctaacataacaatcctcatcataagtgagagagaagattgggtgagtagggctcagtgggggaagctggttcctttcacccaccttcagaaatccaggtatggaatacaggggttgttctggacctcaaaattacctttttttttttttttttttgacggagtctcactctgtcgcccaggctggagtacaatggtatgatcttggctcactgcaacctatgcctcctgggttcaggggattctcctgcctcagcctcccgagtagtggggattacagggatgtgccaccacgcctggctaatttttgtatttttagtagagacagggtttcaccatgttggtcaggctggtctcgaactcctgacctcgttatccgcccgcctcagcctcccaaagtgccgggattataggcgtgagccaccacgcccagccacgaaattacctttaaaaaggtggtctttaaaaggcaaatagggagatactaattgcaaaaaaaaataatgatgaaataagttatctttctgttttccactttttctgtggtgttccttttgacatttgcattccaaaccagagccccacaaataactgagtttgcactcttttggcaagcaaggactgctctcagatgtattttataacttcagcttatatgggaagaacttttctttccagagacggtttcatagtaatatccttcaaaagctcacattgtagaatatgacttttttttttctttgttgttatgtttgctttgttttggtgggttttattcatcatttcagccagcttatagaaagagatagaacttttgttggatactaaatcatgtctatcaaaagcactattgaccttgtgttgttaaaactaaaaatgtaagaacaaaccattttctaaggtttttaattatatgcactaaaacagagtaaggcctagatttattaatcattgggttatggtttgatgtggaaagaaccagcctataacttttccctttgtttaacaacgttattgctgaaaactttaatagacttaagtgtactggaactagggagtgaaatcttatctttccctgaacaccagggctgctttgttatggtgtttccatttgtggcataatgaatgtgtaggacgctaatgatgtggtctctaggtgttctcctactacacagagcactgataatgagctgcgagtaatctagtacgagtccctgaagatgaatcctgattaccttcatggggccattccgctctgctcccttcctccttgatgtttctgtaaagagcatttggattttgaagagagtattgtgtatttgacttttaattagatttgcagtgtgttgggttaataaactagggcttcttcttcttcagtttcctctaaagggatgtgtgtaaatgttgcacagtgggccaagagaacagagggtcataacaggcagcaatggtggtgtcgcccacttcatgccccagtcctgaaaagaaggcttatagtggctgaaggttgatttcatcccatggtccatagttacaaatggcttccaagctgccaaggacctgctaaacctattgcatctgttctgtacgaggaagcagtctcagaatgaaatatgacagttgtctgtcagggctgccccagagtcctgcaagttggtattatctgcttgcgttcagaaaacacatcaccgtggctgaccacagctttgtacttactgtgatcttagggctcgcatttttagggacaacttgccctttatgcctttggtccctttctgccttctgcttttgtttttctgccagttgggttcatttatcttctttcctgtgtgttttgccatgcttttcttattatagctttcagattcatcatggacagagatagaaagtactctagtgtctttatcccacctcagctctcagtctggtgtagagctaagggaaggagaattgccttcacagtcaactttcagtgtggtccctgaactttttattttgttcagtgaatccagcacatctcatattgtgccccagctataatgggtagtcctttcctgatcttctaagaaaattagatgcctggcttctgccttgctcttcattgttttttaagcatagtccttacatgatggtccgggccttccttacaggtctaattgtgtggctgggccttccttctgcatgcctattctgttttttagtttttgtttttcttttaagaattggggtctcactctattacccaggctggagatcagtggcataatcataactcattgcaacctcgacctcctggactcaagagatcctgccacttcagcctctcaagtagctgggactacaggcacacgccaccacacccagttcattttgaattttgtttttgttgttgttttgagacagagtcttgctctgtccccctggctggagtgcagtggcacaatctcggctcactgcaatctccgcctcccgggttcaagccattttcccacctaagccttcttagtagctgggattacaggcacatgctaccatgccgagctaatttttgtattttaagtagagaagagatttcggcatgttggccaggctggtcttgaactcctgacctcaagtgagccgaccgcctcgacctgccaaagtgctgggattacaggtgtgagccactgtgcctggcctgaagttttttttttttttttgtagagacggggcctcactgtgttacccaggctggtctcaaacttctgggcctgagcgatcctcccaccttggcctctcaaagtgctgggattacaggagtgagccatcatgcccagcctgcctatcctattttattctgaggctactactactccttatgggtagatccaaggatctgacatcattttcatacatcctgttcagtgtgtgagtatagaattgaggtaggctgacaacacaaaagtgggcagaggtttcccactcatccccgacagggattctctgttggcataggtgggctctggtccaactcctggccgacatgagcatggacaatgtggcacagttgtggctctgcatcttgtgtgtgactgctgccctgtttttgtttagcaagctgctgtgccaatttactatgcatgttgttacatattctgctctaatttgactgccattttgcttcagcgagacgatgattgtttatggcagggctgtaatgtgttgtcagcacaggttactcgctacttgttggcaatggcctaacattgcctgagacatggtgtcactgtgaaatggtttgacaatgttgagactgtagttatgttgagcagtaacaactgtagaggtcaagaaagggcatctaagaggaactgtgttcataggggaaagatggagaaggaatactaagtaggacagtagcaaatgtcatcaaagagcttcattttcacgcaattttcataattcagtctgttttctgtgaacagtgttggttcagctgttgctcgggagtagaagcacatttctgagttagaaatgaattgtgctgatcatgaccctatcattttcttctttgaacatttttagaaagttatccagcttgctgaagaatgcactagatccttgtccatgtgtgaggcaagggactcattgggccaccttcacagggtttcatttttggaacatttatctaaggactatcttactaccctgagagaccaagatgtaggctaccttaagtcgtatgaggctgctgtgaaaatggcatttgtttttttggctctaagaaattttcaggacctagtcaagcatgtgacaacaaatatttaatgatagtggacaaggtaaacttcaaaagtgactagaaacccttgtggaatctaagacagagggactctaacaagcttgatgacattttgaatacgttttgtattgattactgactcttttcccaataatctgtgaagctggctttctgtttggcaaggcagccccaaaaggaaccttcatcccatacctccatgcaggagtagcacagaacagcacccagcatcgggccctccagagtctgggagggttcggttgtctcatgaattatgtggtgcccttcaggaactcactttgacctctgatgcctttcctttcaagcaagtggtgtggaaaaatattaaaactctcagtaatgacagtttccagatatgcatatctttgagtggacaatgaaggcaacatttatattctgtccacgatgcgagcatggtatgcattctgcagctgtcacagagccttccttctggtaccaaataccttacttcctgacaggtatgacctctgagacctccctaacccctttctttcatttcatacaaaaatctagagcttggcttttttttttttccttctttttttgtaaaaagaggtttttccattttaaaaagccttttcagttcttaaacttgatcattgatatgttccacctcatcaaaaagaggagtgcagctaaactgacaatcagttcatgccattggcctcactcatcatcatgtcaaggacctggcatgcccattgagaagggcctctgtgcattctgtcctcaccaagcctaattccttcccctgttgatggttttgccagattctttgcctgttgatgcccatgccagggccacggtgcttatgccaaagcctttgacagaatgagtcaaatctggtgccagtcacccttggcatatgccaccttgttcttgaccacttcctaccagggatgggctgaaaagaatagtgtctgctaagagcttgtagaggacttttctgttaagtgctaagtgttgacattactccagtttgaatcagatcatttggaactcttgcttggatctctcaaagctgttgactcatttgtatcttggcctcacattagtggggtagataggagccaaaaagtttgagtgaagtcagaataaatatattttaagtgtggatctgtggagaagaaagaggtcccaagagcataatgaaaactgtggttaaaactgtgaatcaagaggtttgttttaatttgccattttcttacgaagttttaaaatattttctaataaagcttcttatttattgccttagtacattttctgttacttataacagaatacctaaaactagataatttatggccaggcgcggtggctcacacctgtaatcccagcactttgggaggctgcagcaggcggatcatgaggtcaggagatcaagaccatcctggccaatatggtgaaaccctgtctctactaaaaatacaaaaaaattagccaggcgtggtgttgcgcacctgtggtcccagctactcgggaggctgagacaggagaattatgtgaacccaggaggtggagcttgcagtgagctgagatcacgccactgtactcctgcctgggtgacagagcaagactccatctcaaaaaaaaagaaaaaatactagatagtttataaagaatgggaatttatttctgcagttatggaggctgaaaagtctaaggtagaggggctggggctgcatctggtgagaggcttcttggtggtggggactttctgaacagctccaaggcagcacagggtgtcacatggtgagggggtgagcatgctaacatgctagctcagttctcttccttttcttataaagctacctgtctctcaatattgctgcattggagattaagtttcaacacgagttttggagggggcatttaaacgatagcatatatatagtgcagcagtcccactcctaggtatttacccaagagaaatggaactatatgcttacacaaagacctgtaccctttttacactttttttttttttaagacagagtctcactctgtcgccctggctagagtgcagtggtgcaatctcggctcactgcaacctccgcctcccgggttcaagcgattctactgcctcagcctcctgagtagctgggactacaggcacgtgccaccacagctggctaatttttgtatttttagtagagacaggtttcaccatgttggccaggatggtctcgatcccctaaccttgtgatccacccgcctcgggctcccaaagtgctgggattacaggtgtgagccaccgcgcccggccaacctgtacactttttgtaatagccaaaaactggaaagaagcagtatacattactaggtgaaaattacagcatatagagataatggttatttctaagcacaaaaaagaatcaaactgatattcctaacaacatggatgaatttcagaaacattgtgctaagtaagagaaggcacacacaaaaaggtacatacttaataattccacttgtgttaaattctagaaccaacaaaacttatctgtagtaacaaaaagtagttccatgttcacctgggtgcaggggtgggaacactggctacagagttgcatgagggaacattgtgggtgatggaaatgttgtttcttgattgtggtggcagttatatagatacagacatatttgtccaaactcatcaaactgtatacttcaagtgggtacattttttcttttatgtgtattatacctcaagtataatgaagttgattttaaaaatatatttgttgtaatcccacttttgccacataaacagggtccagagaaatattaggtattccttctctctctctcatgtatatcctgatcaaaacatttatatgaacatattgaaatcagatttaaatatcagtttccctaatggactcagctggactcaagttaattgacttaataaaatttcgaatctcatttgttcctattttctcctccctacagttgttatctttactgttatttgaaggacttgaataagtgaattttgaattcagataatacactatagggagtaggaaagcagacccctggcctcaggagcgcctctttgatcatgaatgtctatgactgccattttgttctctagattcatgtctttatattgtctatttggcttatagttttttctatcaccatttttgttttcaactgttttttcactaaaagacaaaatttgattttcatgctattaatttcgtactaaaaagagcacagcaggcataattaaagcattttaagatgtagtaatttgatttaaaatattttactaagcgatatattacaaaaagttatttaattatctgtaaactttaaaagcaggtattagcattctatggctattgtctttaataattacattttaattttaattttagttttttaaatgtatgtttctttttgttgttgttgttctgagatggagtctcgctctgtcacccaggctggagtgcagtggtgcgatcttggctcactgcaacctctgcctcctgggttcaagcaattctcctgcctcagtctccggagtagctgggattacaggcacctgccaccacacccaaccaatttttgtatttttactagagacgaggtttcaccatgttagaaaggcttgtctcaaactcctgacgtcaagtgatccacccccctccgccttttaaagacctgacatcttagttgttactgtgaaattgattttcttgttttctcctcatcttaaccttgttttatatatcaaagtaaagaagaggaactgttaaaacttatatgaagtatggctgaatcttcaaaaagatatcaaatatttagaaactaattttaagctgcatatgttttatgaatggtagcaatacaatttataactgtcatttctgaaatctccggatttaggtctccattgccaaaaaatgtaaaaaatagaattatgacaagtgatctcttgaattaaaaccaaatgtttttgtattacaatacctgtgatgatgattccaaacaggcttctctttaataagtggccacagtagagtcatgatgttagcccttatatttataatgaggacaattctgggtcaccaagggcctggatatgggacccttggggcccactgtgatatttatggacatgaaatacagtcataggccatttatcagatttatcaaatttggaaacttccaaataaattaatttgacaaatatacataaacttcagtaaattttattagttttattttttgccctgtgtatttgcataaatgttactaggaaatatatttaataaaagtagaaggattttttttttttgcgtgatactcagctatattcttccaatagttgtggaacagcttagtgccttcagcagtggcagtctcctaaaacgattgtctatcagttaaaggttaactgagtatttggaccaagtagcaaactagaattcttttcatctaatctctgtttaatatagggatatccaatataacatccttgggtcagtgtagtacatcttacgttaagttttgtctctaatgaatatttatattacataaatgggaaaattggtgggttcccttggtagaaacatgatattggtatttttaaagtaaacttaaataggtcagaatttttatcctctagagaaaatttcacgtctgattaaatagtttacataaacttaatctttttctgctagatgcattataatctcagatattattcatgtagctattcctctgtgaaccataaaatgttcatttcttcaaaatgaatatgaagctcaaagcattagtggtcttaagagcataaaaactttattactttgtgcttcacatttttcaagtgactttggaaagccgaaacaaattttgcatttagattaatggaagatgttttccatgtgaaggaactggcaagggagcaacaataacaaaaatcccccaaggttaaaaatgtagtgcttttgattcttcccagaactgtgttagcagaacaatcatttctcagcatggaaaggtatcataattggtctatacagtggcaatactgaaaacgagtatgcttcagagaaagctaatatgactctacttaataatttccttcaagagcctgaatttgaatgtatgttccacccagcttgaggcaaacaatttgttcctataagttctagtggaagttaccggggggtcatgtaatttatttttgtcttgaagttttcaaaactgtgtagaaataaagacacgtttacttgcattgttccactagtaatttgatccaattggcaatgctcctttctcttcttctcaattctattatgttggaagagtggaagcgttcataaaatgttgtgacaaacaattcttcctagagacgtttcctctttctgtttgaacctctgatccacttgcgaatgttagcattctttttgtttgtttgtttgtttttgagatggagtcttgttctgttgccagactgcagtacagtggcacgatcttggctcactgcaaccttcacctcctgggttcaagcgatcctcctgcctcagcctcccgagtagctgtgactacaggcatgcaccactacacccagctagttgttgtatttttagtagagagagggtttcaccatgttggccaggatggtcttgatctcttgacctcgtgatctgcctgcctcagcctcccaaaatgctgggattacaggcatgagccactgcacccagccaaatgtttgcattatttagtaagtggttttttattatgggtctttacttacatgtgctgttattgtccttttcactgggattatctaggttttcaatctgtttctttgtattaattttttggctatgggactagttttaaagccctaccacagaagtagagggtctgtagttggagtacggtgagtaacatgagagaatgtttcctttttttccttgaagaatggatagttttaggggaatgtgtgcagatgtcagaagatggctacatagagaatgaagcatcagaaggtagacacaggtctctgcattgcaaatatcagtaacagggatgaagaaagaacagcaaaatttttagaaaaagtgtaaaggatggttagacacttagaccctctcttttataagtttgattgtgtacttctaagaagcagcaataagttgaaggtaaagttatctcaatactctgataagatgtggtctctggattcataccaaacattagagttcaaggcattccccttcagtttattttatattcctcaaatgtatctaattccttaggattaatgatttgtttctcttaaaaacagcatttattgctttaatctgagaaaaaaataagacttccagtgtttatatctacaaacacaaggattgaaaaaaattttataatcagcctcgctgctaattcttataggtgaagcaatgacttagaagaatggggagactggagtacatgatagttttgtagacagccacagttggcaaaagatggtggtgaggctgtccccgttgtaaatcctttatctccatgagagcaactgttgctggctagtttcttgtgaattaagtatgcagtttgtcttttttttaatgtgataaatgaacgtattttctaactggctatttgcttaataaaaatgagtaatataataaggaattaggggagcattggaaagataatcactgggaggtgagaaaaaaagttatctctctgcttcagtcccttattctcatctttatagatcagttctcccagtgagaagccaaatgggatgtcattctttgtttgtttgtttcattaattctttgcaatctatagtaggactgttgaggagaatgtataaactgcaggttaccagcaggtggaaggaggggaatgagggcaggtggtccataagcagaaatattaattcttgactgattgggacagtgaatattgaccaacattgaaaacattatattatggtcttatttaggcctgaacactgacagccagttgacaagtctaattttttataacttaaatgtggttcatttaggaaaaactgccatcaagggcaattcaattctattatgacaattaactctgactttgaagtaagtagaataaatcagtttatttctcagtaaggcccaaataaactgagattgttgtgaaaattatgcagtttgtgactacagtgtggatgttgtgtgttgggttgtgcagtgtacaacctgcaaagctgtatgaggcaacctggacattctactcctagctatatacccaaaagaaaatacatgtttctacaaaaccttgtacagaatgtttatagtaccatcattcataatagctaaaaagtgaaaacaacccaaatgttcataaactaataagtggataaacaaaatgtggtgtatccataaagtagaatattatgtagccataagaaagaatggagtaccacacgtgctacagcatggctgaaccttggaaacattatgctaagtgaaagaagccagacaccaaacggcacatactgattgtatgagtacatttagatatgaaatatctaaaataggtaaatccattgccagtggctgaaatggggagtgattgcttaatgggtatagggttttcctttgggggtgatgaaatgttctggaatcagacagtggtggggttgcacaaccttgaaaactactgaaaaccctgtgaaatgtacagtttaaaatggttaaaatgatacattttatgttgcataaaagaacatttaaaaaaattaatccagtggggtctgatggcaaattgacatgagggaacttttttgagggtgatggaagtgttatcaatctagattagagtgatggttgcacaactgtataaatttataaaaactcatcaaactgtactcttaaaatgtgggtgtattttatggtatgcaattatacctcaataaagctgtttaaaaaaaaccctctctgagtcattactgaaatcagtgccattttctgaatttcagaaatatcaaaggagagctttcctagtgtgaatttatcataaataatgtttggtattttttttcctttgacttaacgagagcctgagatgcagaaacaaatctgcacttccatgttgtgttacccgctttgggccatggcccatttgccagttgcagattgcctccttgtctgaaaatgggtgtgtttcttcatagtaactctcaattctattgttggtgacagcgcaataatggaactttcttctgtgtggataagccccttcagtgatatttgcaaatcaaatcatatctgctttttgtgctacattgtcctcaaaatcttctgattggtttggttatagacatccctatatcagctttcctgttctctttcagtttaaatatctgtatgctgtagcaaattgcattatgaaatcctctcacatttatcgctgtttagtgcatggaaatggcatttcctcattaccagtcaaagataaactctaaatgtttctttttttttttttcctgaagtatcaaattatgtattcaaaaaacttttctctatagcattatttctctgagctgtttcttttttccctcctgaatgctgacaccagatgcagtctgcatggacattagtcccagggaaatcttgtcttctacccaggacaaggagattataggaagcaatgctgactcttgttgtagattcacaatgtgctgacacgataataggacatgaatgggcttttggaatgccttttcctttgagctgggctgagagggggacagaggcagacagctccatggcctgaatttcgttagctgtgtgacaatgggagagataagtagatgtgacagttatgaatgatcctctgtcatgcactttcacgttcagattcagataaactgacactgctgtcaaacacaagctatggagagctgagacctctgatgaaccttctaatatggtaaatgggagtcttaattcttcattaactgaaaaaaggagatttggccatgtaattttctccttgctgcctgttttaaagattccaataacccagcatttacagttgactaggcagggattgcttttccccccctacacttgcaacatgcagactgtgaaatctgaggaaacgctgcttaaacccagacttattgccttggttatctttaatgactttgaaatgtattggcctcattatggaacagtgcagttatcaattcctctaattaggtgatgtgctcccataagaaatttaacattaaagcacaaaaatgaactcgttagaggcatctattgctgggaacttcagtatcaatggtgaattgaagatactgtgtttcgttaccaactcttctgcaccatacatctgactcctccttgaagactagagcatgggcatttttttctttttccttaagggtttaatcctcatatagcacctctaacacctttgatgacattttagtgcttctggatagtaaactgtgtgcctttgactaaatcgactaggagtctagggaagggaggaggtgagcagtttacatttaaatgctccacatatcagcccatctttctttcttggaatttaacccatggctatttactctttcttatgtaagtccaataaacttcctttctataagtagcttagtacagtctttgtttttatcacgatagggaccattatttgtttattaaatagtgatgctgtttcactcataaatatttcagctgtatttctagagaagtaggatggggtttctgggtttaggcttcagtgaagggactttaagtctcttaacccttctttacctcaatcatccatctgaacaaaaaaaatcattatagcctcccctttggggaaactacatagtttaattagtgttttctaataacttacaaatccttagagaaaagttatagtagaagcataagaaattatctttggggttagtttattattattgctattattatcattattactatatgggactagttgtttttttaaattggctacttgaaaatgtgtttcagatctcatggagtgaaatttacctttcatttaccttagggctcaaataagagtatactgaatataaaaatatggaacactaatttctttaaaatacctgaacctattaatagccaggagtgttaacttcgtcacctggaagaagatcctgtcctaacttgaaaatgttagaatgaaaaccttaatcgtctcctctcaaagggtcattgaggaagctgggcttgagtctgtgcagctgttcttcaataatgttatatcattctgaaccaattatcatccttaacccagatttgctttgaatctctgtggcatcttgactactgtctataacaacggtgattgccagacactgcctgatgctcaggtttctatcaatcctcttcttctcctcacagcaggtaggagcttcttggtgttccgctccttacccaggcttgaggaatagtcctactttttgccatgatgccttgctgcagttctggctcttcccttgtgctgttgttctctttgtcatgcaggtttcccagtatcttagtagaagccttgaacaattcctattaccttttcagaccttccttccaagaactgggggatgggggtgttctggtcttgtcacaggtgggtgccacatgtaaggacccactggttcatgggattctttgagagagtctgacgctcacttgtctgggttaaaagtctggtgctgacacctgctttctgaatgactttaagcaagttatttgacttctctttgcctcagtttcctgcctacaaaatgaagataatagcgcctgtcttatcaaggttcttagagaagattagatgcattaacacatgtaaagcacttagaacgctttaagtcacatagtaagcattaataaatatcagttgctaacagcttttgcttctgctctgttaccattttactatctcacctctctcatagcccataacagcaaaccaaactctttggctcttggtagatatattattcttaatgtttgagccctactatttgctattgcttccttttttactcctataatgtgtgaaattgaaataaaaaacagaattgaggccaggcacagcagcttgttcctataattccagtgctttgggaggccaaagtggaaggatcgcttaagcataggagtttgaggctgcagtgggctatgatagcaccactgtactccagcttaggtgacagagcgggaccttgtctcaaaaaaaacaaacaaaaacagaattggtcaccatgatattaaagagccatgaaatatattagcatgtcttttttctgcctatcccctctatcctaaacattccatgtagtcttgggaaataaattctttaaggtaggccagttattatgaatataacatgattatctattgtgttatgtttactgggttgatgccaaggaaaaatgaatatggcaggtcccagcaaataacaacaacaacaaaaatagtattgtctactatttcacagagggtgtggagttagtattgggttttgaaggatgaataggagtttatcagatgaggaggattgagaagagcattcagggcaaaggtatgtggaaaaattggtgtggtagtacacgccaatcctgggaccttcaagttgaacatttaggagtgtagtgtttatgtttcagaagcagaggatgagtggagagggcagcaatagaatggcattaagacccttgtacagtatactaaggagtttggacttaatcctgtgggcatgcaggaccctttgaaagatttgcagtgggaaagtgatcggatctgatttgctaactcattgcaatggctctgtggaagaatatcttggagaggggttcaagacttgagccaggggacatatcaagtagtgtttcaaatgctaactaccccctcctgcttctcacattgctaaatagagtgcagcagaatgaggtgtacttctgaagacaggtttttgaatcagctttccagcagtcccttgagtacattgagagggtgcatggagggaagacatatcatctttaccctgccctctccccatgttaatctattaaaagagatgggagcaaagctgctatcacattgggcttgactgaagacagaagtccttgagcatccttcccctgagtgcgggcaagcctcgtgcttgcagaggagaggagattagaataacatcttcactcttcggtgagagggcaggcagaccctcacactagatggttccaccccggagttcaggcttctcctgacaagtgttgcgagcatctgatgtccttggcctctcttctgcactgcttaccttacagcagttaagcatgagggcattctgtgtcttcctttctttcccttcagttgcttaaagaagatgagaatttgctttaaagaaaaatattaataaatctttataaaatggcattaaatagaaaatctcacactcttttcttcagaatgcttttcttcaattgccattgtatctttttgccccttccaaagtcttaccaattattattaatatatattatcataattacttgtagaaaatcaatagaattgcttgtctttatcagcagtgctacctttctacctctctctcccttttcatcctctcttcgtctcttgcgaattgttgtttctgggggtattattattgtaattacggaaattgataaaaataccatgacaatttcatgcctcagaattattacacagggtttataaaaaaagattattatacatcaatgcagtatttgttattcctaaatgattattccagaaatactaatcaaaaacatctccctgcagaatagtactgtggctttaatatcagctgctgtttctttgaatggggttgcccaatctttcatcaaagaaacacatcacccatatccctgtctttaaaaacagcaattatgtgtaaatgcctcctgatttatttgagccagggccactggccagtatgagtcaccacaatttattgctaaccgtcacttttacatgataggtctgtaacaaatatctgccgcatattgttaaattaatcttccatttaaaattaatggagttagactccccaggttcaatgtaatttcatgttcacgggcagggagggatgtgtgctgcatacaaaatgagacaaggcccaacgccctaatctttcatcaccttgaacctggagactaggacgcgtctcagcaccaactaatgagattgagcctgcgtctctcctgaggatgccggctcaaagaggcttttctgctcagaaatagcaggctctgtcttattttaataattcctcagatatgacaagtctgatgttatgtatgaaagagccaggcttgaaaaagagataaaatgaattttatatcattacttcaaaaccaaaccaagggaagtgtgttgtagttaaattaaaaaaaaaaaaagataggacacattttagtcatgaaatatactgactgtaaaccaggagtcatcctttcatttattttaatgcacaatcaccttagatttctcttctgtaatttttaaacctattcatgcgttaatcaaaataatgtggatgaaagcaggagcttgttcaataaacatttagatgaaaatatcagaggggacatgtaattcctgatggggtatgtcatactgaacctctgaagtcccatcgcttcttttggtggcatcttttgaaaatgcatcttttttctgtgtaccactaacctattactgtttagtctcttagactttaaaaatgcctaagccaaattactcaggggtattgggttctctcgtttttttttctgtctttttcacaaaccaggtaactattttgcatccatggaaaagaaggttttacagaacagatttcggctctcatacatctatagtacttctggcaaatggttgctgtttttttgtttgtttgtttgtttgttttaattcttagggaggactgagccccagagacaatgggacccttttcctaggtaaagaaaacgtctctagaaagacactaagttaagagccaggcaaggtggtgcacacttgtagtcccagctacttggaaggctgtgacagagaattgcttgagcctaggagttcaagaccaatctagacaaacatagcaagacctccagataaggtaaacttcctggtttttaaaaattctgtgagttgagttctgcttcctcagaggggaattctaagtatctgcactttgtgtctgatttatttattttatttttttgagacagggtctcactctgtctcccagtctggagtgcagtggcacgatcttggctcactgcaacctccacctcctaggctcaaacaatcctcccacctcaggagggagctgggactacaggtgcctgccacaacacctggctaattttatatgtttttgtagagacaggatttcatcatgttgcccaggctggtcttgaattcctgggttcaagcaatctgccggcctcagccactgtgcctggcctgtgtctgatttataatacaacatatgattgattttaaagctcttttttgtgatttgttgtaatttgggaccacaataattttttttccaaccccttcttcagacatacataataaaatttctaaagaagtagtattggtattatactacctatagcttttattattattattattattattttactggcattctataacttagaattctattttcttacaatctttgtatatttaaatgaacattagggatagaaaaaatgtaaactctaatacaagaatcaagtatagtcacttaattgacacgtgcagttttaaaaattatagtcaccccttggtatactgagggaattggttccagtaccccctcaccttcacccccatatatattcaagtcctgcagtgggtcctgcagagccctgtgtatgaaaagtcggccctctgtatgtgtgggttttgcatcttttgaatactgtattttaaatctgcatttggttgaaaaaagtctgcatgtaagtggatcaaaacccatgtggttcaagggtcaactgtgtatcactttgataggctatttataagagaagattttaaaaatattgctccatgtctgtacttgaataagatttagaaaatcttaggggtattttagaaccagataaattagtaaaaataatgatactgtaaattggaaaataaatgaataatagtagggcatctttctccatgaacctgaattgctttgctttcctctcttttgatgtctgtaagctgttgcgttttgtacagtgggcctcagggtgcttcgtgagtcccaaataccagatttctttttctctcttctacttatagtatatttgccttaagttcttgatattttcttctgccctcttttcttcttttaatatcttcagcatttttcttcttttttctttctctccctctttccttcccttaaaagggcttctttattttatatagaaactcatctttttttgttttgagacagggtcttgctttgttgctcaggctagagtgcagtagtatgaatcatgactctactgcagtctaaacctccctggctcaagcgatcctcccacctcagcctccaaagtagcctggacctcaggcatgcaccaccatgcccagctaacttttgtatttttttagagacagggttttgccatattgcccaggctggtcttgaactgagctcaagcaatctgcctgcctcagcctcccaaagggctggggttacaggaataagacactgtgcccagccttcaatttttttgttattgttgtgagtgagtgagtgagaaagagagagagagcgcaggttgatatgctcaagcttaaggtctgtaatgggtttaaagctccaagttttataatcggaatggtagagacggaaaggatctctgatctaatccatcctccatttcataggtaatgccatggaggcctgaaaaggttaaggttctcaaagatcaaaaatgtatccttttggaaagtattatagtggttcctcaaaaaaatttaacagataattaccatatatgattcagcagtcacacttctgggtatataatcggaattaaaaacagggacttggacagatacttatattccaatgttcatagaagcattattcataatagctaaaaagtggaaacagtccacatgtatatcagtttgtaaatgaataaataaaatgtggtatatccatagaacagaatattgttgttacttttgtttttgagttgcattttattctgtcactggggctgaagtacagtggcacaatcacacctcgctgcagcctcaaactatggggctcaagaagtcctcctgcctggtactacagacatgagctaccatgctcagcctggaacattattacctagccttaaaaaggatgataattctgacagtctgcaatacgaatgaatcaatgtaatttgaaaacattatgctgattgaaataaactacacacaaaaggataaatattgtgggatttcactgctatgaggtacctagagtagtcaaactcacagagacaaaaagtcaccaggaactgggaagaacagtgggatagggagttacccattcatgggcacaaggtttcattttgggatgatgaaaaagttctgcaaatgaatgttggtgatgattaataatgtgaatactcttaatgccactgaccatatacttaaaaatggttagaatggtaaaaaaaaatttgtatatttgccacaataaaatacacagacactggtatgatttggctctgtccccacccaagtcttatctcaaattttagttcccataatccccatgtgttgtgggagggatctggtggagagaattgaatcatgggggcagtttcccccattctgttcttgtgatagtgagtactcacaaggtctaatcattttataaggggcttttttcttctctgggcactcattcttctctctcctgccaccttgtaaaaaaggatgtgtttgcttccccttctgccatgatcgtaagtttcctgaggcctccccagccatgcagaactgtgagtcacttaagcctctttcctttataaattacccagtcttgggcagttctttatagcagcatgagaacgtattaatacagacacgcacacattcttttattacctgagaaaatttctggcaattagtatgtctgtcctcctctgcctccatctctgtagctaacatttggacattcctctgtttcagtttcagatttgctctcataatgtttttgaatgttacatctttccctttcttatttcagttttctttttttctgacattgagtacgtgctttgtgatagtcactagagatacaaatagctcagaatcaaagaaagagtgtacatgaagtattttcaagaatatgcctataaaatattcaacgatttctcagaaaatatcaattgtaaaataaataaaatacaacaaaactttcttatttgcacaaatgcgtaaagtacatgtagtctaatttaagtagtttttattttttttctctaaagtaaattttgtgactttttttttttttttgagatggagtcttgctctgtcacccaggctggagtgcaatggtgtgtgtgatttcggctcactgcaacctctgcctcccgggttcaagtgattctcccacctcagcctcccgagtagctgggattagaggtcccagctaccacacccaactaatttttgtatttttagtagagatagggttttgccatgttggccaggctggtccctaactcctgaattcaggtgacctgcctgcctcagcctgccaaggtgctgggattacaggtgtgagccactgtgcctggcccaattttgtgaccatttcatataatattataagtattcctttactaaggcaacctgttaatataggtctctcagttgcaggcttttcttattctatggattgactaagaagcccccaaaaatccttatgaggaaagatagagtcatgtgtcataagagaaggctagtaataggcttgagtttcaaagaaaagagtttatcagactgaggagtaaagaacgttggtaactggccttcaaaagatagttaagattgcatccggaaagatgtggggaaggggatgtaaaatggatagcaaggcaggatagcaacagggcattcttggaatagacaaccatccatttgttctcagtgtgaaatatacatggttttgtaatgggaattaaggccgaaatggcatgtcaaggccagtagttgagagctttgtaggtcacattgaagagtttgtatttggagtttgatggactcctaggatggatctgtccagtggacaactggatttcagacctaggagagcctctatagaggtattaattgaagcctttggatgatcgagattgtgaagatagaatataagacagagcctcttgagcatttctcccttagtgagaagaaggtggtgatacacagaaggaaccttcagcaaggtgagaatgatagataaaggatggactttccccaagaaacctggcaagggagtgatcaggagtgttaatactgtcacagagactttaaagaggatcacaaatgaggggaaaccttggattttaatcttgactcttagtactcaaggaaactgcatgttaagatgtggtaattaaagtattaaaatattctaagggtcccttgcactctccctttctgtgcccattgtgacagcatggtcacatcattgcttgaggcatgcaagagtgctttattgaagatagtattacggggggagattttattttgatagagagtaacaaatagactaataatctatcttaaagtaagtatcttaaagtcagtaggcaaaggagaaaaaaagatattgataaggaaagcatctgcaggacagattctagatttctgttttttgttgttgtgtatgtcagggcccagactatgtaaatgatagggcaaaatgtgagtagcaacatagtcttattagaaacctaaatatctacaaagagagcaaaaaactatcaagtcaagaatatgttacccattttagtaaaaaggttagatttcatttgccttgtgtatttgtgtgtgtgtgtgtgtgtgtgtatgtatgtatgtgtgtgtgtgtgtgtgtgtgtgtatgacagtactgtattaggaatgcttagtaggcatttggagaagttttgggtgattggtaacatgaaccattcttccctttaatctggtgcatctgaacatattcctgggcagaaggtatacctgtgcacattacagacgtttgtgggtacttttatttcattatcctcaagcaagaatacgagattgctatattctacattagaccaacttgttcttagcaagcacagaataataacctttcagtgtgaatgtttgtacataatagtagtaggatgtattttgtggtattttttaaatgaggattcattttaggcttggcacagtggctcacgcctataatcccagcactttgggaggctgaggcaggaggatcgcttgattgagcccaggagtttgaagccagcctgggcaacatagtaaaacttcatctctacgaaaagtacaaaaattagctgggtgtagtggcacatacctgtggtcccagctacttgggaggctgaggtgggaggcttgagcctgggtggtggaggctgagtgagtgagagtgtgtcactgcactccagcctgggtgacagagtaagacagtctctcaaaaacatacatacatacatacatacatacatacatacatacatacatatgtacatgcatacatacatgcatacaaatgaggattcactttaaaaagcattgaaatgtaaatatcagctatacctgaatgtttataatttaaaggtaagattgtcattaaaggaaaccttaggaatttctcagacatactgaaaatcagcccgaaagtgttttctgttgtttggttgttgtcgttcttttaggattttatggagtactctcattacttatcacttagaccaaaagagaatgtcaaactgccaacaaagttgttttttctacatttctactaaataatgttaagtagtcaggttcatctttggaaggaagattcttaagtgctttggcctccagtagtttagatgagacttcttaaaactcaaaatcattttattggaaaatgctttattttctgtctttgtgaattatatttataataatgcatttaatttaggccttgggattttgtatacctttgggtgggcctcttcctcttctccccctgcatctctaataagcactgaatatcaaattgaaaccatgatattctgaaatcggaaagtttctgccttttgcagcttatttgatgggaataaaaatgactgatggcactctctcttggacccttttgttcaactcacctatgattatggagcctattagctggagttacaacctatttaagagcagtgcttaccagtaatgggggccaaatgattttggaaagttcagatgtactggactccctgcagaaatgaattcagcactgaacatattgatgcagaacccgaacgaggctactccagtgggacaaagagaattgtgagctctgcaagaaatgagtgggtagtagaattaaagatcagatagatgttcggctcaagggcagtctcagctcttaagttcatcacagcaatttaatcaggcccaaatgagcgttgcccagaaaggaatcagccttcggtgtgacaggaaatggagtttatttaaaagattctttgtttctagtaattgtgtgttaaggttttccaagtctacactaaaattacggaactactacatttgataggtgatagcactttggtttaccttggttcagaagatgtactgttgagaagatttatacaagtcatgatcttgtccagaaggagcctgccacctcaaaagttccagctctatcgtcttttggattaagtaggccagagtgcatctttggctatagctatctgatgcccccttccattgtaaaattattttcacaaaaatatatttgtctacagtaagagttatataatatagcagtaaagaccacaaactttagaatgaggcacacctgggttggaatcccacctcctccacttgttagctatatgaccttgagcaaattacaactgtagttgaacacatagttctttacttacgaaatgagaataataattcctgcctcacaagattatggggagaggtcaattaaatgatgtagtatgtatcagttgcttcacaatgtctgcacataataagggctcaataaatagtagttacagctctagagctctctcatcttgtccctcacctcatttgcccactcctctactctcttcatgagccagagtgttcactgctttaggaataagtgagggaaactttttttttcttttttctttctttcttttttttttttttttccgagacagagtctcgctctgtccccaggctggagtgcagtggcacgatgtcagctcactgcaacttctgcctcccgggttcaagcgattctcatgcctcagcctcctgagtagctgggattataggtgcccgccaccatgcccggctgatttttttttttttttttttgtatttttagcagagacagggtttcaccatgttggtcaggctagtctcgatcttttgaccttgtgatccacctgcctcggcctcgtaaagtgctgggattacaggcgtgagccactgtgcccggccaaataagggaaactttttagaggatctttggcttcagtcatggagaaaaagaagaaactataaacacttggaggtctgaacagttcattgattgttaagaacccaaacaaaaacactccgtccccaaccccgacacaacaatacagtggggtattttggattgacacattattagcctggaaacctatattgacagccaggttatgattttacacatgtaataagaagagtctattggtttttcttctttgttgctcactagttcttaagtttgctcactaatgtataggtatttttgtctaacactgacaaaatttgaaaagaagtataataaatttattaggattttacttctctccttcatggacctggcaaatagtgtatctatgtctccatacccatatccacgttcttattttttttatctgtatctattatctgtctctgtgtgtgtggaaagtgataatgaatgaatgaatgaatgataaaagatccaaactatgaactttatggatatcggggtaaacatccaacaatcccttaaatttggtgcactcaagtaaaagctgaactggagagagttgaccagatcctcttaaagttaagctttttatccctctgcccataatttgtaccttgagatcctatagggatgtgcctaggcctgtgtgaatggcagcctcatctatgctgtacctgcagtacagaccagcctcatctgtgctttacctgtaatacagagcgaaacatatctagagaaagagattagtttgcaattagggggatcccacccattccacagcttggcccagtggaggttccctgctttgatcgtctcttggtgaagagaagaagagacagcaagtgctgtagaaagttttcttctttgtagttaaagtgatagggtggaaacaggagcatagaaaagacattcagagaatagaaagtgaccaaccatttgaaaacctaaaggaagacctgggttcaaacatttgttaacatacagagaagaaaaatatgatctgtttggggtattacaatccagtgtgtattttctatcatacttaccaaatgtacttacttgttgtaaacatttaatatttgtttagtgctttgaagattcggagtaatgtttcagatctacatattgtatcaataagcaaataacatatgctaagcacttaaaggctattgtcattctccagctagtacagagcaaatgtgaaagggtaaagactatgtaatttcaggtgcggtttcagtgaggaagccagaacagcagtctactcttatctgctgctttcttccaccccaaccccctgacccataacaacaaaaatcaaacccagaacaaaccgcatagattgatcaaagagcataacatgcattgttaggatttcagatatgtagacagaaagtcagattaagctttaatgataattttgagttcttggagcaatgctcattgattacaatgtgtgtgtgctggggagcaatatttggggtacccataccttccctgggcatgttaaccttgtggggcttgccttgtttcagaacatgtttcctattaaaaaaagatgactgtaaaatcgtaggccttttctagcatgcacctcaaaactcttccagcctctacccatcacccagttccaaagccacttctgcttccacattttagttatttgttacagcagtaccctcccttcttggtaccagtttttgtcttagtccactcaggctgctataacaaaataccaaaaactaggtagcttataaacaacagaaatttatttctgacagttgtggaggctgggaattacaagatcaagatgctggcaggttcactgtcttgtgaggcctagtttctggttgtagatggcaccttctagctgtgtcctttacatggtagaaggggtacacgagctcctagggccttttttctaaaggcactaattcactcatgaaggcttcaccctcatgacctaaccacctccactaaaggcccacctcctaataccatcaccttggtagttaggatttcaacatgtagattttgagtggacataaacattcagaccacagtccctgtgaagaaggtatttgttattctggcagtgcaggagcaagctagcacacttgccatatttagctgatagaagtaatgtgaaatgaaccgttaggaggagggattttgtggaagaaggaatggcggactgagcaagataaaatatggagaattgctccctcttcaagaaacgcctccatcctgatgtatatcagctttcatatccccatggatattttacaggcattgctacctctttaaacatttatgctattaaaaaaatcagaccaattgttgacataaagctaacatagcagcttctatatagacagaatatgaattttttatgctgttgatgagaagtttatgtcatttatatactatagtagggtagaagatggatttggaatcctgaaaaagctactgtttgtaccattcagaatattagcttgtgctttgaatcgaaatattaagatacctgtattgtcaatgtgagtgtttctgtgcaaagtggcttacatatgggtggaatgggagaaattgctctacctggagaaaatagcaatagttttctttcgtttatgttttgttttgtgaaaggaagggttaatagcatttaatacctgatttatctgtgcttctctgcaccattaaaagaatgaactgttgtggtaataaaaccatatttcattgaattaaaagtgccatcacttgcaagatgcaacattattttatgtacctctaaaaaactacactaacaaactgacatgtcaaactgacatgccattgatgttaagatgcattccaatttcagagatgtaaatatactttaaaatgtatatcttggaatcaatgaaatactgcatatagttcttttgtggtatgtgtatatatgtatgtatacacacacatatatacatatgccacaagagaataaagtatacttctatttggttatagtctataatattttgaatcattttactgagttaggttttacttattttttaaagttgctgttgacatctgtttgataccattcatttaacatggcatgaatttagaatctctacttagaatagtcctttggaagccctagtttgttgagttttcaaaagaaaaaagagtctggtgcaaggaggcagactgacattcaagtcagatcattttttaaaaaaggaaagaaaggagggagggaggaaggaagaaaggaaggaagaggttcatcctgtcagttaggaaccagctatcttacttttcaaagacaaaatcagatcatactagtatatcacaatcccgtagtttatctaattgcatatttataattcttcttggatggtgtctctcatcttggattacctctctcacccaaaatcatattttattttgttttgtcattataaaatttactatatgatcattgcaaaacaaaaacaaaaaattaccagtacatataacaatactggatgtcatatattaagttcacaataaattatggcgatttttccacatcaataccttatcttcatgtttcacatcaatacataatcttaatttttagtgactgcatattatatcattgtatagtaaaacataatttttaaccatttccctattgatggacatttagattggttgcagtttatcactttaatggcatggctgccatgtactttctttttgtcacacttacccagtgatcattttaggatcaattcctagcaatttctggattgctggatcaaaggctctgtcttcatgttattatgtgttgggaagggaccatttcctcatctgttcaccaatacaggatatcagccatctcccaccccaccccatctttacctacttgattggttaaaaaaaaaatctatttttgtttttattagcatttttaaaattgtagttgaggttgaacaccttttcatatgttttggccttttcagagtggttcttgataatagaaagcacagcaggtcagagagcaaaaggtcttaatgaacttccattctgcttcacagaagcctatgaggttttgaggtaactttctcaagttcgttataaagaagatgaaactgatagaaaataactgtgatgtagagatggggtctggcccactttcagctggtctactctccagcactggaaaggaagactgagcatcagaaagccagggaagatccctccagaggtccaggattgttctgaggaatactgaaatcaaaaactctagactccttcctgctttctgagatgcagggatttgacagagaggtcaaaaaagggcccctttcctctgcatgtgcagcttttatttactattgtttcctttttgttgtattgaaatgtcttcattgcttgcctttatggatacaaataaccggatactgtaatttgaaagtagttaacaatgaaactgcatagtatgagccatgctgatttttttttttagtgggcaaatggggtgatttctctatgagcctctctgctgtcagaagctcttaacatttgagtcaacatgggaattatatttggaataaattagtaaattcccattcagcatgcctataccatgtaatcttcaggaaccgtaatgactgtgtagtagagtatatttccaacttggtatttataaaacacatttgctctgagaaacccttcagtatttgttcctcaaggcccagccctcatgctgcctcctttgttagtcagtgtttattttgtaatagttgggacagtgttgtacagtggaaacccatttgtctttggagttagcccagacataaatggactcttaggcctgctatttactagcagtattctcatgtttggaaatcaggagcaatgtaattgttgagacaatttattttaatgagagtaagtcatgcagtaagcatcaatcttagcacatatacatgttgtctttttttgtctccctgaaatcttcttcagctgcttccatgtactgatatcttcttccaaattccttaagagccttcatctgggtcatacattgacatttatttgatacttaatattgatagttatctcttgatgtttgtgtatgtctttgtatccataggatcctccattagcacatgtattcattcatcaaatatttattgagccacttctgtatattaggcatagagtaagatgctggaatatgttaatgaacaggagatgtggtcactgtgccctcctaatgcttacatcccagcaggcaagacctatatgaaacaaagtttgaattactaaatgaaagacatggcagttgctattagcaatgttgtaaggggctgtgaatgtagactagcttgtacatgacatttgagctgatatctattggctgagtaagagttagccaggtagaggtgggagtgataagtctttaggcagagaaagcagcacgttcaaagactctgaaacaggaaaggacttgtttcagtggtgcaatagaggatgagcaaaatgttctcagagaatggagtgcagaaagcaggccttcagagaggtcattggcagcgtaaaaatggggtaagaacggcaaccttgtgcagggtcttgaaggccaggtgtaggttccagtctgtcacctgagagcaacaggaagatactgaagggttaaaggtttacctgtggaagagtatcagtaaaacataaatggatagattctaagtgagtctactttaagctggagtttggagtcgcagggtcctgcgtgtgtaccaccatactctctacacttttaaaactaaaacagaaagtattctaaaacataaaacaaaactggattgtattttcaactgttccttcaactctgaaatactatgattatgctagagtatgagaaattttattttccaaacaaatataaagatgtatttctgatgaaaaacattttcaacctaagctaaaaggaaatctaatgaaaactttaaggatcctttaaaatactaatattgtgtttaaagagaaaatgatacttgtctttaaaatgttttaaaacatttaaaatatgctactgaatataagtgaagagtggtagatcctaaagtagtatttcttagaagagtagaataggttatttccaaaatctttttcatggaattttagtgaaagctaccatagggatcatgttgtccagcctctttgtccttataaaaacatcaatatcttcataaatcaagaaaatgagtcccaaaattggacacatgagctacccattttctaagattttgctgaacggaactttgatcataggggtctctttctaaggcaacgtattagaaactcccagcatcactgtattccttataagaatcatattttttacattaatctccagaatcaaactacaagacaattaagttgttgcttttaccaggttgaaacttgccttgatttactatgaatgttggttgccttgatttcttctactttttgtctcagttctacatgttgttgttcttctggttttgctccttatgagattcgctggatctctgtatctcttcaactgtggtgagtttcatggacagggtcagaacttagggaaatgttgagaatagggtgtggtcctatgatgggtcctcctcttcttacaccttcgactgttgtaccactctttgatgttacaaagatgaatgacttgtggtccttggcccagagtttcatattctggataaattattatttatttgtagtgtacttctatatttttacatgctgtcagaatattagaaatacagtgtttcctgtcagaaatgccagctgagcaaaagccagtaagtcagatactaatgaatggattagcaaattatagggactaatgaaattaaataaagattattcaactaaactagtggctcctcccagtagtttagagcgttgctgaccaccttctttttgtccactcacatattagaattaaaaatgtcaaagtaaaattaaaataacattctcacctacaagaggtagggagaaggaaagtaatatttatctttaatgttattttcagttgtgcatttattatgtatatttttgcataaaataacttgtagtttttgtttggacaagccaatcaaatgagtctttaagatgaagaaggagagcgaacccacaagagatgagtttcgtatgtcttctcaaaaaaaaaaaaaaatttttttttagctcaccaaaaaatgttatgaaatgagaattttgaaaccttacctgtggaaatcacagtggtaatacttatatttcagcccttagatattcccagtggtgttttgatcttagatattcccccaaaggtgttgattagattctggctacagctgaaggaagagaatttttgctttttagctgaatagtaaaacaagcctctaaagatatgaggcatgggggaaaaaaactaaaggcttcttcaaggtggtgtaagggcataatttttgtcatctttattttaagagctctaccaggccagacgcggtgactcacgcctgtaatcccagcactttgggaggccgaggcgagtggatcacgaggtcaggatattgagaccacggtgaaaccccatctctactaaaaatacaaaaaaaattagccaggcatggtggcgggtgcctgtagtcccagctactcaggaggctgaggcaggaaaatggcgtgaacccgggaggcggaggttgcagtgagcccagatcgtgccactgcactccagcctgggcgacagagcaagactccgtctcaaaaaacaaaaaaaaagctttgccaaaggtttccccttagtaaagaatttaatacttgaagtcatcagattagatttcagacttcatttacccgctctatgcatttttttcgtcttcctgggtttggtctgcctgtgcttcttagtctacaggtgtcttttctctgtactgccaacctctaattggagatttattaggtgctcttaagtaagagaggaggaaggccaaaggagacagaaaatggagaagcaagaagaaactgatcaaggcaggagagggaggaactggagaggatggagataaaagatgtataaatgaagacaaatggaagaacaatgagatagagaggcctgaatggtagaaaaattctaaaactgagctagtgagaatgcatataaaataggggtctggtagaagaacttcagcaaaagtggtgtaaatcaatgatgagtaaattaatagggcaattgtgcaaatgggactcactcatttatactaagcgtaatacatcatgaatgatttagagataatgcaacccgtagggcataccttttaatctacccaggacccggtagagaatgctgtcacttcaagagtaaaaaggcagaggatcagaatattgggtgtgtctcttcattctaacagtgttaatgagatagattctgagcaacatgaaaattaaccagactcacaagcttagtttgtgatttatagattgaaaagaagcttaatatattccaaacatcttcctacaaacccaaaatatttaagtgttttgaaagtattcatttgaataggttaacatgtgtgattgccatggatggaaatgaaagtaaaatgagtcactgcacatatgatccaaggaacatctgagtgttaagtgggttgtaactgcataagaatccagtgctattggaagatgcatcagagtattctgagaccagggaataaaattctcttccatgtgctcccttctctttcattcgtgtgcctattcactcaccattcaataggtgtctatcgacagccttctgtgtggaaggtactgaggaatgtcctatgggttgctgcttctacctgaaacagaaacataagatttacatccctcaggccctcttaccagtatttttatgggaggatattgaggaagggaagggagaaagtgaatataagaagtggagagaagtcttggtttatagagctgttagggttccaagtctgctgttctttcttgattcagaaatggaagctcacaaaggttgtgtctggaccaaagacccaagatagttggagtgttgaggattagatgattttgggcttcccttctagttcattcttagaatttattcccagtttttgtgtttatgaaagttagagatacagtcttcaaccattaggagttagaggtgaaaataatagtaattggatgttaccaagtatgtaaacacttgtagggaagggaaatacataaataactaaattctctattaaattctgattctgaaaacttcaaaacagacctaatttagtaagaggggctgcatttttatatgtgatcccacagaatgcttctagacttctgtcactgatggggaaaaatcaaattattcaaagtcttgcaccatataacaaaaaagctaaactaagacgagatttcagggagtatagaaaccagcaatttgtgaaaaatcttgtgtatgaagagtcatgatgtagaacattcaaacaaatggatcacaagagatttctcaaagcatgtcttagaggtgagcaggcaggcatcaattttaaaattctctgttataaatgatcataagcttatgtttttctgtgtaaaggagaaataatttcccaattttataaaacaaattaccaatgatgtaaaaaaaacatttagcacagtattatatcagagggcatttaacattcttttgaatcatttgagattttcatgtttccatttcagagatcagggaagatgtgccttggagaggaagcatgtcttaaatctggaaatgatatgaagagggatgtcagcaacacttcatcctgggccagtaatagggagagtttcttttctctcgtcaaattgcttaaaggattctagttccgtttggtgtggtcactcacatttgaattctaatactctatgtgatatagattctgttgactactgttagcgtgaccccaatgagaaattaaacacttccctccttttcatttgcagtgtgttttagtttaaccttcatttgtttctcttttctccattcctcatcccaattcaggtatcagatcctttgacaattgttaacctgcccagctgggatttttggcattaagctatgactgtaacgtttctactaataaattagattttttaaaagagtgctgcttgccaagaagcaaagtcattacatagtgtgtatatgttcaatgtatggctataaaagtctccttagccaaacataatcgacagttaaaataaatttaaaataaccgtgctacctctagattttaaaattgttaaggtgaagataggtggtctaattttactctatttccatttttcttattcacagggtatatttgttctgtaaaaccacatatgtatcttatagtctgcagctgatgtatttatctgcctaaatacacatttctccaatggaatattctgtaatatcaagcatttcttttttagatggaaattaattttataacagttgaacatcatctttgtcaatcagcagctttatctaccataaagaacaaaaacgtacttggcgtggcctgctttaacttttgtagttcctatgtttaaactgaacagaggaatattatgtgaacaaattggaaaattatataaagaaataaaaatctttttactattatagttatctttaccccatagctttcaaaaaggcatttgaagcaatttaataaaataggaataacagtaagtactagatgtgagaggtgagaaaacaactttgtaaatcacccatctcacgaagttgcacagaggttcctgatagcccagacaatgaaataatgtgataattcctattttcagaaaagataactagctccttattttgttttgggtgtagaatgggggaagtggtatatttttgctaagttctaaattcttaggaaaatgttcacatgggttttgagagtcactgtataactgacaatgtccccagttacagatttccagaaaattcagacatggaattcatgttactcattttagttctaacctttgatgaaagattagggcattagattgaagcttaagtaagcaaaggcattcttcaggtgatgtggttcattctaatcagtaattttatgatggtgttcatattccattccaatgatcaaatggactagtaagcttgagaaataagacaaactagagagagagattattttataaatatgaaggaggctagtgaaattttggtccagatggaaagccacccactctcccaggtcaggactgcatagatgaagtataagcaaaaccgtcattcacactttgaaggtgctgctttagagagatgtcattatatgtggtgtcagatttttcaccctgttcagtactgggcactgatttttaaaaccacttatctatattttttaaatgtcttctgactcattggattgattttgtggacctactggtagtctttggatatcccccagttaatctttgcttccatgatgagcatttattgaattctattcttatgccaggcactgtactagattttaggagtacagtagtcaggttttccttgccttcatggagtctctggtcaaatactttggttcttatatagcggttcatgttccgacacgtggttacccacacaggctttagttaacatctgcatcacctgctgcacattctcatctaaaatgcgtatgtgaaagtacagttgtagccactcagtgtcactcaccagtggggctttaggcctgagactttccgatagcctctaattatgtaaaaccatgcctgtattcaggagtcagaagtgatcaaaatgttttaggaagcacaccgtcagcatagatgtgtcaactcagcagcaagatttttcattcttttaaagttacacatttcataaagaagaagggtatcagtgtaaacttctaaatgcaggacaaaatgcatgattggggatggagattggagtggacttgttcaaagagcagcagcaaatgagacattaaaggaatacataggaagccacttccaagtacttccatttttctttagttgtgattgtgagatggttccctactagttagagaaggaaaattttaaaatgctttgctaaacagatgatccttaaattggtcactgtataccgtgatgcagcctaatcaaaatggtattcctttgagtgagtgagccacagagactctcgccaaccccttgtgcagctttctattaacagtataaatactccattgttgtaaagcagtttatggttaacaaagcgctgtcacagacacgttatcttagttttgcagattgcctttgtacatgttattctcatttcctagcatgccctctatccctgctttgcctgcttagcaagctcattcttatccttcaggacataacaccaactctgcaaagtcctcttgagacccttctgagcaggtagatggtcccttccccgtacttacacaagccctgatctcatctctgttgtcatttgttcacatcactgtttctccctggagactgagtctctcaagggtaaggacactgtgtgctcttcatttttcttcccagtgcctttgtaaccagtcttcctgggggatactttgtaagtaaaggtgaatactgtatggtgtgcagcttaggagagcttaagccacttcctaagttaagatactaagtagtagataagagtaaaacttaagtgtcttaactcctgtttttatcggtttttctggtttatcagtttattgctcatctgaaaacaagctgtccacatcatactcatgctgttctacctgtcagagatatattacatggtaaatgtgagtgataaaggaggataagttctttgtcagaatgaggacatttcggttctgtcatcatgcctgaaatgcatgatttcacatgatttccatgtgaaataaaacattggtataaaagggatatggacaaatttgtggatgttagaaccacacctttttctctgaatttattttcttctcactcctacttggcatattccctgtcattgtttgagagtgtgcaccaatgtcctcgtctcagggacaccatttctttcccgctattagagtgtctggatgatgccgtacccttagtgcactgtcctgttgaaaatttggtacattagttattttaaggtttaaaaacattgctgcctacataatattccacctctttggagcatttgcattggagtgaccagtggcttgaagctctgtatggtggagtgactgatggtagttgaagactgcaaaagtaggtatctgagggctggaaggcattcctggcacccctaaaactaccccactgggggccatccaagcctgtgattaacaaaccctagttatttgctaggtagtttccacatggcatagtaggatatatatatgtgaggcacaatacagtgtttatgtgagaataatatagattatttgaatctaggctgcagaacctacctgaaaatgggttttacagttttgtgtaattgccttttctttgtgtttgcatagaaggcattgcatagctggaagatgatggcaattataatttattatgctgtaattgttacctaaatgtttttgaataagcaaaaatcacatctgtttaggaataagttgcacagcaagagaattccctttgaaatgaataccgtgttctcatattctgtaactgtacacataaaacaacatatttatttccccactgagtccattacattcccaagtcaaactgcatcctctcttcctttcccatattaaaccctttgatttaatggaggttttaactactggttctttagggaattttcagtaggctttgcacagattaggttattggaaagtatagttatttgcttgtaaagtggcagttctgtgtcaaaattgcttttctctggagctgcaacagtaaaaacgataagcttctgctttgcatccaaaatgccctgatgttcctagcatgatcgtttttcctttgcttcttgctcagcaccattcggtcacaggctggtttggacaggcgaatatgagcacatgtagcccagaggactttgatatccagtggtgataatagacaaggcctgtcttccattctggttgccactggtctgtgacaaccagtgttccgggcatggtgagcatagtgctgcttcccttctccgttaaataggaaatgcataagcctggagtcgttttgtttgttccacagaaacgtagcagttgaaataattgccttgccatgcccaggctaacaggatttatcttccattatagatcatgaagacataggcaagaatagtttactcctctaaatttactaggctactcacttcgaaatgatttcactgtgtaaaagagaacagtcctagctgtggcttagcctagaaaggctttgatacctagaaagatgaagggcagaagtgtattctctatttttctgctcccagctcataaaatagaattggagtttatgtaaatagcagatagcctgattttattttttatgccccagttgcaagttagtgtctccttaagatgggtcttaatcactgacgttgtgtgcttccattcagcacctatctgtctattaagtggcattctagtggcctccaagagttgagtactttattctgatcagagtcagcctgggtgaccaagatgggctgtatcaatctgttacacctcagacccactggaggccacaatctttgagtgtcttttggaagatactgtcctatgttgttctagaatgctgactcctactgcttaaacctccgttctctctctgtttttatcttaggccagatgtcctttataaattttgattttttgttttttgggttttgtttttggagtttggatctcttagttttcatcctgaatactgttccacactgcatatttaatcagttaaatcttggtctcctggctttgaccatcaaatgttactctattgcctcaactctattgagttactccaactcaactgctcccacctcagggtctttcactacccattcataggcagtagccccttgtttctcttcttcgtgaaacctgagttttccttattgtacttatctcaggcattaatggatctgtgaagaagtatgacgttaagcttaaaggatcaaaaactgggcttccctatgtatgtttcaagtttcatttgtgtgaccaagagagttcatagtatagatttgaagagttcaatcaagaagctaagatattaactcatcttagtaatagccttttgtctacttcatccatctgcccatctgtctgtcaatctgtatacattattgataacttccaatgttgtaaacactgggaataccaaaaaaaaaagaatgagccatgcacctttccttcgtaatgactacattaaagccccaagacatgaagctacttgctgagccttgcagctgacctgtggcatagtggagactagaacccatttctagagggatcttcctcatacttcccaaggtcagttctctttaggcctttggtattcctgtcttagttgttgtaagagtagatttcgactcatcaaacatttgtgatttggaagtatcgcatagttgaagaattgaagaaagctgatgggaacaaagtcattttcaagtttacttgagcacatagatatcatgttgactactttgctgaatattcagaatcatttatatttagtatagtaaaagtgaaaagtatctgtttttaaaatttggaaaacacacgaaatacaatgaagaaaactaaagtaacaaccattttactactctttttatgtatttcctttgagtagatatcaaatatatcagcattttcagcatatacgtacagttttgtgtcctgcctttttcccttcaactatataatcagcatcttcccacatcgtgagatgtgaattttttgaaaacatgataattaatgcaatatgttatttcaaagtaaaaactttttatttaactattattgtgtgtgtaactttattttctgtgtttaggttgtttctgatttttcacccttatcaaccatgctgaggcatgaacttcctattaataaatcattgtgtacatctgtcagtatttccttaggataaatttcttttagttctattactgcatctgaggaaattaacatatcaaagctattgatatgtatttccctgggtatacatttttttttttttttttttgagacagtgtcttgctctgtcacccaggctggagttcagtggtgttatcacagctcgctgcagcctggactgcttgggctcaagtgattctcccaccttagcctcctgagtagctgggaccacaggtgtgcaccataatgcctgactttttttttttttttttttcaatttatagagacaaggtctcactatgttgcccaggctggtttcgaacttttggactcaagccatcctcccaccttgacctcccaaacttctgggattacagatgtaagctgctatgctaggcctcccagggtatacttttaaccctgccttacaccacccagaattcaaagcatggaatccttgacccagtagccagagtatttcttatcttaagtttaggaaagactactctgtggtcaaatgtagtcacagaatttctttccaacaaagctgtctacgtagttaactgagaaccgtctccaaagggttgttcctcttgagggaggtttcagagaagagatggcattgatgtaagtcttgaagaagttagagctcaaaatattgtgaagaggaagataatttttttttttttttttttatcgagacagagtctcgctctgtcacccagactggagtgcagtgacgcatctcggcccactgcaagctctgcctcccgggttcacgccattctcctgccccagcctcccaagtagctgggactacaggcgcctgccaccacacccgggtaatttttttttttatatttgtagtagagatggggtttcaccgtgttagccaggatagtctcgatctcctgacctcgtgatcctcccgcctcagcctcccaaagtgttgggattacaggcgtgagccaccacacctgaacgatgaatttttctaccaggacaaacaggatgttcagaaggaagacattgttagaactgtacataatcttagacatcatctatcccagtggtttatcaaatattttcacagacaaaacattttttcaagccaaatcttgtctagagtactacaaactgattgaagtgaaatgtctccagttaaatcacagtggatgggagagctcggaattgagggtagaacctcctttgctcagctttcttagagcttcctatgcacctgaaaaacccaaagcctctttttttggttttttttgggttttttttgttttgttttttgagacggaatctcacttttttgctgaggctggagtgcagtggcactgtgtcagctcactgcaacctctgtctcctggattcaagcaattcttctgcctcagcctcccgagtagctgggattacaggcggccaccaccacgcccagctagtttttatatttttagtagagatggggtttcaccatgttggccagactggtctcgaactcctgaccttaggtgatccacccacctcagccccgcaaagtgctgggattccaggtgtaagccactgcacctggcccaaagtctctttaaaaaacaaattttaagtcactccagtttgaagtttaggacacagagacaaactgtgactttcctcaaggtcagtcagaagtgattctgaaaccacctttcagtactttaaccctgtccaaaagcagccattttagtgcttttatcactagatgttcccatgcaggttgagagagattatttctgttctgttaggttatgcattgttgcagtgtcccaagagataaagtcccaagatattaatgtaagtattagcttctgtaagatgttaccccaatccatattaaccatgtctggctgaggcatgaaggatctattaaattatatccaggttcctattaaatcactacactggcagtaatacctgggctcaccttctccttaacccaaattaacacatgctgttagtggtctcaagtctaaggcaagttcctgagatgaacaagtgactgggaaaacaggagaggagaaaattaaaataaatgataggctgaccttctcacaccacttgtggtttctcaattaaccaaaagccagacagctccacgttgctgttctctcagtaataggtttcaccctcccatttaatgccagcccacacgggtgcacacacagacacacactttgctaatcagattggcagcaaatagaattaaaccattaaggcaattaagcaattcttagataacatttgatcagttcaatgaaaatgcaaattcattcttcttttggagaaataagttgatggaaagtcatttcgtgttctataatcataattaactcttttccaaataaagattgcaatgttttgggcttggagctacacagatggaaatgatttttttcattttttgcttcactctgttcatccttttgtaatgcaccatgtttttctgcctccagactctttgggacatttaggtcatcttacctacaatctcttccttgtgcctcaaggcaaactctgttatttactctcacacatgatgactcatgcattaaacacctccttagaccctgagttcggaatagatcctacagcattctggaatgattttggtcggatattcatgtgttgtagatgcactacttggctgcttctcatttctctctattccccacacttacggtttctcctctctcacaagctggtggggaagagaatgttgcacccaaaaataggtgcttgaaaatgagcgtgtggtgtctgcattttcatttctagattggtatcattgaagcctacgttccattctgccaccacagcctgaactttcagcaagaaaatgatgagcaccttgcagcccgtgcttccctcacctgccaaggtgcctttgtgctctagctcagggtttccaaacctggtacatcatcagctggggacatttggaaatatttatagtccacagggttttaatccagacctatagaatcggtatgtcccaggtttggcttagggattttcttttgcttttgtttttttcctttaaaaaaaaaaaaatctttctgtttgataatagggatcagccagtcttaagtctagatgccattttttttctacattggagaccataacatgtagtctgatgcatgatctgtcaatgacacagaaatcacttggatccaaagaattttatgatagccttgcttataaagaaaaataacaccttatgtggcaggtcattttatagatacacacatatgaatagtccactgcatcatgcgtgtgtatatgtgtatatcaagtgtctttagaggtaggtaaaacataagaggcagctgttatcacctagggcaggggtgtccaatcttttggcttccttgggctacattggaagaagaattgtcttaggccacgcataaaatacagtaacactaacgatagctgatgagctagaaaaataataataataatggcagaaacatctcaaaatgttttaacaaagtttacaaatttgttgggccacattcagagctgtcctgagccacgtgcgggctgcgggttccacaagcttggcctagctagatattatatttaatgtatctccttttcagtcttaataaagtattgcagccaactcccatccagcaggacacatggacttagtgtgcctacctgcaggtttttgagcatgaatgtaaatattaatagaaaaattgtgaatgcttctcaggaatgtcaccagtgatttttttcccccaaagaaacctttagttttgctaatccctttactagtacatgtttgtagaacacatctttttgagaattttttggggatactgatcagctactattaaagccatcaagccagcggtgccaccagtgtcacaaggaagaacgatgttttgggaagggattgagctcagcattccaggaaatattttttacctattcattactgcatgcataggcttacattttctcaatttaaaaatacttctaaagggtgggcttttgggatgtagacacataatgttctcagcaatactgtaaagcctcattaatttgctaaacaaataagtgagatggtaaaggatattgcatagattgtaagggcacatttaatcatctgaggtttaactggctctaaaggcaacaccttttcaagctcttaagagtctatatttacatggatagtaggtcttcttccttcattaaacttgccctctaagaccttttagctgttagttagaattacattttgaacttcaggataattctatatttctttcttaaaataaattctttatatgagcatttagaccataattcaaactgaggtttcctataagttctgtgttatattttatttgcgtgcatagtgatattcataccacatctgttaaagtatgaagggaggaaaatgtcagcaagtgtattgtgtctctgctcacaataattttccaatgaaagttcacttaaatgagggattcatatatattaaggactgttgttggtgattagtacataaaaatgtgggtttttctcataagtggttttaaaacttcagactgagtacctcttttgtttaatttttgcacttcttggaggcataaggtattttagtatgtgtggatcttttttattgagtttgcatagtttaggagttttttggcttaaaataaaatagggaaaaaaagctctcttaaaatagtatcctttcttgaacccataaagtagggctttgaagacgtgcaacatttgtgaggttctaaagaggggattttgtggtgttctttccagtgcttccttccttccgtcctcaccaccctgctgtaatctgataacaaataactttccagtcagtcaatttaaattatatgtaggctgcaattttttaaaatttcataatggatgctatttaaacacaaacatacatttaaaaaaaatgccatactaaagtccaaaaggaatggtgacagacattttatttatttagagacaagttctcgccctgtcacccaggatacagtggtgtgatcttggctcactgcaacttctgcctcccaggctcaagcaatcctcccacctcagcctcccaagtagctgggaccacaagtgtgcaccacgatgcctgtgttttgttttttgtggtttttttttttggtattttttgtagaggcgcattctcgccatattgcccaggcttatctggaactcctgagctcaagctgtctgcccaccgcacccagctgacattttaaatatttatttatagagcttcattatttgtacagtgcccttaaagccaaaggcattgattaggcttatagaaattgcaattaggccatgcacagtggctcatgcttgtaatcccagcactttgggaggccaacgtgggaggatcgcttgagctgaggagttcgagactagcctgggcaacatagcaagaccttgtctctagtaaaaattcagtttaaaaaagtgggcatggtggtgcaggctggtattcccaggaggctagggtgagaggattgcttaagctggggagattgaggctgcagtgagctatgattgtgccactgcacttctgcctaggtgacagcaagaccttgtctcaaaaaaaaaacaatgtagtgagtcatagttatactaaatgggcttgaatactataactagttttagtgttatagtcattaaaaaacaccataattccaaatggatataccaattactgcttgcttatcttatgcatccttttcctctcctctctatcccccaaaaccactcttgaaatcttcctgtccttttgctcttatcctacctggccatctatccaccatttatctagtataatttccataataaaaccaccagcttgcattagtgtgttggttacttcaaaggtggctaaattagagactttggttaaggacaccaaattcttaccaatttgatggtcttgaggggcaggctgtctggctcatctcttttctatctgctgcccaccttttactgcctgccccactaagcacttctcatcatgtccgaggagagagtaagtgggtgcgtgcatgcgtgctgcaagtatctgcatggcattctttttcctgaaagatcttctttttttttttttttttggccatcatttccattctgtcctaatatatcctttctctttaaaaaccagcatctagccaaggcattgatgaaaagttttctttgagctcccttgtggctgtgcagaagagtttattcctgaggttgctctcatttagggttggaatctttgaagataaaatacttcttcctacctctcacttgagatcaaggaaacctacataagactcccagagcaaaaggaccctgtaacacttgtgccttggcattgccatatgctctgttgcgcaggaatggggaggaacggccatccacatgccacccccacttccactcggaaataatagggggtgacaaatggctgctgcattctattctgttttaccaggctgtttctttcctgccctcaagaggtttctgactttctgacagcagggagctgaggttgatctagcaactgggaggattgcacctggatttgcagaaatacacatgcacatgtgtgcacgcacacacacacgcgcgcgcgcgcacatacacacacacacacacacacacacacacacacacagtgctgctgcaactcccagagtatcacataatcactcttctggctttagtggttttcctttggccacactctgctcttgtttggcttgctagcacagtaatcagaggaaagacagagactctttgcactctaatccccttgtgggttacagtagtttcagatagaagacactccagagggtgctatacaatttggaggtttataaaggccatcttctggcccccatttccctttaagaaatgagcccctcaatctgcattatacatgttcccttactgctagaagggttttactggtgccctgacactcttctcttcctcacccctcccagagcaagaactacaaaaacatagtttttttctcattttcttttagatgtatctgctgccatttattttctctctggtgattgtgtgatataggaaggggaagcatcaatggcttctttatatcctaaccacattccttgactgggccctgtttcacatctctgactcctctagagattactcagccaacatgctgcccctcctcagcgcatcaccttcttgggtctcagggcttggcattttcattcagccttgcagttccatgctcatcaccaacactgcagacatctgctgccactttcctgcctaaagcaagggaattcctgtgattcacaccgtgagcagaagcaggggtcctcttctactcagcattatcccagtttgtctcactcctttagccaatatcatgaaactctgaaactttatagcaggatgaaaacttaagcctgtagtctaaagacccagaattatgagtgaggaaactgaggccaggagagccatgaatgatagtgtttacttgattgctgtttcagatttcaccagcttttattgatacttcagcattttacttagtcgatatatctcttcgtgtgactcaaagtatcccagtggagcacagttaactgccctggatccgaattgccactggaggccgtggcagtgtcggcatcaatagggatcacccatgaccttttatttgggatgtagtagggggtctgaagttgggaaagtctgaggtggtactcagttctgggttgaatgtcttgtgaaaatcctgtgaatacatcttgcggagaaacacagaggggaaaacttcctgttgtgagagcagggctggttcccttttaaaaaggtataggatgaatattccatatttgaaatacttgagaccagaagtgttttggatttttaacttttttttttttttttttttttggaaatgctctggtgaacatttccttagagtgtcatgtgacactcaaatagtttcagattttggagcatttcggatttgggatgctcaacctataatacccaaaggctctatttcagtagaatttattggtttgctgattatagcagtgacatagttgcattctagagaccttagaaaatgcagaaaatttcaagaaaaacatttaaattgtgctcatagtgaaactgagaggtgaccactcttaatattttgtggcataagcattccagtcttttatctttctcaaagtttcacataaactttctcaaaggccattaaatacttttccatagcctgattttttgtgaccacatagtatcctattatattgataataccataatttacctaacccatttttatatatttggattttttccaattcatcattattatgaataatggtgtatctcagtggttattactttgcactgcatttcttatgaaagtattgagtaaaaggaagtaaagccctctcagagtgttttgtaggctgtcacatttcactccataatgtcctagtgtttgttgccaccagtgatatatgaaggtacccactgaaatgtcacacctttttggttttcctttttaaaataaaaaataaaaaagacatttaaccatataatattgttcttatatatgatttattataatgtagattcacatctttgagttcataaaaatattgaatttggattctctccaatttcccttttagtagaaaggctaaagttcggtaagaaattctacttggaattttattgaattgagaaacatacttggatttctgtaactcatgacaagtaacaaataaacaattagccaattaattaaaatatctgttaaaaccttgagtaatgcagagatttagttaggcagtgtagtttaaaaaaatcaaacaaaccagacctatgctgatctccttggagatgaccatcaacaggaaagatagactttaaacagtgtatgttgacatagagcaagtttctaattttccatcatttcaaggtgctggaaattatatggacataaatgcctttataatatgtgtacatctggtgagtataaattctcagatttgaggacatttccaataaaagactcacatacaaagtataaaaccagtaagcaatggaatgctaatcaagtaatgaaggattcaggaaagaaaataaaattatgccaaaccatgtaggccaagaaatgcaagtgggaaaaaaaaaaacttaagctgatgtcaaagtcaaaataaaatgtagagacaaatctctaaatttaatgttttatttgggaatcatagaatcacatttggggcatgcaaacagactgggtggtcttcagcatgtccaaagaacaaaggaaagattgggggttttattagaaagggaaatgttacttacagttttgaaagaaagctcattgaccctagagaagcttgtgggagctgcccgggtctgattggtgagtgatggtagtagataaaactagtcttaaagtcatagcaggttgtttcagcagctgctaagtaaaactggtcttatggttacagcaggctgtttcaacagctgggcttggagaaaactcaattcttggagcatgtgctgtgtcttgagtactttttcccgctgctctgtcaactcttctttagttgggcatgacaagaatgatgcaatttgcataatcaactttcacactgagtttcctgtagcctatacaaaacataaatattagtgtttttttacctttttacagtttttattgtattgtctattgaagtgaaacattaaagttatcagaatagagaaacatttgcctatcactacacattgagaagatactgtaaagagacttgaacaaacactgggcagtatgatgcgtagaactttcagtctagtttttacaagaaaaagaaaagaactgtgctaaccattttgttcatcaatataaactcaagtaatgaggttaaattgtagttctttgcagagtgcctggccaccaggtccgtaatcgctggaggtttgattagatattgagaaagaaatctgcaaaccttggcaaaatttgctgcataattccaagactgctggttcttaaatttatctccatcaaaacacagatgtcctgtgagctggactaagccatctcactatctataatcaaattattgctttcttttttttcccactgaaagatcgaaaaagaaaaaatgggtaaaaattcttagataactgtttttgtaatgtgtatttttgttgaaccttgcctcattgtataatcaagtaacaaatatgaatagaaaatactattgactatggatggtacttagctcaacagcttattttgaagaggaaaccatcatgtttttaaatatgaaacataatcatgtactttacgaataaaattcttcctatttcttacaacaaaattgaacatttcaggatttaatggtgttccatagccactagcacgcagtagctcataatttcaaggtgtttgaccacatcggtcagtttgaaaatcatacctgaccatcactattgaacacctgaagtgcaagcatccatgatggagactggagctgtccattggctactgcctttcagactaggggtggcaaacctgaccctttgttataaaaatgaaagccctcaaacgtgttcttgtcctcacgaagatttttgtctctactgaaatgcctgtaggccatttttggaaattatagctagtgtgctcactaaagtttttcttatgtgccagacacatgctctagctttacatacaatagctgtaaacctcacacaaccttgtaaggtagagagcattattatctgtattttattggtagggaaactgagaggctaagtgccttggccaagatcaccaagttatgaaatcacacgaaaggagagcctagatccctctaccagcactccttcctctatatgcactgccttgcagtaatcaagacttcactaaaagcaatttcagatctctgcaaatgtttgaacaagagctctgttgaaatgccataaaatataggatataaccttagctttgaaacattttgaggggagttaccaacttaaaaaaaaaaatgtttacctttgagcataaccacatccgaaagagtcacagagctagtcacagaatgtacccctcgataagtaaacaacataacctgttgaataagtaagtagtttagtcttctctgcctgcatgttgctaaaaataacttttgctttggtatagaagttttgaaagttgtgtagttcaatgaatatttgttgacagtgattgaaacttacattgtttctctcatgctaatcttgccaagctttggtggtcttcaagtatttgaaacaagaaagggccaggccagagccctcgttttcagatatgggacaacaaccaggctttctccatttgaaggaagaggaaagagataagggaattgttgcagtgaatcctgtgggccccaggagttataacaattgttttctaggacatacccatttcactcttcttaattttctgccatcagcatttctggggatgtactaggaaaatggaaggaacatacccagcttccagggtttcagtagtaaagtatagactagtttaagagcaaattgattagatcacttctactcctatgatgtccatttctcatataaagataagctgagaaaggtttattttaaaattaaagctagttgtttaaaagtgcggctgaagttaactcatggattgccctaaagtattgagctgtgattataaaaaaatgtttaccaaatattgtcactatggctcttatgtagtgaagagaagaatttagccttaaattagttaaaatgtgcaaaccgtttagaacagtgcttaacatatagtaagtgctccataggtattacctatgctttagaacagtagttctcaactggtgtaccacacggcacaagtatatctttatcctttctcagacatgtgccgaaacatctatacacatattaatttttttttgtatagccaaatatgtaggtgaagtgcacactgatgtttcacttggctgaataaaataagaggtgagagacacagtgtaatgtcaagtctttgcttaccagagtgaaatggggcatcgcctttcgggtctataggggtgcactgagcagtcccgttaaaaaggcacatgttcaaaaagactaaccaggtgagcagcatgttaattaccactgcttttaagaacactggaaaggcaagtggttgtatggtagtagcaattacattgtaattactgtgacttagttagaagtttttgaaccccttttgtatttcaaattgccctgtacatacaaagtgggtcagaaccatcagttaagaattagtggggtcagttcctgtctgtagctattaaagtgatttatttattgtcttataacattatactatattaatttacacatagccttggaaaaactctttctcagacttctaggccagagtctaaatacatttatgaaacttctcaggaccaggttttgatagtgcggagatcagggagagcctaaaatcataagacttctctaatagagttaggtcattaaagaatatgaatatatgaagagtagggcattagagacaacattctatacctaacattttggtccaaatcctataaaggtttctcacatagaaagctgcctttttgcatgtactacagcttgtgtctctaatatcctttctgtaccaatacacaccacatatctgattattgttcaaatactcctcttaacttaccaatgaaagcttcagatcacttaaagagattgcagatactatagtgaacatagtagaaaatcattattctattgtatagtaaaacccatgagttacatctaaaatgttactactgtttttatgtagtctttaaaaaaagagattatgaaggtttacaattatagtaaaacttattaagtagatgcatcaataggaaaagaaaccattatcctttcaacccagtcctatttcataaatagcacatcagcgcttcagtgattaagaaacatggctcatctttgcagcatgttgcttttattactttttgcccacggacctaagaggggagaggtaaagtgatagaggaaaaagctccaaggcaaatcaagttcacatatttttatttaaggattctaggaactcgaagactgaatcaaacttgttacttagtttttcactggaataatggctctatttctatagtagagtgagtagaaggttaatggtatctgccattgatggtttactaactggttaaataactgattgaaatgtggtaaagggagatgaaaacaaactaaatctttttttttttttttggcccagattttcacgtttagatgccatgaagcttttgattgtgggtctaaagacaaactgtgacagtgattggaggcttcttttaggggtcgggagatatatggaaggacaaggaggacagaggaattcaatctcctatgcagtctctgcacctgttcactaagaaataagtcagctgaggccggacgcggtggctcacgcctgtaatcccagcactttgggaggccaaggtgggcggatcatgaggtcaggaaatcgcgaccatcctggctaacatggtgaaaccccgtctctactaaaaaaatacaaaaaaattagctgggcgtggtggtgggcgcctgtagtcccagctacttgggaggctgaggcaggagaatggcgtgaacccaggaggcggagcttgcagtgagcagaggtcgagccactgcactccagcctgggcgactgagcgagactctgtcttaaaaaaaaaaaaaagaaagaagtcagctcagtccaggcagtagactttggggtgggccttgatggaccataagacctttgctgccctgtgacttctcccttagttctcagtctgttcagaaaacaatttgcaacaacatcagagagaaatagaatgcaaaacacagctcccttttgatgaattggctcctggctcggcctgcaaaagataacatggtttttcccttagaatacttgtcatgccaaaatgatggtatcgtcctactggggtttttaaatgttaatacaagtaaaataagatggatttttttaaaaaatggcaagcgtttcttagtttggctctcttggcttttgtttaaaactgaagatcactaagcctagatttttgtgtctccagtttaaaaaaaagtaaatttcaaaagcagttcctagaactctccctctccataggcctgttgtgagatgcctatgtccctataagtgtgcttcaatctaccagctttcctaaaacaggttgatggcttagtggataaagatgggacttacaaagcctattgattctcttattgtactcatctgtagaatgggaatagcaatggtacatgctgatcttacatgatgtgaggatgtgatgaaataatacatggaaggtattgagactactgtctgggtcatagcaagcagttttgccattattatatttgtcatgacagttttgccattattattaacccaataataatgtcgtgtcccctttctccattcttgtctcccaaagatgtcacacattcattattgccaaaaaacatttttaaagctttctgtttttctggtacttgcagtgtggctgacgccagtagggtataactcctctgagaatgggtgctgaattctgttcccaaggcctatggggaaatctctttttgttgttgttttttgttttgttttgttttgttttgttttttgttacagtctcgttctgtcacccggggtggagtgcagtgatgcaatcttggctcactgcaacctctgcctcccgcattcaagcgattcttgtgcctcagcctccctaatagctgggattacaggtgcccgccaccacacttagcgaatttttttttttgagacggagtctcgctctgttgcccaggctggagtgcagtggcgccatctctgctcactgcaagctccgcctcccgggttcacactgttctcgtgcctcagcttcccaagtagctgggactacagcacccaccaccacgcctggctaatttttgtatttttagtagagacggggtttcaccgtgttagccaggatggtcttgatctcttgacctcgtgatccgcccgccttggcctcccaaagtgctgagattataggcatgagccaccgcgcccggccacacttggccgatttttgtatttttaatagagatgaagtttcaccacattggctaggctggtcttgaactcctgacttcaggtgatccacctgcctcagcctcccacagtgctgggattacaagcgtgagccaccacaccccgctgggaaatatcttaaaagaatcaaaataagaaagttactctacttaaatcgtgtgctttttctgtgtgtgatttatggtaatcttaccatggggtatctgattactttagaaagatccatttagcttatttttttcttctttgggttatttttttcttccttccatttgcacagcctccccccaaataaaaaataaagatataaagtctatcttctccctcttgtcagtttaagtaaaaagaacttttgcttccattttaataatagaatttgtgtgtatataatataggcagtgatttggcctcaagctgagtttagatttgaaaagatgagaatattaaagcttgtcagccagcccacaaaccacttaagtatttctgatctgacaggatgtggggtggagttctttttcttttctccaccaacacccctcacaattaaaataaatcagataaaatagacactgtgaaggtgggactgaaagtaggtgataggaaagggtggccccacaccaggaccagtacatatgcagaaattccgtccaaagtacttcaagggtctaggacagtgctgtccagtacaactttctgtcacattgaaaatgttctgcatggcccaacagagtagccacaagtcacacggggctgaaggcagatagtgtaactaggatttgaatttttaattttatgtcattttaatttaaatagccacaggtagctaatgtcttgaacagtgtaggactagaaaaaatagattttgacacacattctcatgtatgaaaaactgccaaagagcatcagattgctctagttgtggaagattgatttgggagtaaaagaacgtctaaactgctatcctgtggaagagaaatagatttctattttgttgttccatagggaagaaacaggactacttgggagaaactgcagagcaacacatttaggctcaggctaaaaaaacttcctcagaattagtcatacaaaattctactcagatctcttcgagtttaaggacgacccccaattctgagagtactcagggttagacttgatggcagtttgacgaggacctgcagttccccatttataacacttgtcccacacagagtcactagttgtgctaagtattagctgaaacattgttttcataagtgctctgaagctaccaagaccattggtatcattttattagacatgactattatttagctaaagacaatgtactttgagtcactgtaaggccatttgttctaaaagaaacaaaaagattctccttgggatcccaagcggaaccctgttgttctaacagtaaacatgctccccatgactacgataggtggcactggtcattcagttgttaatcttaaacttttcagtgattatttcacctggaggggatgctgacattggcacaatagcctttccaaatacccagaaaatttctgataataagcaaatggatgaactcacagtagttcagctgtggtagatgctctcgttgctggttagtacttgtagcatccatcagccacggacccgccggttcctactgttggatgtaacagattcatggaaaagaagccttgtaggtaatgtcacagcagtggtcttaaattgcaaagaatttctaccagcctcacgaaccagggcatggcatggaattcattggccctgcttatccccccgtggagacgtgggaatggcaggactgtgaatgtggagctcagttacccagcagaggggtaacgctctcataaagaactcccacagaattaattagccgcattttagcactggagactgcacctcttacatagtaggagcgatggttcagaaagataatgaaggcccttaggttattattgatagaccctgccttctttttaagcaggaggacatttcctcgttctttctcttgttaaaatgataagtgcagagcactctcattaggatgtagccccttggctcccaaggacacagtgagatttcctttccttccgtgcatgttgtctctctctctttccctgccatctcattctgacatttcaagtaaacaggcatacatttacctgttggtaggtgattacatactaataaaaactacaagtaaggaacactaggcagcccccattttacaaattggcatttagtccctctataatctcttctctggagaggagtaatatccacctggatgtaaggctgggtggaattataatgcagccctgttacacagatggctgtcttcgtctgtgacatgtgtgcacacgtagacattcttgcatgtgcttttctgtcagcccagattgatgtgtgcataggttaaattgctagagaaatcagctttctacaccagttgcatctgatacaaatttctacctctggctgggccctggtgccaagtgtttgctcattttgacagtcctcaaatttgttgctttagatttttttcctctcatcttaaaccctctagtccagactttcgtatcacactttattatgtgtagatagctctaccaagaatatcaagggtatctagtaaaatcaccctcaacttccatctccgccatttaacatgaaaacattgttattcatgtttatgtcactccctctggagaaaaacatgttcttcattcccaaggtcaaagccatgttcttcaaccaacgcttacagtctcctccatggttttgtcacatcagtcattcctttccctttgccttgtacctgctgtctttttcaccacttccctctcagctcatgaactctagcgagtttcctccaatctttaaaaatctaaaggagaaaccacctccatcttgtgtgtctccatccctcaaggtcaaagaacttttatgcttgctgtcacccttcataacccgtggatgaatagttactgtatcctattgtgctaataaaatagtttcttaatacccaccaatgactttctaataaaatagcttcttaatgcccaccagtgaccgcattctgcctagttgacaagctgttccactttggatctctctcatcccatggactgcctgactttgccactccttgttcccatccttttctgtatctttgtcaggctctcttctctttctccttaaatattcgtcagtatcccaaagtttatagagaatgttacttaacagcatggatatgaggaacaggtaggcctgaattcaaatccttgctccactacttatatggctatggaaacttgagtaaattagtttttctgagtatgttttctcatactgacttcagatggttgtgaggatgaaattagcaaatacatgccatgtgcttagcagagtgccttaggtcactgcccctggcctgtctttcccctcttcccactgttcatgctcttacctgccattgttattctttctgttcctggcctccttcgggaacccaaaagccacattgtcaaccacctgccagacacctttctcaaatagaaataactatccctttttcccaaagtaaatttctccttccccaacttggcttgatagtctctctcaagtaggaagcacagatgtccatttgacctcctccctctctcttaccctcatatccggtcgacaatccatgtctatcctagcccctggattcttgagtctagacctttctttgattcttaataccaccatcttggctaaggcttctcctacctccagcttagattattgttctggcatcccaagtcgttccccatctctattctattgtaagcattctccctgaaattgtacatatattatttagttgccttctcaagttgttctcctttgtactttccaatcccttattaacttttggctgaaggtttcatagccaatctgtagctcaggggtagaaaggcaaaaatggttgatgccctgcatagagttagaactcattaaatgctgaattaatgcagtataaaataaagcaaaataggaagtgtagtaagtcataatgtaataagaagtggggataagtggttgattaaccaaaagttagctttccattgataaatactacagaattagttgtagaaaaaagagatttataacttgatcttcatttctcacctgagcctatgacaagagggtaatggattggacaaacaagtggaaaatctcagctggcatcaatgggctgtcttctgctcccacccagtgggtgtgaagtcactctctggctctctgtatacctctccttccagccattgctgatggagccaggtctctattttttttttttttttttttttttgagacagagtcactctgttgcccaggctggagtgcaatggcatgatctcagctcactgcaacacccaccttccagattcaagcgactctcctgcctcagccacccgagcagctgggattacccgccaccacatctggttaaattttttgtatttttagtagagctgagttttgctgtgttggccaggctggtctcgaactcctggcctcaagtgatccacccaccttggcctcccaaagtgcttggattacaggtgtgagccaccacacccagcctggatctccattcttgatataggtgttttgatcctaaggagacaatcgttggtgaatttgaaacagattcttcaggaaatatagtgcaagaccaaaattgggtcccaggaaaaatcatgtgatacttcgtaatgcaggtctcttgtagacacaagaaggcacacttgctcgtttccctgggtttggtttttgttttgttttcttccccctatgtctcacatcctctcctgcaaccccaaccctccgtaccgcaggcaagaaaacattgatgtttctgcatctggcagcatgtctctgggagaagaggccggcggaagggagtttgatgtgtgagtgacagatccccaggtaacaccactggggaacacttgatctgacctgtttgaaggtgaaaactcaccaggtcacactggaaacagttgctgctgggcatggctttgatccttgtttatctttttctcttttttttaaccttcttgaaaaaaatgttttgtacaaatggatactttttcctgtgtatattttgtctgctggagcatttgtatattttgtgtgtgtgttccttgtcactgcagggcggggttttgtaaccttttgatgcagattgtgaatcttaatgaatttgtcatttgccatggaaagatgtttgttcaaatagagcagagacattttcgtccaacaatattacaggaatattgtgtagaaaataatgactaatactttgagcattccatgttggctcccattttaaacacttcatgtattaacttgtttaatcttcagaagaattcatttttcctggttttcctgttgacatttgatgaaactaaagcagagggaagttaagtagtttgcctgaggtcacacatttagtaagtgagagacccaggactcaaactcaggcaggggttctagtaccagcagtgtttatcaactgctttccaaccctgacaagcatgagtgggcacaagcatggagcactagggcttacaaaaagctccctcaggctggcacattgcctgacttaaaggtaccgaaggcatggccctgccttcaaggtcattattgcatgctggttagaggagaaatctgtctgtctcatttgcggacgtgtctccgttgctaagtagtgtcaggcatgtaggagatgcttagtacaatctttttggattgtatcaatgtaggttttgaaaggttattagagcttgtgaatcatcaaggttgaaccataatcaattaacaagaaaggggaatctgagacttctaaaatgtaatggtcatgacttgctacctttagaaacaccagcgaaaaaaacctgtggtgtcggttggatcatggctcttattcactgcggcgtttttaaagctttttcaaggattatgtggggatcccaggctcctttatgatttataaatctattatgcatgtcacgtagagattttcatgacagaatcgtcagatgaactcattcagggtataatattgtaggagaagggttggcgaggttgagggggatgccataagaaaatgcctaattcataggtagagtgtaggacagaaatggatggggactggaggccagttaggacgacactgtagaggccagtgtgaggagcaaggacgtgggctagaggaggaggagatgagcatggggaggaaagtccagggagagttaacaggacctaccgactagacaagaggatccagggaaagagaatgaagcattgttaggaaagtttcacagtatagcggcccaccgataaccttaagaacctacaaacctaacagttttaaaacgatgagcttgaggctcagaaggaaaggcatgttaagctgtcatatcaggttgattgaatagattgggtaagtctttcagacatcctaccaccaccttctgccccatgctgttaattctttaagcattgggaccatgagttctgtctagcagtgtgggtgttgagaccacatgaatcaaggaagagggcttctagaggcccaagggctgtttgctgtagaggaggcagaggagggttccaagaatttcagaaggcactgtatagctctgccaggaagtgtttagagaactgaggtgcagcccccacttctcattacaacattttactaccatcaacctctcagcagaactgctgcattaggtacctagtgtttgatttgaactttgtatttattctccatgaaaaggcaccgtgcccattgatgtcactttggtgctgctgagacagaaagtgagtattttatgtgctgtctcttttcaagcaagatggaagggtcttgtaaaagtggtttctaaggaataacctaacattttaaagatttatagaacaagcatccacttaccagttcatttaagttttacaaaacatctctgcttctgccttgccatgtcagcaaaagattctgacatttaaataaataaaatatggtgggatataataaagtgcaaaaaaaatgatgcatcaagttactactgaaaggaatattgaggcctgagtcatctccctgctgctgtctcccaaacagaagatagctttaatcttcaggctctgtgttatttaaataagctgagggatttgcgagttgggggatgctgccaaatgtatccactgaagataatgatcccatttcagatctgcaggtctattttaatgaaaggagacaggtgagggtgcagaacagaaatgttcatagcacctgaccctccttctttccttaggagtttctcaacccagcgaaattggtgagatttttaaaaataaatactttggagtatatcatgaggtaggattactgtagtgagacagggagcagtaatggcagtcaggaaaacctgtgtatgttaaaaagtgtttgctaagtctctcctgtgtgtttagtgttgtgggggttttagtcgaaacaaattagggtctcagccaacctcaaagggtgtattttctcagtctttattgattcctcttggtttcctcagggctcagaacatccaacaccttaggagcaaatgtcctttgaatgaataggtttgggatgaggttctggaagacactaacacaaacaaccttgataaattacatggtagtgacttcatcacattcttccatctagtcggagtagctggcctttgaaaattacccttatgaagcttacattttactggagaagccagacaaaagaatacgtaaatgaatgaatgaatgagtgaatgaacaaaacaaaattatctctcgttcatagatcaaattgtcctaaacttgctcattaagacttacttagctatgcattttataccactgtccctgagcactttaatcatttattaattattcaacctctacattgctttaggtgaactggaggcatgagacaagtttgggatgcagactttttctttttattgtccttaagaactataatatatgcagttagttagaaaccctgtcctattggtacttttgtttcagtgaacttgagtttaaactttaaggcacagaggttattacagtatcatcttcaggaagctactggtactgaaaagagcattcttcatgccaccccagtatcatctttgtactcttacctttgtgttgagaagggatacatgtcacttataaaacctgggtatgactacgcaagccaccttcacatttgggatagaagattctacaaaagtaaaattcacaatctttgtacatacacagaagccagacttaccagcatgtattaaatctgtctttattttggatcatggcatttatggagatcactaagcaggcagctcatttgaagtgagattcagaacacttacttattttatccatttagcaaacatttacttaactcctactgtgtgtactacatcactggggaagacaattaggacccagtccttgttttcaaggagtaagtactctagtccaacatgaaacaactaatgaaactgagcagggataggcaaggcagaggtaagtgtgccttggaagaaaaggggaagaagaaatggtggatgttgaccaaggctggcactaggtaggctccaggttcccctgggatgctagttttagaggtggaagggcagttttgaagtctcatttcaggagcagggagaggctgtgcgttgatggttccagtaggatggggaaaggaggaggagtcagtgcagttggaccaggctcttgtctgtccatctcatctctccccagggataggatgacaaggaccccagaaatcaacagtgacaccagctgagtgaccacaggcagtaaacaccttacaatagctgctttgatttgtatccttgctggcgtatcttaacaacatgacgacatttaccaaatgaatgactgcttaccaagcaccagtctaagtgcttcacccatgttatcatgtttaatcttcccaattttgtgagataggtagtattattcccatttgaaaggttggaaatctgaggagtgaagaggtcacccagctagtaaaaggtagagatgatgcaacagacatacatgtccatgcttgtttgactgtaacacgtttactcttaacctctaagcaatggtgctttccttaatatagaatgtccttcgaaacatcccaatgccaaaattcagcatattttcatattagaatagctttgcgttaggtctctttttccctgaacatttcttttctctgttttgcagaatcttgttggcctcctttaaatatcattataaatgttggcagtgttgttttaaataattgtgaacagaaagtaaggaagcatatgcactctgatctttttaaagcgatttcattattgtaaaaaattctggttacaactcactaaattggtagtttggagcacctttgggtgtactcccagatactctctactcccctctcctccctcccacaaaaaaacagcatttctaaccacagtgactaagtcatgcacttctaagttagaaaatttatagatgggggaaaaatgtagttgaccagataaatatgcagatagttgggacatgtctaaagtgaaacactggtttcctgacacatattcattaaacatacagtcatgtcacaaaaagagattatggtcaggtgaatttattattatatgtccctcccgccccgagaatagtaccctatagtttatgaagcatgttgataatgaagttatctgtttcatatactctttatgaaaataatattttcccaagaagcctgaaaaacttacttggtcagtccaagtgagaaaaaattgaattattttgtatttagcattttaatccccaagttagaagggacatttaacaactgtactaaattcaaaaggttacttagagacagaattcctctttagatctaatatgattgtctggttttaacagtttggctttacaggaagacttggaagaccagcaaaactgccctttatttgtataaactctgcttgcatttgtgactttttttaaagggaaaaaataaaattctttataggcataatttttataaattaaaatacattatagtatatttatgtgggtgaagcttaggaaattctttataaaatgaactgtattttgaattggtcaactgctacattgtccaaaaatgggaatggtgattctgtggatgaagtggaagaacaaggctattctttactgtcaaaaagggcctttatgctatggtttaaaatctttctgcaaagcccttggatgttataccacacatcctgtagctcctacatgccaaactcccagctttttttatgtggagccccaggaaaaggtgatcacttacctgttagcctcatgcctggtggtgataagaaagatggctttggtgatactaactgaatgcctactagaagtcaaatgtgttgttgtttcaattttatggcctctctgctggtgagtatttaaaatgagaatcgagcaagtgaaagtgtgtcatagttttttgtttgtttgttttttaattaagaggaccaaaccaaagaaataggcccattttgttgagagaggcagtccaacacagtggctcaaagttccagagcttgcctgcaagctcaggcagatgctggtaccaggaatgccctgtacggataccaattcattcgtgggagatagtacaggggcaggtaatgctgaatcccagctccacttatgtccagagcacaagtgatggcacaaagccctagctctcttcatccttccactctcagcactttacatgtgttgccttcctctgatttgattccaagctcaggccccagatgggggcctcccagcaacatgtccctctccctttcctggcttaaaccaattagagtgggttctgaaactggagctggagtttatcccacagaaattgaaagtacagcagggatatttcccaaaggaaagttaggatactattttactaagaagattgagaggaggaggtgacaaaaacaacagatgtctgtacatatgtgagggtggagctgaaattgcttggtttctacagttagcattcgctcaaaacaggcagacctaagtttgcaggtgaggccagtccacaacccaactcagaggctgagacaagcaaagtaagtggaaaggagacggatggtagaaagaaataatatctattgggtgtctgttctgtgccaggatctttatgtttgtggcccagtgtacgccttgtcaccctcatgaagtggtattggaaggtttaaagggtttggagataagggtaaagatagatgtagagtcagggtcagccactgtagccaagagctttgggtagttccagggcaaactgaggaagcagacctcttagagggtaaaatgggttatgattttctaaagaggaaattcttctgtttgacctagatgtgaactgaataatcacttctgttgtttggaaagccataaagccagccaaccatgccacaatcctgatctcgcaactcacatatcttatttttcaacaaggaaaatcctttcaaagagataaatgtgaattctgtgtgccatgtatatatttgtaccacatttaatttcattagctataatatcatgtagctgtgcttatttaactgcttagcccagatggtaatgccttctgaagaaaaatggctacacagtgtaattgaacatgtcctattgacagagttacaacaacccattttccccattaaatataggtgattcaataaaatgaacacagagtctattactctgccaccatttctagctgaaaatgcaaggaggaaatgttctacaaggtgaagaaatggcacagttatgttgcatgcagtgggaggacaggcgtaaaggcaggcctcctcctcccgccttggacaaaagaggagctatttgttgacactcagatttggttgggaaccaaggggagaaccttggcgtcatcagctaagacctgtctgaaagtgatgatgatagcagatgtgaacatgaaaactaggccgtacattttggaaaatgatgtaaaaggatttggcttctaaatggaatcaagtggtagaaacagttgtgttggctctcagcagatgagggtcttgggtcttatgaatgttgtcaatcactagtataaaaatattctggccaaattagtatatgagaacaactatctgatgaagctatcactgcaaatatttttgtattcattgaaaaaaaattgccaaggcagaaggattgcttgagcccaggagttcaagaccagcctgggcaacatagcaagaccctatctctacaaaaaattttaaaattgactgggtggggtgatggtgtgcatctgtggtcccaaccactcgggaggctgaggtgggaggattgcttgagcctagcggttcaaggctacagtaaactgtgaccataccactgcactccagcctgggcaacagagcaagaccctgtctcaaaaaaaataataattacagggttggcctccctgatcctgtatatattgtctatgaaattgacaggtttggtgtggtctaagaaagtaagtcatactcgacactgaaactttcctaggaagagcactagagatgatgtgagaagatgttattgaggaaaagtttgggaatggcaccttgccatgtggcgggacttattgcagttgctatgtgtatattttttcttagttttcttcatgttttatgagtaaagacttacagtcgttctctgtctttgcttatggggaagttgagaattttagagtcaaaaagacccaaaagcccactctggcttaccctctcattttcctgaagaggaaagtgaggcccagtgaaaacccacacaactcaggagagatgagccagggtccaattgtcccttctctcattactgcattttgcccttattccagtgctaagggacttttggggatgaaaggagagaagtgggaggctggaaggagtgaggtttcttgtcctcacagctagtcacccagagaagcttaagaaatcattacaggcattgtggctcacacctgtaatcccagctctttgagagactgaggcgggagcatcgcttgagaacaggagtttgaggctgcagggagctgtgatggtaccacttcactccagccggagtgacagagcaagcccctgtctctcaaacaaatataaaaataaaactgaaaaaaagaaattacttaaaatatttttcttatgtaaagaagtacaaaatttgaaacccactctcctaaacaataggaattcgtacgaagagtgatgggcatatattatgcctccctcttcttcactcctgtccagtgtgtcctagatatgggcgtcacaatggctagtatatacctaaatgaaatgacaaaaagtgaagctgaaccttgtcttcttatggagaatatattcagaaggtagaataaaaagatattttagggtgattgagtttaaacaagtagaacctggtcactccaaccccacccccgatcagattctcaaaaattagacttagaaatcatagtcctggatgttagtcaccctttctgcaagggaattgctatctgaccttgcatattgcatgtggacaagttcagagccatcagatccacctgagaaaggaggcaggaaaagagggcaagccttatcaagctgctgtggggatgaatccagtccggtggaagaaactatcccacctctgagccctgccagcacaagccatctgtctgcatctaacaacaccatgggcctcagctctgaagcccctcccttggtgactcagcaatcaaactgttcattttgcacatgttttgtgtttgattcatttagtcactgagtcttcagtttctctgcctgctttttgccctgctgatggggaccagcctccaggtcagcacagcaggttgagcctagagaggcaatcacagtcccaggatgaacttttttttttgtccctgaaaggggcctttccaggagactccccaggggctgctgatatgctcttccaaggctttcctgattgtctgtccacccatacccaaggggaactgatgtttctatcctctcccataggccttttctaggctttttacccacttccagcctgtctcctaggggcctgattggccctctccacttctcccaaggcagcctttcttcacttgcctcagccacctaatctctgtcccaccagttttggggttttccttactccatgcgtttacctttccacacttgcacatgcacacagcaccgcatgaaaactcctaggaatctctccttcaacatggcttaatagtccttcttacctaatttcccagtgacctctgactcacagttacacaaaggaaatggacgtacacctggagcccagctgacttgggctaaggttggtcatggctctaggtttggtttaccttattggctagaagacagtagaggcccaggcactgtgtgctttatggatcgtctttctaatttacttgaacctgggatccatggtcacttctaagagatcaagtctattttactctaagtagtttctttgagtaaggttggacatttatttcccttgacataaggtaaacaagtgtgcctatgagtgtggcaacaatgaggagacattgaatcctcaagtcacattggcatgcttgttgaggcttttaaacgatctcagtatcacagttcttggtaataactgtaaaaacataatcacaggtggcacttggcatgaaaggtatgcttggttcttttttttttttttttttgtgacggaatttcgctctgtcgcccaggctggagagcagtggcatgatcttggctcactgcaacctccaccttctgggttcaagtgattctcctgcctcagcctcccaggtagctgggattacaggtgcctgccactgcgcctggctaatttttatatttttagtagagacagcattttgccatgtttgccaggctggtctcaaactcctgacctcaggtgatctgcccgccttggcatcccaaagtgctgggattacaggtgtaagccaccgcgcccggccgctcagttcttacataatgagggcatccatggatttttaaatggaggtctttatgtttccagttccgtgtcttcccaccttcagaaagcactattttgctgaatttgtctaaagggcagtagcttctagagtaaccccaggagcaggtcttctcaaaatgcctatttatcagcctttgcatgagttttgtgggagctggatagaatggaaaaagaaatgaggaatgttcttcagatatgacattgtacagatctattcttccaaagaaatttgccttgagaatagtactccagacatggaaggggctctaggtatttaggctatggcagaaggtaacttgtaacatcttttcagaatttttgcaacctctgattctttatttgacatttttctttcttaataagatgcacagctagtacagcagcatcctgtaatccatggatttggatgttctgggcgtaatcatccctcaaaatgcaatacaggtgtggttagtctaagccatcttcctgcaaaaactttctattcctcatcccctccttagactccctgtttttgtaatatgttgtcaactgaaccacatttatcataaaatttatcattttctttgtatttctactgagatctagatagtcatcaacatgggacatctttccagcttgaagcaaaaattcttggtacttaggtatctcctgtagccttggtagaggcatgtgtggttaggcctttctgaatattgaaaagagctcccttatcccccagttggatccatggaactcctggtcccaaccactgaattcagcactgccttgtttttgcctcaataccacaatgatggagagaagctctactttaggattcttatctgacaaattagacagcaggaccccttctaccttctaatatattagatttaataaaataggcatatactctctactccagagaaccaaatgcctttcagcttgggaaactaaaatacaggggtgtttgatttgtgtgtggttttgcttgtttgttttgagactgagtctaggtttgtctcccaggctggagtatggtggaatgatcatagctcactgtagccttgaactcccaggctcaagcagtcttcccacctcagcctccctagcagctgggactacagatatgcaacaccacacctggtttattattttttttttaatagagacaaggtcttgctttgttgcctaggctggtcttgaacccctgacctcaaatgatcttcccacctttgtctcccaaaatgctgagagtgcaggtgtaagccgccatgcccagcagagtgagttgttttttaagatcacactgcaagtttatgtaagaatcacttgaataactttttgttcctgttgggttaagctggtgggctagatgcttggaagttgtagaccttactctcaagaagtttctgtgcaagagagcaaataagcaataagtaaaattaaccacattcagcagtaaagaatgattttaagccaacagtttatgatgcaagatttaagagaatggaaaagaagttatttcttttaaaaaaatcgtttgagatgaaattcacgtaatataaaattaacaattttaaagtgaacagttcagtaggatttagtatatccacagtgttttacaaccactgcttctatcttgttcccaaatattttcatcactccagagtaaaaccccttacccattaagtagtctgtacctatcccttcctccccattgcccttagtccccagtaaacctctgatctgtgttctgcctcttcagatttatctattttggaatcatacactctgtgaccttttttgtctggcttctttcacttagcataatgttttggaggttcagccatgtatgtgtgtataattactccactcctttttatagctgaataatactccagtatttgtatataacatgatttgtttatctgtacatgcactgatggatgtttgggctgtttataccttttggctattgtgaacagtactgccatgaacatgtgtcacatatacttgtttatgtacctcgttttggttcttctgcatatatacctaggagtggcattgcaggacgatatgatacttctacattaaactttttgaagattgccgaactattttctagaatggctgaaccatttcaagttcctaccagcaatatatgagggttccagtgactccacatcacttccaacacttgatattttcctttttcttaaaatagccactcttatgggtatgaagtggtacctcattgtaaatttgatatgcattttcttgaccaatgatgttgagcatcttttcatgttttttggccatttttatatttttttttagagaaatgtctactcaggttttttgctcatttttcaatttggttatttgtctttttgtcattgaattgtaagcattctttatgtattctggatactagatacatatgatttgcaaatattttcactctctaggttgtcttttcactttcttgataataaatgccttttgatgcacaaggtttttaatttgatgaagtcttagcctgtttattctgttgtaacaaactacttgacactagagaatttataaacaaaggaaatttatttcttacagttatggaggctgggaaatccaagaccaagatgccagtagatttgctgttgggtgtggggtgctcgctctgtttcaagattacaccttgttgctgtgtccaagtggtggaaaagcaaaaatgccaaactctgtgtgaagcctcttgtataaaggccttagtcccattcaagaggaaggagccctcatgacccagcctcctcctgaaggcctcacctttaaaactattgcattggagattaaatttcaacatgaattttgagaaacatattgagaacatagcaaagtccagtttatctgttttttcttttgttgttaatgcatttgatatcacatctaggaatttatggccaaatccaagatcatgaagatttaccactttactttcttctaagagttttatggctttagtttttatatttaggctgttgatccacgttgaattaatttttgtacatggtatgaggtaggggtccaatttcattgttttgtatgtggatatccagttgtctcagcatcatctgttgaaaagattattcttttcctgttaaatagcttaggcatcttgttgaaaataagttggccataggcatatgggtttatttctcaactctcaattctatttcattggtctgcgtgtctatccttatgccagtagtacactggtttgattactataggtttgtaattaagttttgaaatcaggaagtataagtcttccaacttttttctccttttacaagactattttggcgattgagggtccattgcaattccatacaaatctgtggatcagcttttgcatttctgcaaaaagatcactagaattttgatagagattgcattggatctgtacattaccttgggtagtactgacatcttaacaatactgtctcccaacccatgaacacagggtgtccgtctatttattcaagtcttttaaaatttcttttagtaatgtttattttataattttcagcatataagtctttcacctttttggtgaaattgtttcctagatatttcattctttttggatactagtgtaattgtattattttcttaatttcctttttagattgttcattgctgatgtgtagaaaaacagctggttgagaatttttgcatcaatgttcatcgcagatattggcctgaaattttctttttttgttgtgtctctgccaggttttggtatcaggatgatgctggccttataaaatgagttagggaggagtccctttttttctattgtttgtaatagtttcagaagagatggtaccagctcctctttgtacctctggtagaattcagctgtgaatccgtctggtcctgggctttttttggttgttaggctattaattgctgcttcaatttcagaatttgttattggtctattcaggaatttgacttcttcctggtttagtcttaggagggtgtatgtgtccagaatttatccatttcttctagattttctagtttatttgcatagaggtatttatagcattctctgatggtagtttttattactgtgggttcagtggtgatatcccctttatcattttttattgtgtccatttaattcttctctcttttcttatttattagtctggctagtggtctatctatttttgttaatcttttcaaaaaaactagctcctggactcattgattttttttttttttgaagggtttttcatgtctctatctccttcagttctgttctgatctatactggcaaaccaaatccagcagcacataaaaagcttatccaccataatcaagtcggcttcatccctgggatgcaaggctggttcaacatatgcaaatcaataaacataatcgatcatataaacagaacaaatgacaaaaaccacatgattatctcaatagatgcagaaaaggccttcgataaaattcgacaccccttcatgctgaaaactctcaataaactaggtattgatttaacgtatattgaaataataaaagctatttatgacagacccacagacatactgaatgggcaaaagctgaaagcattccctttgaaaactggcacaagataaggatgccctctctcaccactcctattccacacagtattggaagttctggctaggcagtcaggcaagagaaagaaataaaggcattcaaataggaagagaggaagtcaaattgtctctttttgcagatgacatgattgtatatttagaaaaccccattgtctcagcccaaaatctccttaagcagataagcaacttcagcaaaatcccaggatacaaaatcaatgtgcaaaaaccacaagcattcctatacaccaataatagacaaacagagagccaaatcatgagtgaactcccattcacaattgctacaaagagaataaaatacctaggaatacagcttacaagggatgtgaaggacctcttcaaggagaactacaaaccactgttcatagaaataagagaggacacaaacagatggaaaaatagtccatgctcatggataggaagaatcaatatcatgaaaatggccatactgcccaaagtaatttatagattcaatgttatccctatcaagctaccattgactttcttcacagaattagaaaaaactactttaaatttcatatggaaccaaaaaagagcctgtatagccaagacaatcataaggaaaaagaacaaagctggaggcgtcatgctacctgacttcaaactatactacaaggctacagtaaccacaacagcatggtactggtaccaaaacgtagatatagaccaatggaacagaacggtggcctcagaaataacaccacacaactacaaccatctgatctttgacaaacctgacaaaaacaagcaatgagagaaaagattccctacttaataaatggtgttgggaagacctgctagccatatgcagaaaactgaaactggaccccttccttatactttatacaaaaattaactcaggatggattaaagacttaaacataagacctagaaccataaaaagtctagaagaaaacctaagcaataccattcaggacatagacatgggcaaagacttcatgactaaaacaccaaaagcaatggcaacaaaagccaaaattgacaaatgggatctaattaactaaagagcttccgcacagcaaaagaaactatcattagagtgaacaggcaacctacagaatgggagaaaatttttgcaatctatccatctgacaaagagctactatccagaatctacaaagaacttaaacaaatttacaagaaagaaacaaccccgtcaaaaagtgggcgaaggatctgaacagacacttctcaaaagaagacatttatgcggccaagaaacatgaaaaaaactcatcatcactggtcattagagaaatgcaaatcaaaactgcaatgagatacgatttcatgccatttagaatggcaatcattaaaaagtcaggaaacaacagatgctggagaggatgtggagaaataggaatgcttttacactgttggtgggagtgtaacttagttcaaccattgtggaagacagtgtggtgattcctcaaggatctagaaccagaaatagcatttgacccagcaatcttattaccggatatatacctaaaggattataaatccttctactataaagacacatgcacacatatgtttattgcagcactgttcacaatagcaaagacttggaaccaacccaaatgcccatcaatgctagactggataaagaaaatgtggcatatatataccacagaatactatgcagccataaaaagggatgagttcatgtcctctacggagacatggatgaagctggaaaccatcattctcagcaaactaacacaagaacagaaaaccaaacaccgcatgttctcactcctaagtgggagatgaacaatgagaacacatggacacagggaggggaacatcacacaccagggcctgttggggggtggagggctaggggagggatagcattagcagaaataccttatgtagatgatgggttgatgggtgcagcaaactaccatggcatgtgtatacttatgtaacaaacctgcaggttctgcaaatgtatcccagaatttaaagtgtaataataataaaaaaagaaatacagctgatttttgtgtgttgatcttgcaattttgctgaattaattttattagctttggattttctgtacatagaataatgtctgcaaatagagaggccatttctttctttttcttgtctaattgccctgggtagaacttccagtgcaatgttgaatagctatagataaaagcaggcatcttcatcttgttcatgatcttaggaagaaaagctttgtctttttccactgagtacaatgttagctgcaggtttttcataaatattctttatcatgttgaggcaattcccttctatttctagttttgtgagtatttccagcatgaatgggtgttgaattttgtcaaaggctttcttgcatcatttgagatggtcctgtggtaagtaaaatcttaaagagtaggactgataacagatacagagaaatgcgattctggagaagtaagtaactaacttacagtggtaggtgcatgactagtatctgcagagattagtgcacaatctaaatcactgtgtagagtattgggggcagaggactgaatgcagtacaggcaagggcagattctgagtagatcagggaggacttgattgacagattgccttcatcttgtctccattctggagatccttatggtttctgagcccagtcaaactaggaattgtacgccttgctcattgttctctccttctgtgtcttcacttctcttccttctattgactttcatgtccctctaacaatctttcctttttaattttggtagaaaagtgtcatgtaaaacaaagaaaaaatggagttttttggtactgtgtgataaatcttatgattttttagaatttaggagtacacataaaattgagaggtgagccaacttttttgttggtttatttctagttatgtatggagatagacctgctaaccagccaacagctagtgtcagggctgtaaattagactggaggaaagaatgaactgcacatttctagctcctgggccaaggttcctgagatttttgccagccctcttctagacagcagcttggtacctcagctgtccttctcatcagggagacagatggaacctctgaggtttcctgttgaggcgtctcagaattcaaagttgttatgatgtgtgggctttgaaaatgccacacgtcagggaagctgagtttttgtttctcaggctttcttatattgagcatgtgttcctttctgtctttgtggcattaagtttcattatgtgtgtccccaagccttttcctggaatctcaacagaggatgggttttagctctgttggaagttacattccattaagtgtgctcaaagatctgctttactacacactctctcctgcccaattcttaggccagccccttttcctctccctactcttgtctaattagtcctctccttcaaaaggcagccctttcatgggattctgctccccgaagtagtgggccctgacttaagggccagcccatctttgtccatggccatacttatcagggatgtgactatttagctctttaaccaggagtctgtcctttctagagaccttccagcatactattaacctaagtgcataggcagaggagaccaggagcacttggtacaaatgttaatggctttttcattagcgtacttcatcacagaattccagctgttggtggcaggaggtgacagtgaggcgtctcttggataagaaggacgtggagatctacggagatgaaaactgaaaagatgcatatgattagtcatcagaaagatgtttgacttctaagttttttccaacagcaggtatggctgcatggaaaatgcatacatccattgttgcaaggcctttatttccttatcaccatcatcaagcagtattaatgaagaagccaattgtgcatgacatagtgcaggtctctgtatgtagttatggaaaacgcttccacagttaaattgagtatggatatgtaaagtgattaaccaagacttgacagctcacacaattctttaattgcagcaagcatctcaagtaaatacataacttttaagaaaatccagaactataaagtcttaatttttgaaacaaatcatgatctttcacgttacaaacagatctttctttctaaaaagatgattcacaatcttttatgctggaacatcaaacatagattttactttacttctttttaaaataattggtttgttaacagttaggaaagccatacgtgttatttgttaaaaaaataaaaataaaatggaacaataaagaaaatgtatccaaactataaaaagcaaaagtcaccaacttgtcccagctgcaccccctccaccccacccatgtttctgttcccacaggacaaccattgctagcatttctctctgtagttcatctcttttgaaagtacatatgtaagtgtgtgttaaatgattatttcagaatttatattgataaatgcctatgttttctattatttcaatttgcccacatggagggtgattgttttttagtgtgttcccttagcttctggaatacaaaagctgatgcctgtataccttgactttgctgacggcagtggtagtgagtttagtgctttctacttttagctttatgttttgcactatttttgaattatatcaattagctatgatgtatacacattcaggattctttaattttgggtaaaaataattcttcactctgtgcctacttagctaagaatatctttaacagaggcagagctgtgaaaccaccgagcaccaacactgcctctctggcttttgcagggacgcttgggtttcaggctgtaactcttagttgcattagcctctgataacttttttgttaattgataagtatgtgtatgactcatcaagatgctggttgctcagtaagataaaattatattctctaacactacttctcctttagaagcttacttacctgccttggtgtcttctgtctcggtcttactttgttttttagtttgtagtttgttcttcagcttactaaacctctttcattgactgtggtattggctaccgatttaaaaatccttgaagacttaaaactcagcagacacgtacagggtggacccctgctttttctcaagtctcccttcatctccaggaactgaatttttcatgcagtaattaaaatttgtaggtcaagcctcccatggcaccgtttgctgctaatatgggaaagcagtgatcagattcgcttatgctgctcttcactgagctgagacttaaaggatgaagggtgacattttcccccattttgtaaattaatgccattgatctgcctaacaagaacaaagttaggcttcaaaataccaaatgataaagagattaagactttaaatggctttccaaaaggcaacctctattgtaaggctccgagctgactattgaactttcaattagaatttctaataggctattgacttaaatggacaaaatgttacaagtgatagctttcaagatgacaaagattgcttcttacgttctggaatattactttatgtagcgtgcactgttctggagggtgaataataataaactgccctccccctgtagagtgtcttctgcatctgtgctatagttttctcaaaggtgaataaatgcattttttaaaggcatttttgaaatacttgctttttcatgtgtttgctgaacacaggttttatgaaacctttcatggcagggaagtcccattagtctttagcactgtggcactattcttcttttatgaaaaatagcccatgtggtatgtatttctctgcacacatgtgtgttcatgcatgttaacatgtgtgttcacagttgggacaccagcagatctgttgtctatcattgccatgaggatcagtccctgaggccttgctctctgcctcagtttactgttgttggaagctatgattcttttccacaatgggcttgcagtgtagtgtgactcaatttaggccttgttgtgaaacactagctctaatacatttttaaatactaattttacaaagaccagctacctcttctaggataaagggttaatattatgcttatgttacagtgcattaaaaactctaattaaaacagcattacattcccatctgccaatctccagtaatcttctttaattgcagtaattaaactatatttacatgttcagaatacttgtaatttagcaaattgcactctctgctctacatttaatcaaacaaccagttccagtatatttagtgtggaaagaagtaatttcaatgttttgattactatagcagatttgacagagtaagtgcccctctagtagagggcttgaaagggaaggcaaacatgaaatatagtcatggttttgattgtcatgtgaatgcctaattacatgttggaggattaactattaaagggtatcatggttgcagttgatgtttagaaacagccggtattacagatagcatagactgtcttttaggaaaatttcacaagaagttttctctttaaaggttgtgagatcataggaaaatttagtgaaaagatcgcctacattgtataattgttattatgtcttctacctgtgatcccaaagcctgctatacaagatggttattttagtcttcccagttaaagcccagaagaaattcaatgataaacaaccaagagaaattgcaatgattatatcaattcagggatgagtattccctcatttcggtatcttttggcaagtctggttgactctggagaggacatgtggtttcctggaaaggactcatcagtagaagtcaggctttttttattttaccttttgctgctgttgttgttttaaaccatgactctctactaggctgttccacctaacccatctccagcctcatctcttatttatttatttatttatttatttatttatttatttatttattttgagacagagtctcactctgttgcccaggctggagtgcagtggcgtgatctcggctcactgcaagctccgcctcccgggttcacgccattctcctgcctcagcctcccaagtagctaggactacaggcgcccgccagcacgcccagctaattttttttgtatttttagtagagacaggtttcaccatgttggccaggatggtttcgatctcctgacctcgtgatccgcccgcctcagcctcccaaagtgctgggattacaggggtgagccaccgcgcccggcctggcctcatctctttttttcttggttttctcattttaaaaacaagtaacagtgttgtgaatattgattagattcaaaggaacaatgtcttagtcatctcaaagctatttttaaaattcttattgttattatctctttgcaccagtatgaaagtttctgtttctttatctagataaatttgactgggatattgggtattgccatcaaatctctgttatccaaaacaacgtgctaatttattcaacacagaaatataagtaatactctctttttcagtagcttctttttaattatttgatgttaacagtatttctgagaatttttctctctctccacttcggggtcatctattgtattaataaggattatgaattaatgaaaacaaaaagctagtctagcgtacctgtttaaaccaatgtgaaaccttgcttcttgaccatatgaaagagcaaagctactgaattgttaaaatgatatgcaggagtgaggatccaagattttcttcatgggtcagctagtaacttactgtgatactgagagcaacatgtttgactgatttaagtctcagattgttcaaggtggggtagagaatagggcctggatttttttggttcatgaagagtcttgacataaagtaagtattagactttagactgtcacaggaataaccattcagttcaaatctacactcatttctgtgttagattagtgagaatttaacttctgaaaaaagttcaggcaaaataccgctgatgtactgcactaaggagatttgagagtgccagagatactttgaaaggaaaagagatgtaatttgaagtggaggacagggctagccagggttaaaattgcagctcttttacttagctatttaataccaagcaaattaccttatcctctgaggtcttgtctgtaaaaatggggataataatacatacatagtactacactattagtttttctctcctatgacttgccatctgtgtccatgtatggagagaaacacacacacacacacacacacacacacacaccccgtaataagttaagagtctttggaatggtaaatgatttgaacataaataccagtacacattttttttaataatgcagcataaatgtcaagatatatatgcataagggatgaggtgtgcctagaagctgtaatatctagaattttcgcaaaccttatttataaccatttgtttctgaaccctaacaattcttttctgaaactgttaactgaaagatctgaatctcactatttatttcacactcttcacatagaggtgctaatgagcagcagaataaccccaaaaatggtccttaatccaaacaccgagaagtcaagttataagtaattaagaatacactggatggaacatacctacatggcagctagcatctgtgctttccagaggttgctggggacggttagttcagttctcatttttgatcctctttggaaactcaggagttaaggtcagcatcctcagtacaaaggtacttgaacatgtatgaatctttgccttcttgaaaactttttatcttgggaataaggaacctgatacaaagagaatctctagtatttcattccatcgagagaagttttgacatttacaattctgctaatttcacacatcatttcgcagcatgcaggattttggcgcctgccaaggggactgcaaattctttttggaaaaagtacttttttgggtgttggaagagttttgagttacagacacatttctttaatagtgttcttgaaatgtccatgtggtcttaatatgtaaatcatatgaaactcaaaacccactcctgaacttactcttccaagaaagctttaaaacagccctcattctaatagtaaggctgttttcctcttttccaatgtttatgtatactgtataatgtttactgtataatgagtttattgtataataagggactctgatttattagctcttcattattctcattctgtcagcttcccaataaatgctacaacccttggcagagacatgagtctcaatcaggtgatatcattgctttttaatgaactcttcttaccggagtaacagcattacatgtgaaataccttatcctgcattattaacggaccgcagcataaaaggcacaaaggcactgagaaggttgcactgaaaaatggggcagaattcattaccaattcgatatactgtcagctaacagtctttgattatcatatttacccttctgaaactgtgaaaaatcatgggcggagccgctgtgaacaatagcatgtgtaggcattttgtaaatgttgccttagttgtttaatgcccaggctgactgctggaatttaacacagtgacaactttctcagatggggcatgaaaaaaactgtgatattttactacctgagaagttaagcactgagatagttaggacccagctctcattagctgaatggtagatttttctaattagttctttctagtgcaattagcacgaaaagagtctaatcacctcatgtgaaaccaatctaatgctcagaaaagaattcccttggcctctctttcagattggatcttaggattttcagtctgcctccttaaagaatggaatctgttagtgactgattatttgaacggtaaggacagatctgtagaaaaggcaagaaatggacaacttattgacttgcagtgcaagtttggctggagaaggtgtttagaaatattcattaattggcagttatcacttcaactataggttctggttttcttgatttctttcattttgaaatgggagacttgggcccgggacagctatagttcagcatggctgcctctctggagggcatgaaacatactgcacattagaatcaaatgcattcggggcctgggactactgggcttgctttcttagcctctgcagtgcccagattcccccatcagtttttgctaatctgtgtgttcagggctttgcctgtcctctctctctccctgccttgcagtcatctgtaggcaccacattcatttttgaactgttctctaatttctagtgcccatccatcacttcacatttcttaagtaagccaactctgggcatctcagttgatattgttcatttttaactggaaaggaaactataatgacagcatttctggcacataattttttctttttttttttttgcgggggggaagtcgcttgccagaagatcgatgagaaaatgctgagtatgtgtgtatttattatcaactatgcagaaaatgggcatccttgctcatcaggctacagagggtgacaatattgaatttccattgttcatcccatcactgcccagtagaacttcccatgatgttggaagtgttctgtacctgcactgtccaatacaggaggcactagcgacatgtggctgttgagcacttgaaatgtggctagtgagactaaggagctaaattttaaaatttcatttaattttaatgagtttaaatttaaatagacccatgtggctaatggctaccatactgaacagggcagatgtagatctcttccacctcctaaccactgtaccccaccttacacatagctgcatccttaacagagaatacactgccctccgcagcctcttgctatccattctcttcagctttgccttaaaagcaatcagactttttccagtgctgtctggagtttgacacaaggcattcccttggcttgtgctatctgtagatcattctgtatttcaccgtggcagtgttttgttctaaagttggaaaagaccttgtagttttttaaagagccaaaatacaggattgtttctaagaaaggaggtggccagaatcagtaaatttaagctcatttgtggaagcttccaaatctcaaacctagggcagtattgaacacctctccaaaaagtcagattaagtatttgcaaatggcttcaacaaactccctctctatgaaattttaattatagttgattaaatattcactttaatcatcttaattaatgatatttgacaaatattttagctttgcttatgatattcacttgctctgtcagaactctccagttcacactgaaagggtaaagttaacaacctggacagacaggcccatcatgtgtgttatgacctatctggtttcctactcgcatggttagaaggctcattttattgctttgaactctggaattaatcctgcttaaaggagaatagtaagaatactgtggttttctgctcaacagaatgcatgttcatttattccacagacactaattgaaggcccattgtgtgctagtaattgtggtagtcactgagaacgcatggatggaaagacactatctatcccactggattgtaacctcaagccactggaacataaacagttaaaagtactatatgataaatcttctggaagacgggtgatggaatgtaagggaagaaacactaagtggtggtttcaaaacagaaagacttttaagatgtaacatgtaagggaaattttatggatataagggaatacaagggagagtcttaaggggattacaggattttgcccgggataaagagaaggtggggcatttgtgaaggggattatgttttcctaattaactgtattcttgaatgtctttgaagaaaggagtctctcctttcttcattttgtaaagcaacagtgtgtgttagaggaattgctgttaggaaaggaatgaggatatttggtgtgtaactgtgagtgctgggaaatgaaacaaaaggcagccctacctcaggtcctggaaaggcacatagtggtgtgagtgttgcagcccattgaagctacatcctcaattctggaaactaacaagaacagcattagggtgaggccagagatccacctaaggtgcaaaatgtaagggggcactcactttgagggtcgtgcaggttcaggatcagtactgacacaaccctgagaatgagtgtctcctaaaattgtgtgccctagacaccttacttacgccctgaaacatcccagccctgggtttttgtgcagtgaatgggcttgaaaagcaagtagataagaatctgaaccatggaaatatggcagacatggcagaatagaaatcaatgagacctatttgcaaggtaaagtcaagagaacctagggcagaaaaaaatacgaggcatgagagaggggaccctaattgtcctgtcactgaattctggggatcttttctattgcctgatactgacttttctccaatttctcatattcctcagctcctgccctgtcctgaaggtcatgcccagttcaaattcagcccttacctctttgctaagtcccatgccctcaaccttgttttcagagaaggccatgagaactggagtttttaaaatgtccaactctagatagatctgctttactgagtggtcttaacacattcagagaactgcattcttcttggctctctaaattcagtgaccttattttaaaagatgatcaacatgggttagaaccttttgaggattaggagacattttagcaagtttatcaagaataagcaaagatgacatttggctagcagtatgtctcccccaccccatcctgcaaaaccattttttttggagtgaagcttttccatttgacaagtttagaattaccaatactgcttgcaactccttccttactccaaactctgggatgttttcaggagggactcttttcttcaaaggcatccaagaatatagttaattaggaaaacatgcaagaaaagacatcttggctcctctggccgcctgttgtactcttccagcatatgctattacttgtctcagataagtagacaggtggctgtttgcaaagcagggtccaatgtgcctttgactcagagaagtttggaaacaaagccctctgtataataagcttctcactgtatgctgacgtcttctgatcttgcctattccccattacctacagtctgaaagaattttgtagggagtgtgtggtattctgcagaaggctattgtagcataacttagacttagccggcatttattgggcttagaatcacaaaatctcaagattgggtgactactggatggttatctaatccaacttccctccagaaagtctcccatacagtttttcccgcaaagtggccctcgagccataacttcctatgacagagtgcttactgcctctttgttcaacgctggtgaaacctcagtgatacttataagttaactttcattccttcagcattcttctctttagtgttaatttctttgatggtggtaccactttccaacttttatatgtggcctcttaaaatcagcttacccagagaaacttcctgcctagctcctgatttatgtagcttctcaccaccatgccctttctcccttcttataggggcagtttcacaattttgaagctccttgattcccttgagccattgtcctttccaaaacttgtcactatgaaaagtagactatgttttagcctttgaactataaaatctgcctttcagtaagcttagctccatattttgaggtctctagatccccccttagtatgcatcatgagacttgtattactcgccaagactctcatgactttcttcaagcattcagttttgtctaagaagccatcgtttgatccagaatggagtagacctaattatatctcctgtttttttggacttgaaatttacttcaagcctgatgataacctgttggtcagatgctctgccattaactaaatgacaccatcagcaaatatccagatagttgaggtcccagtgtcctgaatctgtggttttataatctatgtcagaagtctatcattttttttttcacctggctgtcatctggtatattctcaaaaggatatcacttttcttcttatccaggtacgtgccagtgtgcttcatctctcatgctcatggatctccatgcaaattgatctgcttttccaaaaactatttattaagcattattatgtgtctggtactatgtcaggtggtagagctacagtggtgagcaatggaaatctacgtgttttttgacatatgacactgcttttccacaatacctttcccaccttaaatcctatcccatgagcctgggtgatactcaggagattatttttatcatgtctctaaaaatctctgcttattttataactgatgatacatagacatctaaagagatgagggcctcacacagggattggccatgagagaagctttcagtgctgcgatctgaggccagtctgatctgacaccctcttaaaggctttcaagtataggccactgggttccacatcccatacctcttacctccattgtggctagtttctcatttgcggaggaggttagagatgttactctcttcccctccaccttcagtgtaaatttctcttaatcaggtcagctcacctccccaggcaagcaaacacatgtctctctgtcttcctgagctacccccgggaaagtctgcattattttagtaccatagacacagtctagaaatctgattcctatgggttgacaacatcctcatgacaaacccttcacctaccacatcatcttatttttataatcaccgaactttgttaggatgaagaactagagcactcaccaggcacccaactctgcgccaggctccatggtccccaaatgaagcttcctaggtctcttgtgtccaagccattcccctcacgtgaaacaacatgaataggtagagataagtggctttgtgacttggaacagacagtagcccaagaagaccacatgcctcccttctggccacgtgaactacatgaagcagtctcctttctgttcagccaagagtccgtgccatctcagtgcttgttttccttcctgtccctttatctggctctgtgcatgactgtttgagcagcctgtgtcttctccttccagccacacagagtactggtaacttctcacaggatattgcggtgtgcctccgtttacactgtctcttcttcctggatgctttcctctatcccctgcaatcacttcttacttacctgaaacttacttcttgtattactgcttaatgacagcttaacttccatgatacctccccacctccttctgctcaattctaggtttgagtatgtgccttcactaagtcctcccataatacctaagcaggtctctatcacagtccatacattgtttcctgtgtgtgtctgtttcttccattagactataatttccttgaggactgctcttgtgcctcactcatctttgtgagtacagtgccaagcatacagtagatgctatttaatgaaggtgggcatgtatgggtgaatattcccagtgtttcaggatgttttttctttctcctctggcttttctattctctgctcacctggaatgagagcggataaaataatacagacaggaaaccaggaagcagaagagaaccccagccacctacctacacttccccctcttagatgccctgcaacagagatctgtcctggggactccacctcatctttgccagcggtgtgcagctggcttcctaaaatccacccagagtaggggttagcttgtcagaaaaatacaaattggatgtcttctgcagggctttgcacagtcccctcagcacccacacttctgtgtcagggaggggatgcagggacacatctccttctaccctctgggagacttgtagtctacggctccaggagatgactccctggcctagaggactgtatccttaaaccactctctgctctgctggcttatgtcatcctcctgctcctttgggtagaagttctagagtcttatccacaaattgtcaccagttataggcttgagtaggcactaaatatgaaacatgaataatgacatgagccagcagagcagagagtggtttaagagtggtttaagggtcagagggaagggaaatgaaagccttggaggatttcagattcactcactcttctttaccttatagcctgtgctgcaaagtcagagtaaagaaacttctgttctgcctcattgcatccccaccacaacaggctgtaagcaggagctactccatgttttaatataaggaaactgaggccccaaaaattaaaaataactttatagtaccagctagccattggcaaaacacgattatacattcagatttgtccaattgtttccccatgtaaatgagaccacagattaaaattattattgtcaattaagaaaaaataaaagaaacccctgaaaagaggatctgatatgtgtctaactacctttaaatctccttgagataaattataaggtgttgtttctattgagccacccccatcaccagtttctcacaattcagtgctcagcaggcagtggctactcaagaattccagctggctgggcacggtggctcacgcctgtaatcccagcactttgggaggccgaggcgggtggatcacaaggtcaggagatcgagaccatcctggctaacacggtgaaaccccgtctctactaaaaaatacaaaaaaaaaaattagccaggcgaggtggcgggcgcctgtagtcccagctgctagggaggctgaggcaggagaatggcgtgaaccccgggaggcgttgcttgcagtgagccgagatcatgccactgcactccagcctgggcgacagagcgagactccgtctcaaaaaaacaaaaaacaaaaaaagaattccagctaagtggcagtgaactaatgagatttcatcacagagcatggtgaacgcttttctaaggtctaaatatgtgctctatagttgtcatggagggccaaagaaatgaagaaaataaagaacaatattagtcttaagaacttttttaaataacaaaaatgactgagttactaaggtcaggaactattctaatgcttttatactcatctcatctaattgctccaaaccccatatgaagtagacactactactactatcatgacccattttacaaatgaacaaactgagtcttgaagaagctaagtaacttgccaaagcacatcccagacttacaggcagtctggctcagagacctctgctcacagacactcctcttcctgggtctaattcaagaggggtgacgtgcgacttagagcagcctgtgggcttagtgattctgctgcttggtgcacagcaagacagaccataatcagcactagaataatagaatttttataagtgattaaagtaaaaccaggatttagagattgagagttgattgttaaaggataaatgatatttggaacatcttactggatttgattaaagtgaaattcaaaaaccatcacaaagagaatgattatttaccagtggtacttgaaggactttttttgtggcttaagtcattggcactccaatgcttaaaatctctgtgctcaaaaccagaatgtaattgatccttagaaaatcagaggttagcgccttctttggcaagctacttctgagctttgttacactgtaacataatcatcctttgaagactgagatctggttttccaggcttttttttttttcttcacatggtgcctggtatcttctcttgaacataatagatactttgagatgggtggacaaaccgaagtcattttatattgctttaggggctctgaatttaagaaagagttgatttctgaaagaaacataatagcaaagattacttaaacacaaaaatctcatttctgttcttaatcagctggacgtcaatacccaggttccagtccaagtgtcacactgtgcctctataagttaatcttttctggaagggaaaccaaatatgaaatagtatcaagaactgggacagtgttggaacaccctgcatgtcctctgttggccactacaaaaggttaaacaacaggagaggctggattagggtttgtgtttggaagtgcatttgaggcaagcttgacagttaagctcatggccagtactacatgccacagcaagaggacaataggagatttaaaagtgtgagcaggctgtggccaaatgctggaattcatgggctaagtagatgaagagtggatggagttaactagtaaacaagtttcatggtccttgaagagacctatttttttttatggtatgaatttaagatgtacaacataatgttttgatatacatacaattagtgaaatagcgataatttgatatttcatatatataccaaaatgattactctgggtgtattatttccttctcatgctgctaataaacaaatacctgagactgggtaatttataaagaaaaagaggtttaatggactcagttgcacatggctggggaggcctcacaatcatggcacaaggtgcgaaggaggtgcaaaagtacgtcttacatggtggcaggcaagggaccatgtgcagagtttataaaaccatcagctctcctgagacttattcactatcacgagagcagcacaggaaaaacccaccctcatgattcagttacctcccacctggtccctcccatgacacatgggagctacaattcaagatgagatttgggtggggacacagccaaaccatatcaacagggaagcaatttaacatatctgtcaccttccatatttaccctttttatgtggcaagaccacctaaaatttactctcctggcaaattttcagtctacaatattattaactagagtcctcctgccctacattagatctctagacttaactgcaagtttctgctctttgacctatatctgcccatttcctcctcctccctacccctggtaaccgccattgtgttttttgtttctatgtctttgactgttgttttttagatgccatatatgagtgagatcatgcagtactttttttttctgtgtctggcttatttcacttatcatcgtgttctccatgttgttgcaaatgacaggattttgtcttcttctttttttttttttttttagatggagtctcgctctgtcacccaggctggagtgcaatggcacaatctcggctcactgcaacctccgccttccaggctcaagcgattctccttcctcagcctcccgaatagctgggattacaggcgtgcgccaatacgcctggctaatttttgtattttttttagtagagatggggtttcaccatgtaggccaggctggtctcgaactcctgacctctggcgatccacccgcctcagcctcccaaagtgtctggattataggcgtgaggcaccgcgcccagccgatttccttcttttttaaggagatgtatatgtgtacacacacactacagcacattatcacattttctttatctattcatccattgatggacacttggttgatttcctatcttggttattgtgaatagtgctgcagtgaacatgggggtgcaggtatctcttcaagatgttaatttcattttctttggagggattgctgtgttgtatggtattctatttttaaattttggtggggtcttcatactggttttcacaatagctataccaacttacattcctcctaacagtatacaagtacctttttctccacaaccttaccacataagtgttgactttttctttttcttttttcttttttttcttttttgatacgaagtcttgctctgttgcccaggctggcgtgcagtggtgtgatctcggcttactgcaaactccgcctcccaggttcaggtgattcttgtgcctcagcctcccacgtagctgggattacaggtgcctgctagcacacccaactaatttttgtatttttagtagagacagtggtttcaccatgttagccaggctggtctcgaactcctgacctcaggtgatccacctgtttcggcctcccaaaatgctgggattacaggcatgagctaccaggcccagccttgaccattatttttaatagctaacaattattgagggcttaccatttctatgagtctaagcactttacaaatatttaatcttcataacaatctctgacatagatactactgttaatcccatcacacatactaaaaaactgaggcacaaggagtttaaggaactcgctcaaaatgtcacaattagtaagtcatgaagccagccagaacgcatgctcttaacccctgcactgttctgccaactctttggagtggtttgtttcagttgtcagtttttgtttgctgtctctgaaaatccttgctcttacagtgtcagccagagtcctgcattgatcacatggcctaacttgcctctctcagtacagtgactttttaatcttcggctgcaatcctttttttcctagactgtaaactccctgagggtagaaagtctgtctcattcatttgtgcccattttaatgaatgttgaaagggagcgtcaggaggggttatctagatgcctgtggatctagattattcatcatccactgggatctttattggtgttccttgtccccaaggagggagtcagcagcaacagaaggcagcagagatctcatcagtgttcatcaaacacatgttgagtgcctactacgaggtaaacagaacagacgttatcttctgtgccctctcagaacttaaggtacagcaaagaaacaaatgagataagcacaggtgtgataaatgcttgtttaaaaaacattttaaatgaaatgcttcgtttaaaaaaagcgaagaggctgaggtagagaataatggaggttgggtggggtaggacctactttaggtaggtaggcatgggaaattcctcatcgaagaagtgacattctaagcgaagatttaaccaacaagaatgacatagctaagaatgagaagactgctggggaagctccttgttggcaaagaaaacagcatctgcagaggctctgaggttggaaaggctttgtttcatctgtttaatagtggaattcagtgacactcattagttacctcttcacacattcccgccaaacacttgtccctgagtctgttctttttcattagtggttcctaatccagttttcaaaactgctcaatatttggagaggttttgaccagttgctctggaaacagaggcggttccaccatagccaacagagttcagaacataaattgtccatttatatccccatttgtatcttaagcttagcttgcataggactcagcaaagcaatatgtcaaattccttatatttgttatatctcttttttcactgactcaaagcatgaaaaatttgaaattaataaaacaattttttagatgatcagagattcttttttctaaaattttctaaatactatggttgtgtcccttaaccacaggcatggtggtttcactgcattttactcaagagaagattgcttacaaatatcacacaggagacctttctagtctcctgcaggagggtggctgacccagggaacctccaggcaagcaggacatatgccaagtatcctacatgtggacagtgtctaacttgatccgatctttctccttccccatgttttagttaagtcccctgaaagcccccattacccactgttcataaagggtctgtaaattatttaagagaaggaaacacagcctttatcccatcggatttttcctctcaatcacttgagtcttttctctgagcacacacacatggcccagactcactgtcaggggagatgtaatgccagcatctggtgttaatatctattgttgacattttgggaatgagaacatgagctgttagggaagatgtttgcttgtacctaattaatgtcccattgtatcctctcttgttgtcagctctgcctcaccatcctgccttggcattttcttttactggctaactttaaaagttaattatttctctgttgaatgttaaatgccaccggtttttaatgccgttccttggtgtgagttattagttatcaaaaatcaaaatgatctgtgcaattatcagctctttacctaaagccactgttcttgctaatcgcgtaaagtgtgatagcatttgctgatgtctggcaacatggatctttctagcagatttaagtttctcactcagtacattcctgtccctgtctggctttccttgtggagatcagatacaaagtcctggtacatcatctaatggaaacaattactgacagggccaagtcttcaaggcccattttgcttgaatctcaaatcactgttaaaattcatttggcaactccaataagtacagagagtaatgaggaacttcaaatagaatatttcctaatagctttcgtaaaacatgtcttggtaggagatcacaactctttctttacttgagattggtttataaaaataatagtacaagttccaactaacagctactaagtgcatactctgtgccaggctttgtcattagcttttcgcatggattatcttaatcctctcaacaatcctgtgaggtaaagtcttattattattcccaacttaaagatgagcaatttgaagactaaagacttgagtaattaatgcagcatcacatggctggtaagtcatgggccaggatccccagccagcagtcactgcagagctgcactgtcccaggcagtgactgtgactcacacgtggctactgagcacttgaaatggggtgagtccaaatgagatgggccataagtgtaaaacctacgccctgttcctaagctttagtcaataaaatagcgtaaaatgtctcgttaagaatgtgttcataccaattacatgttgaagtgataatattttggatgcattgagttacaggaaatatgttattaaaattaactttttgtttctttttcacttctttaatgtggctactagaaaattttaaatttcctgtactgcttgccttatatttctattagaaagggctgctgtgtgtgtgtgtgtgtgtatgtatgggtgtgtgtgtgtatgggtgtgtgtgtatgtatgtgtgtgtgtatgggtgtgtgtgtatgtatgtgtgtgtgtgtatgtatgggtgtgtgtgtatatatgtgtgcgtgtgtgtgtatgtatgggtgtgtgtgtgtgtgtgtgtatatatacggagagagatttctggagtttttcttgtcttaacgagtttccgatcctaaactattgaggaataggcacaaatttctgacccttcctcccctttctggttgtttcacttccagaaatccgacagaaagtacaaatttttacatctgagtctctaccaagagcccatctgttggctcttctcaagtatggaaagatgaaacactgacatgccaggcattaacgagatcaaaagcagggctaatgacagaaatgtggctgctgttaaagtgtctccagaggattatcggggaggactttttgttctccttacggcgaccccctcaaatgtcttccagagagtgcctctcagttccagttcctgaagtcctcctttgccttcctttccaatccttgtccaccactttcctggtccacctccctctctctcctggacgcccatctctggggtgtctgtgcagctgaggcggcccctctgttaagcacttctgacacgaggcaggtcttttttccctgccagtgagagcagagtgtataatggtgttgccctccaccggggatctttgagaagctttatggctctagcagacatgggggaaccaatcacaggcactgcagctgatatatgacactaatatagggttcacttttattctcaacctaaaaaaagatagattgttccaagtttagacaggctgtaaaatcatgtgcttctggaaccatgctgccttacccctgggaccactgtaattgctttacatctgtacaaaggttccttgtaatcgggctttctgccttcatttgtcttcttttcagcctcttagtaaagaccttaattggtcttagtggggcttttttcagttagtgcaactgtacctttagggctgaacaagtaccagacactacctgcggggagaagtgaggagatgggaaagacatcaatactcctttacctttaacagtttaattaatgtgctcagaacaaggagcagtttgaagaaattttggctcctctgggaccctgctacagatcagacataactagggttaggtggaattttctagatttctttcctgcttcagtctctgtgaacactcattagcctcataattgtctcacagtaaactgctgtatcaagtttcagtctgtctctttggaggatcaagttgctttatatcaatagactgaagtactaggggatgtgtgtgaagggaagtagcctctaatttcttctgtttcttagctactaattatttaataatacattttattgcctattaaaatgtggcataacttgcttgtcagcaaaactagatggaacctaatcatttgaggagaaggataattggcacttgtacagatggcttttattgccagttgggtttgttattgcagatagaattccttgccaggtttcttggttctgtttgtgggctggtcagtgttgtgagggggttacttactgtattacaacccaggcggttaaatgtggtattattgcaaatgcagtgtgtactcagttatagatcataaaggcttctgctgtgtaggtactttttttcttctcctccccccacctccccacccctggttttaaaggaccctagtgagttttgtaccacactgaaaattaccttatgtgctggaaaatgcatcagtggagactttgtttaaacaaagggcgtttttatgatggatagaagtggccaaaacttctggatttccatctagtaaaaatttgtgtaggaaaattggaccagtcccagttccttagtagaatttcacgaaggttttcctgttgcttcaaaatgaccccttgaggaatgttgtataaattccagaaaattgctcccaatgtttcctggagcacattaaaaaatgaaggagacacattgtgtgtgggatagtttggtaacagaattagttcactgggtagaacagaggggatcccaggtagttgggctctaagtgggaagcgttggccaacatttgtaactggaggcagatttggcaggcacttgggtaaggaacattttggtggtaatgaagtaggcaggaacaaaccgcgcaggggaagaatgcttcacactgccaggctttgtggcccagagcctagcattctcatccccaggtgcccagctcctctgccttcccaaggtgctcaagtttgctttctactcagatatggcccagtttcactggcaaccacctcccttatttgttgaaagtatggcttgtgttctgacccaagagagccatttaaaacctataatgatgtccatctttgtacgttttctgggtcccatcttcccatccattactactttgtcattgttcttatgtctcatagttgaactcctgaggtctaattgtgccagaacaacatgtctcccatctgtctggcaactctcttggcaactgcattcctcttcccttgaaagaggtacacactcttgacccctcccttccaaaagcctcagtgaagacctatgtgttttacctgtaaacgcacggcctttttaagtgtggaagggaatgtctagacttgatactttagaaaatcattatgaagtaagcttgacgtaggtagctttgtttcttaggggttgaacttgggaattactgtaatttaatacctacaataaatgtgttaaaatagggaagaaagccaattctgaggttttgtgtgttatatgaagggtgtgtgttatgcatcgtcattaaattttcttaagcaaaagctactagcaagtggaagccaatttaaaaggtgtatattggaaccagaacatgtagccagaaactggcttgggaggtgcaaatcctttagaccattgagagcatggaggttggcgagacctagaatgtctataaccttagtggtcacagtctacagtccactccggatgacgtggggctatggatgagcagatgggtgggtatgtgttggggacacgattttggacaacgttacatctgttgatttctttctgtcctgtagttgactcttctgagtttatttgtaaatcaccagttatgccaatagtattttcttatcagccctcaccctggtaacttttctcttgttgatctagatggacagacccaaatggagggaaaggattttaaacagtatgccattctttattaaatgaagcaccattaaaactacttccatctctgagtttcctttttccaggcccacgcctaacatttgcaaggcaagcatacacatggaggcccagcttacttctcttcacttctctttccagcaccatgaggagctttgctcctcacctcactcactccatacatccaagctccacccatactttttgccctcaccagcccagtaaacagctgcctgttgaccaccctcaagcctataggtgtgtgtaccaacagcatggcctgcccttgggaggatggcttccagggtaggaacctgcctatgcaggccctagaagcagcttaggccatctgggaagaggagtcctgtctccttggtgtgcaccacatggtcctaagggggaatgtgtcagctaggtgggcccatccccacgacttcatggattcttgccccatgtggagggacacagctggaggggccaagaaggatccccttatgcatggtctcaaggcaggggctggatctaacctgtattgcctctgccttttcatttcagtcttcataacctcacacttcatgtcctgcaaaaataaaatgaaataaaatggatccagctctccttcagaaaagctaaatggatgagctagttaactcatcagtgtctgcggacacaaggtgtgaaggcttagtctttagattcaatactggaaagtcagctggggtcttgtgcaaaagatgtgatgcattttgtgtaagaagtctgttttttccattagcatttaaagtatagcatactgctaaccagacacaaggaatgctctactatacagtgaaagaactatgcaagggaaaattgcagctgaaggaccaaattaggaatgttttcaatttcaagagtccagagaagaaacaaagcattatattgacatagtttgaacaaagtaaagcacttcgaaccttgctaacatttttaaatacacctttgttaaacctctttaaagaatgacgataattgcgttgttgttgttagtattcctaatgtccaaagggttgctgtaatttactctcccttcaaatttgaatatggttcataggcttctgtcttagtccatttcatgttgccataacagaatacctgacactgggtaatttataaataaaagaggttatttagtacaaggttctgcaggctaggaagttcaaggggcgtggcactggcatctgcttggcttctggtgagggccacatgctggtcaaaacatggcagagaaggtcaaaggggaagtggacacgggtgaagaaacccaaggggcgcccttgctttatctcagccggctcttgagggatctaatccattccctggagagtgagaacttactcacttccaaggagagtgttcatctattcttgagggatctgcttccaggacccaaaagcctcccactacaccccacctcccaacactgccacactggggattaaatttccacgtgagttttggtggagacaaaccacatccaaaacacagcagcttctaaaattaggttaagaggacacaaactctatccagaagccaatgtagtatgtgttttctattgtgctgctacccaaattttaacaatgagaattctgactttgatgtggcagtgatagtccttaaagtatttgaaggtctttgtcagttgccacttatttttgtgtagcagaagcacgggtttttatgattttgatcttcctttaaaaagatgtaggttaattattctgtcatctttatctgacagacaatggctaatattgtttattgtgtaaatgagacgctttactttcaaagaatgctaatattggctttgaaaggaaaaaataagcaagtatcttttttttaaagaaaaacagtctcactctgtcacccaggctggagtgcagtggtgcgatcatagctcactggagcctcaacctcctgggctcaggcaatcctctcacttcagcctcctgagtagctgggactaggtacatccaccatgcccagctaagttttaaactttttttctagggatgggagcctcacttgggatatagaaacccctagtgttgtccaggctggtctcaaactcctggcctcaagtgatctgtcgtctcccaaagtgctgggacttgaggcatgagccactaagctcggcctaagcaagtatctttaaatgggtccttgttagtcagcttttttcattatctcaagagaggagagtattaggagagcacattttcagacacactagaagacaacaataatacctgtgacaggtgtatgaccccggctcatggtggccttctcactcacctgactcaaagttgggcagcgggactaattttacataatcttaaatcttataaatgactttctgctctcttttccttacaccactgatttctcttccctggcacccttgctagtgagataaaacagggaacagagccaggaccagtgagctgccatgtggagtgctgcatctccctgaaggctgaccgtgagctgtgttcatgaaggactcattgtcacattctacccagaggcctctaagctgctcttttctggagtttaagcctcattcttaggacatgccgtgaatttgctctccaaaatgattccacacacaaaagtcctctctctataagccctaccagcattagccagagtcctcctggtattctttctcatctccacctgggttaaaaagtgagtgtgtagcagatttgtttaaaagggtcctcagctacacccagcctcccatataaaaatcgattcttggccaggcgcggtggctcacgcgtgtaatcccagcactttgggaggccgaggtgggcggatcatgaggtcaggagatcaaaaccacagtgaaaccctgtctctactaaaaatacaaaaaattagctgggcgtggtggcggacgcccgtagtcccagctactcgggaggctgaggcaggagaatggcgtgaacacgggaggcggagcttgcagtgagccgagatcgcgccactgcactccagcctgggtaacagagcgagactccgtctgaaaaaaaaaaaatcgattcttggaaaatcaagtcagataatgacgatagagcaaagtattttgctcgtgtcttttgtttggctcagtgttcatttgtcattacgcctcagcctccttttctttaagcacttgttgtgatctccgggcatgtgcttatgttcgtgactgttttccagagcattgctgggctgcttaacttttgatgctcccgtctaaataatgactaggttcctaagatgcctttacgcttcctagaagaatctgccaccatttgaattctctagcagcaccccaaaagtgctaaattatacagtccaaggaggacagtcatccaccaaagaaacaagggtaggatgaacagaaagggagaaagatgttgaattgagccaattcagggagtaagtaatacatgctctctggttgaactgatttttcatatggctaggtggctgggttctgcctgtgacttgttcaactctgcaagctactaaatagaataaaacttgctgaaatcagagaacttcaagaagataagttttatgtatatgtatatgtatataggcatatattcatatacatacccatgctctcacacactcatacacaaacttaaaggattctagtttagggtagacttaaccctttgacagttcaaagagagaagttagagtctacaaagtgattattatgtaaacccaacagggcctttcctggaaataccacaaaaatttcttagaattgaaaagatgacaaatgctgatttatgcagaactcgggacttcattgatagagcactgtcacttactacttccatcagcaggaatggttccttttaacatcagattgggtgtttacatggatgacaattagggctggtgaaatagttcaaataaaagaagaaccagaccggcatggggagtgaacctagttagttcccaagtattaaatacctgtcttccctcccttgtctctctcctcttcccttcctttctccactttgtttctcacttcactccctttccagactgttcttccctgtcagggaaggctgaacagagattgaaccacacaatacattgagattctgcagcagagaagacattcaaatcctgaaatactgtagtgggatctggttttcaaatgtttcttccccgggaaagtgaaacattccttgcagtcttataaaataagtatgttcgttgatatttcaagcaggagaaattcattttaagaagttggagtatttatatgtgacaggatagtagttcctctttctctcccccgtccctccctccctctctccttcctcccgtcctctcttccttcctccctccctttctctctcctctttgattttattttttaatcagaaagttctttttaaaggaagagaaatatcaacattgtacattctaacattccaaatgcttcatatagttccttgttttattgctttaaacattttttcaacagatacttaaggacatttttcaggagttgtgcaaggcatgaacacctggagatacgtaagctacagtggtgaacatggaggtgtccacagtaagcgggagagaggcaggtactctgcagtaagagacgggtgttaaagaaagataaattatctcaataactctggaatgacatcaaccccacttagaattaaaggaacagaagtctttgtgataaatattctctcagtctttccctctctgtgtgtgtataatatttttgttaatacacagatggtaatctaatgagatgcatttattcctcctgatatttgtaagtacagtgtatcttttcattgtattaactgttgttctacatctgtttggatccattctgtggattcaaaatcatgtagatcaccagtctctaatggttggacatttaggatttatctggtttctcatctgagtgtttattagatgactattggatttccttagacatattcttggaaatagaattgctatatcaaaaattatggaaaatctgaagctattgatatacctaatgctagatgacacattggtgggtgcagcgcaccagcatggcacatgtatacatatgtaactaacctgcacaatgtgcacatgtaccctaaaacttagagtataatataaaaaaaagaaaaaaaaaaaaaaaaaaatctgaagctattgatagtcttatttttaattgctctaaaataagtattaatttcttagaaagaattatttatttaaattaagatatttatgcagatgaaatacccaaatattctggtttgctgtttatttttatcccataactcaacgggtatttatataattaattatacttttcaagtttttcacccctatgttctacatatattgctacccatgtactccatactctattcttttatgcttctttgaattctgtaatttaaaaaatcaaagcaaactaaaaacaaaacaattcagctcaaataacattttttcctaaaaacctaagtctcccagcttctttgaactcctccttctatggactcttacagtcctcctctagcctatttatctcatttgttaattagctagctagcttttatgctatgttttattattagaatcctgtttcttttagtagattgcaaactactcagagccagagaccatgccttgtgttatttgtgtacacagctagcagagcaccttacacatcataggaatgggatctattttagtgattaatctgttctgtttttatttcagcagggtttgtggaagggcatggccaagttgatggtgatcatatgccttcaaatatcatgttgacaattatcacgttgatatggaaggaagggagactggcttactaaaaaagcattctagttgtctagattggaaaaaaatgcatttagtctttcaactgtctagcacctagtaggcagtcagtaaatagaagcttaaaaaaaaaaaattaggccgggcgcagtggctcacgcctgtaatcccagcactttgggaggccaagatgggcagatcacgaggtcaggagataagagaacatcctggccaacatggtgaaacccagtctctactaaaaatacaaaaaaaattagctgggcatggtggcacgtgcctgtagtcccagctacttgggaagctgaggcaggagaattgcttgaacctgggaggcagaggttgcggtgagccaggatcacgccactgcactccagcctggtgacaaagcaagactctgtctcaaaaataaataaataaataaataaataaataaataaataaataaataaataaaaattaaaaagggctcaaaagtccttttaaataagtatttcaatttaaataaatttattaacttctttttactccatttccttgtctaggaaaggtggatcagactcattcattataaagaactctttctgattgaaaacatttagttaactctctctggtcatgggcattcacatattggagacagaagcagaaccagttgtgtaaacactgaccaatgtgttcaatgtagttttaaggaaataaaatattttttatttatggataagtcttgatactaaaatgctaaaaacttttcagttagctggctggcacatatctctcagcagtaatactgctgtaggtaaagttggcgtgctacttcctttttcatcaggtacagtagctcagtttagacatcatatgtaaatggagaaaggtactgggaaagcctattaacaaaaaggattagtaggaattttaaaaattaactgtgaaaaaaattctttctgctctaagacatcatctctgcagaaaagatatttggtaaaggaataattggttcagattttctcccctagtatctttactatctgccctgaatttccctctttactcttcagaagagagggtcagttccatcaccaacccggatacaaagattctcatttcccgttaggtcatagcatttagaataatgtttattttggtatttttaaatattttgtggttttatgaggaaccaatacatgtggtcaagcattcccttattaagggaaataaagctcaagctcagaacagatggagaaacttgtccatacatttgcatgtgacgtgtggtgtagaccagaagtttaaagaatattatattccaatgacacatataaagcacctgcaattgacagagaacgtaaatggtattttttaaaggctagaagttcatagactccttccattcatgtctgacatcagcaagctcttaataatgcagtgtgtacttatctattgatcagaccatttaagtagtaagacatgagaaagtagacactattgtctggtaattgaccatattggagagttaagtgttctgacaaggaactaagtgtatttaaccttcagataagatcaattttaagataatgcctactttagtaatgaaccaaagctgttaagaaaactttgttcttctaaagcagtgctgttttgatgacaactatcatagttttaatgaccagatttgttcctgaccagattggtcttccagggcaacctggaaaggagttactaacattcatcctttacttaccataaaagctcaaatggaaagagacggtgggaagcagcactgcccaaagagccactgattggtttaggagacatcttttgggtacctaccataagccagtcatcatgctatattgtagggcttccaagtttagtaacatatctgacttcaagaaacttatgtttcagtaaaatggttttccagttgtattttatatgttaaatctctaaaaccaaagcttatgttagtccttcatttattaaagagagagagagaggaagttctcctatatttgcctctgagtcttttccctgtgacctaattgaacaccacttgaaacctccttctcttagagacagatccataagcaaataacacattataagttatataatacaaacatgaacaaaattgacaagagaacacaaagaaggacgtagctaaagcggctctgcatttaggaaaggcttcctagaggaagcaatgttgaactcttgtctcgttggatgagtaaagctccccagagagagagaaagtggaggcagtgtgagcaaagcaggtgaaggctgtggtatgtttgtggaagtaggtagccctacttatatgtctggaatagaggcttttgaaaagaaatagtgagagataaaacaggaaagtagattaggccccaaatcctccagaggtttttaagcagaagactaaaaatcagatttggatatcagtgaggtgatgctgataaactcggggaaatcacaggagctttttaagaagagagttgatattcacctagggcagcagtagtgacatttgagaagaaggaatgttccaaaggtattttagaggtgatagtggatagattaagtgactgaccaaatgtggagaacggagaaacaaaagaggagaggaggtaagggtaattctgagacacctaaccccaaagactgcatgggagagtatgtccaatacagggggaggattgagttgaagatgagaataaggaagaatcagttcattttggagatgttgagtttgaggtacctgtggaacatccaagtggagaactttggctaacaaagtttgggtcctgaagataaaggttaggattagaaatactgatttatgggctgggcatggtggctcacagctgtaattccagcactctgggtggctgagatgggcagatcacttaaggccaggagttttagaccagcctcaccaacatttgcgaaaccccgtctctactaaaagtataaaaattagccgggtgtggtctactcaggggctgaggcacgagaatcacttgcaccaggtggcgcaggttgcagtgagccaagatggtgccactgctctccagcctgggtaacagagcgagagtctgtctcaaaaaacaaaaaggccaggcacggtggctcatgcctgtgatcccagcactttggaaggccaaggtgagtggatcacgaggtcaggagatcgagaccatcctagttaacacggtgaaaccccatctctactaaaaatacaaaaaattagcccggcatggtgatgggcgcttgtagtcccaactacttgggaggctaaggcaggagaatggcgtgaacccatgaggcggagcttgcagtgagctgagaacgtgccacagcactccagcctgggagacagagcgagactctgtctcaaaaaaaaaaaaaattgtaaaaaataataataataataatactgatttatgaaatcactgatgaagaacgtagttttgggaatgttcactaatgatggctagaagaggaatattcatcaaaggaagcagtcagaggtattatttgatatctaggaagcagtagttttgcaaaagaagagagttctcagaaagtgcaaatagcaatatctgataccattgggagaacagaaagatatgaatcttctgaagaccactggctttgctagctattatagaaggccactgacctttagcaacaactttttcaggagaatgatgagagtagagactgggttagaatcattcgaaaagaatgaaataaagaaatggagacaatgaatgtgtgtattcagtgtttagggtgatgagaaatggagaactctggctgaaaagagaagcaaagtggagtgggtgtgtgtatgagagtgagttgaatatgtatataggctagggatacctgtatgtctctgggatagtaaggggtttggaatcacactcgtggaagatcaaacctctggcctactatttaatagatatggaccttgatcaagttcttctgtgagcctcaagttccttatgtataaaatgagattagtactacctacctcttggagttctttaaggatttaatgaaattatgacatagaaaacacctagaactcagaaggcactcagtaagtattagtaggattttttgtttgttcattcttgtgaggaagggagatattaaaggtgcaagagagggaaaggatgatgcctatgatgtcagagaaaagagatgagtagacatgggatttgagtagaggtagaggagtagtttcaaagtgagattggacctattttcctgggtaatagaagggaaggacagtgataaaatgaggcattgggcaggataatttaggttatgttgcagtaacaagtagccctaactctaagtctgttaatgcaacagaggttctctattcatactgtatggccaacattaattaggaagggtttctgttttatctctgcccctcagagacccagcctgatgggagctccatctcggtatttgcctctgcagtcatcatagagcagtcacatggctacctctgacctcaggaggccaagaaagtgcctggaattggggaagcacaggaaatatttggtgatcagtgctcaagaccagaacaatgagtagagctataggtataagtaaatagggaagggatggcagtggcttctctttttcccaatgaaggaggcagcaaaaatatgatccaccaagagcagcgtgaggggtcttacaagagtggtaaatgtttggaacagctgtttgttaaaataattaaacgggaacatagcagcaaaggaaaaggaagttgttctggttaaatatttatcattagggctccatgcagaatgaaatggtaatatagctgtgattcagtttcttagttcagcttaaaattagaagctgcccatcaataattttcccaagagagcgatttctactgtaacagcacatagcctagagaaaaggaaacgcacaaagaacaggctttcttggaatgggaagagaaaccattgcagggagagaatatgagagagaaattgattgtacatctatccctggaaataaaagtgagttcccttttatcagtcattctgtaaatacatctgctgctggcctagcactttggcactaggtgtaatcgagagaagtttaggactttattcatgttctcagagaatgtgttgtttggtcagtggggcaaaaaagctcatgccatgagtttgagggttgtttcatatatgtcttttattgccctaattgctataatttttggggaagagtttcatggaacagatgagattaaaccgaggccttgaagaatagattaaccttggagggtgtcaaaggaaggaaaggagggcaccagagtgatggtatcattcaagggccaatggtgggagtgaaaatggtttctaggggaggcaagaaggagagtggccagaaagaagaggagatgattagatcaagaaattatgggacatcaggttgaactgacaggttgcaaccttattataaggagttggtacaatatggaaggaaagcaggaattagttgttgcatgagagaatggcattgtgacaaggtacacttggtcagttgggaagaacataatgagaaggattagttaaaagacttcataataatccaggtatcttctcctcatctactccccatacgacttgaatgacttcctgttaccttcagaataaagtcccagtctttagtcctgcttgcccatccccattttgaagagactaccagatatgcaaagggtactagaatgaggaagactcggatatgttggaaccaggagccagaccatggatgtacaattagattccaacaatgctatcaacaggcaacatttaggagtgcagcctagcaccttgcaagggctgtgaccaagtcagacataaccctgccctagtaggatgttggaggttaggtgggctttccaacacaggcatcaaaggagaaacctctttattatttttttaaacagctttattgagttatagttcacataccacacaactcacccacttaaggtatacacttccatgttttttaataaatgcacagagttgtgcattcatcaccataatcaattttagaatcaatttcatgacccaaaaaagaaaccctgcactccctatccatacctccttccttgcccattccactgccccagctctcagccctaggtaaccaaccctctatttttcatctctatagatttgcctattctgggcatttcatacaaatggaatcatacaatatatggtccttgtggctgatttctttcacttatttttcactggttttaaaggtttatccatgttgtagtatatgtcagtacttcatctctttacattgcctcataatattacattacattgatacaccacattttgtttatccattcattaattgatagacattgggattgttgctactttttggctgtgatgaaaaatgctgttacaaacattcatgtgtaagttttttgtggatatgttttcatttctcttagacatatacacatcttatagtggaactgcagagtcactatcatttaaccatttgagtaattgccagaccatttgctacagtgcccgcattttacatttccatcagcagtgtatgagtgttctagtttctccatatccttgctaacacttgttgtctttttttttttattatagccattattctagtgggtgtgaagttgtatctcattgtggttttagtctgcatttccatgatcagaagttgtattttcaaaactaaggcataagtgaaagcatgtttgagggctttgacagaagactgagaaataaatattaagagattgatatggataggaggatttcaagcagttaaaggctaagaaggaattggacgcagccttttatagtatgcccagtccgtggtgttgccatgttccatggaaatgaataaccagaggttgctattctcattctaaccattctcagtccttggcaacacgaagttaggttcacctgaaaaataattttaaatataccagcgttcaggccctatccttggccaactgaataagaatgtttggggatatagcccaggtatctgtagtttttaaaatctcctcacatgattctgatgcacagtgagggttgaaagacaccattgtaaataattcagcaggattaaataatagaatgaatgtattgattgcatgcactgatcagataaccatctgcctttattttgacctgtaagcttttctgagacacctgctaactgaatttgatcaaacagatgtaagacataattgcagtgtgcagtcttctccaactaatgatagaggaaaacctagcgtgtggttcataaaatcaattaactatttctccccaattaaaccccgaatttaaaagttttgtcacagagttgagttccttcatttttttcccatttatattggctacacatgaggcatttgtttatttcaatgatttcaatctctttgagttcaacatacagtgatgcttttcaaggtaatgaattagttcattgattagtttatctattataagacagtaaattgatgtaatgagtcactgatagatatcctagtggttggctcatagatacaagcattttttatggttgtgttgatttgaacacgtgccatttctatgcaaaccttgacctttgtaattgacctgatgtgtacagatgacagcaaatagatcaatcagggtgatgtctcattaccatatggccagtgatttctctaggactaaagtatgttttttctctttagggattgagggccatttttgtcttctgttaaaattctaggtctagtcacaaaactggaaaggatgggaactaaagtgcaatactcttctgctagtttggcaccaagtttccaatgctgaaaagaatgattttccattgtccagactcttctttagaggggtcctatgtccccaacttaaaatttgagctacacagtttcagaaaatgaaaactgatattccagaaagaagaggtagataatgcagaaatgtcagtaattcaacatgttctgatgccaacctggccagagatggctttggtttcattgtagattgagatttcttatagaaggtttaaaatgcagggaaggtcaagttgagttttgtagaggaagatatcctagtacttttttagggaacccgtatttttgtcttaatggaactgctaaaaagatgtgcagtaatccaggccttctcttcctctcaaaaacaaactaggcactggttgtatttagtctcacattcgtttaatctagagtaaatggaagcctggcatatagatcattgatgtaaagagtatcatggaagaaattgaaatggaaacaaacagtagggggaagacctgtctggtagcacatcctctccatctggctagccgtcagatttcctggccatttctcattgtacacttcatctttgcttgcttcttacttcctttctttcttttttttttttttaaaatacaagtattttaaactgcaacctggaaagaaaacgagaggtatataacacatccttaaaaacaaagaggaaaaaaaaatcaaccctgttaataacttccactttgagagtttgggctggttgcaaggcccaggggactaatctgctgaatgtgggaggatatggagccatttgtcctaggagaagcactacattaaaaagaagaggaagaagtcatgggggaagggcgagggtctgctgatgaaagtagctgtcaaattagcaggtctggaagttgtagtgcatattgttatgagctgctcaagttcacaccagagcaaccagctccatccatctttctcagtttacattttaattggcttgtagttaagttttttaaacactgcgagattgctgacatacactgcaatatcacgtgaataatttatggaggttgctcaagacaagcttttttttttttttatgtgagaaaccaggggggagtgggggaagaaggatgagagggtctgtgggaggggccaggacagaagagcagacacaactgcatgtgctgtgctggatgttaaatgtttctgctggtgtaggcagcagcatttgggatttcagggaggtttgtacaatacgatcttattaataacaattctgtcaagagagcacccgattaaattgaattgggtttatgactccctcttggtttctgaaaatgtgtggatataaaacctctgcgatgtgaatattggataacaagggtaggtttctttatttatttatttttttggttggttttaatcattcctcctactactgagaatttgcttgtttataaatgcaggggtaggcatttttcccaaactatctttctgttttctgctctcaaaataatctagagaagatggaactggcatcagtgggcagttatcctaagaacgtgactgcttctaggcatggtttgctggacaactctgagtctagaatatcatctaattaacacctgtgggacaatcctcttcatctgctaaaatatactttttttctcattacaaaatgagtaaattatataaaatgtctagagtacaaagaggagaataaaaataacctgtaagtcctccccctgctaataaaattggtatggtttttgtttatatccttctagtcttttttctgttcatatttagtgaacataatttagtgaatcgtatatactgtttagaagtcatcttttttttttcactaaacattacatcacaagcatattcccatgaatggtctatacggaatgtcatttctaatgattgtagtgtgtatgtgtgaattaactatactttatataacctatctcctgcaactaaaatgcagtgttagtttataatttttatccattttagacaggcaagttataaatatattttttggtcaaatttcagtatacattcttgatcatttctttaggaaagctctgagaagtagaatttctacaagaagcagagtgagtctgagggaaaaaatcattaatgtctcaagaattttgtctcgaaaagagggataaagcacattttaaattaatgaaattaacagtttattctatttaaaaagaaaaatgatgataacattcaacatgaggttcttttaaattattgaattttttgccttgtggggtttcttaaccacaaaacctatctattaggattaatggaggctattttttctttaccaattgctatataactacttaagacttcatgtaatcagctgagatgctacaaatgtattgcctgtcaactccagtaaaaaagcgggcagttaattaaagggatgtcttgctgttaaacaaacttgcagtcaattgcttgtaagtaacatttagtttgatatgtagtcaaagggcaggaaaataagtgtttaggcaggactggctttttgcaacgtaaaaagagaagtgattatattggggtcaagatgagtaacctttcaactggcatattttccttctaaaaagtatattcacatatcagaagaaaggtgaaagacatataaggccttaaggttggtcagtttgagatcttttccacttacagtaactaagtcctcatcttcttgcatcccttgaagacactgttttaccctaatataaagcctggctttgaggtcagtgtgtgtgtgtttggacatgtgcgtgcacacagaccgtaagtagatgaggcaagaactccctaaaccaagtgccatactctgcagatgggaaactgccatccatagacccagtagaaaggctgcagtagcacagcagcacttgggacagctgctccaactcaggcccattacctgctcctcctaggagtgccccgatgctccctgcacctttgttcagctcttccttgataatccaggataggatcgcacagtttctggttggtgagcttgtagtcagaagcccttttcaagcttaacactttcagagggagggtttatccaaaagacaccatactgattcaatatgttaaatgttgaaatgcttgtgaaacaacgcatatatgatagagatttttttctatctcaaaatcacttggatatgagagaccagagctattagaagccccattgactttgctttgagattccattggaggtcattgaactttggagcctcactctgaagccaagaaatttcaactttgccagtaaccacattaaaatgtgtgtacctggcaatggtgaaccagcctcatttactggtttccattctttgtattggctattcattatttcatcaacaagaatttatttttttactgccaattttacgtccaactaggtagtatggaatgcaagagaaggtgtaagttatggccattcccctcatgggccttttaataaagcaaagtaaatatgtaatccacttacagtcagtcaagagcaatatttttatttgtaatgattccacattttagcttaagaaagtatttattattctgggaagaaaaacattggctgaattaatggcagattctgaatgggctttgagcaacatttggaatacaagtgtgtaaggtggggttggtgagatttgctttatttcctgaactgctatgaattagcaaattctaaaccagctgttttccaattacatacaataacttgtgcctacctaagtctgtctttctgccaagcttctacttgcaactcattttaaaacttattcctaaatacccccaaaccagtggaataatagtaggcatcaccttaaatcataatattttcacaagaacatgttcaatcttgaaataatggccaggttttagaaagtgggaggtgagaacggaggagtagtttgttttttgtcgttaaaaaaaaaaaaaagaagaagaagtgcttgaatgagcaagttgctcagatttctctgctgctttcttcccagatggccaaagggagagaacactttcactgaagaaagggataaatgaaaaggacacctctgtatccagttatttataggatgataattgatgatagggttggagttttaaaatgtttccgtgtgaacatcttgcagttcgctttacctgccttttctgtggtattaaacacattgcttaattcctattttcattttggattggcaaatttctttataaaaggtcagatagcacatattttagcctttttgaccacacaggtctctgacatatattctttgtttctctttttttttaaacaacactttaaaaatgcaaaaactcattttaatttacaggttgtataaaaatggactgtgggtgagatgtggccggcacaccgtagttggccagctcatgccttagagaaacatggggggatatcctgggtgggcatgagtatcagttaggtcagcaagatttccctcttactgctgcttgctttgttctcttctggtcactggccgtctcaggagctagtccctggagccctgctctcctgtgtgatgtaatggtgtgaaatggtgtttccagtggaaggcctgcaggggtaaatgctgtctctaattaacctgttcatttagtgctattatcctttatctcgaatgcagttctgctctgggaggataaggaaagtgcttaattatagtaacagtttcacattgtctttgtttgcatgatgaagtacaaaaagcccaggagatgaagctgtcagtcactaagtgtctttgggagcctcttggttttttgcatttaataatcatgctctgttattgcgtgttgttgaatgaaacctcaggtcacagtctttgtcaatgatctgacccaagacatctggcctatgtaagttatggctaatgtccacgaactggataatatcattggcaaattgtggcttcattgatgcctgtttatttgctttttgcctcaattagaatactttggattgttatttgtctttttactgtgttttctaactccctaattgcatgttaagtacctgtagtccagggaatgtgccccatgcttctttgaagcctaaagtcttttggaataccatcacaatatttttataggacttttttattaaccacaataaaaaatgtcctataaaaacattgcagagatcctcatactcaaactctgaggagccaaagtcagctgaatggtgtttgggtctcaaacaaacaaatataaatatatatatatatatatatatatatatatatatatatatatatatatagtgatatatatatcgcaataaaaatgttgtataaaatattgtaatggttaaaatggtaaaccatttatatatatttaaatagtttatatttaaactatttaaagccataaaatggcttaccattttaacaatttttaaatgtatagtttaatggcattaaatacattcgcattgtcgtacagccatcaccactgttcatctccggaacatttttcgtcttcccaaactgaaactccatgttcattaaacaataactctccattcttccttccccaaccctgccaaccagcattctacggtctgcctctatgaatttgactactctaggtatctcataaaagtagaaacaaatagtatttatccttttgtctggcttatttcgcttaggataatgtcttcttttttttttttttttgtgacagagtctcacttgtcgcccaggctggagtgcagtggcgcaatctcggctcactgcaagctccgcctcccgggttcatgccattctcctgcctcagcctcccaagtagctgggactacaagcgcccgccaccacggctggctaattttttttttttttgtatttttagtagagacggggtttcaccgtgttagccaatggtcttgatctcctgaccttgtgatccgcccatctcagcctcccaaagtgctggtattacaggcgtgagccaccgcgcccggccagcataatgtctttaaagttcatccatgttggcagcatgtgtcagaattgccttcctttttaaggctgaataatattccattgtatggatatgccacattttatctattcacttatgaatggacacttggttgctttcacattttctctattgtgaataatgctgctatgaacatgtctaagtcctgctttaatttcttttatgcatactcagaagtggctattgaaatatttttgcatctgccaatgtaacaacttttaagctctgtggaactttaaatattcttacggttctttcctatgttatctgcctatagtaaaataaattttataataaagaattcagttattagctatgatgcacaaaaagatctatgagaacaagcatgtattcatgctatgtaccaggcactgagattagctcttatgtgaattaatttacttaaggcccacagaatatgttatctgtgtgctacagaaaaggaaataaaggcttagagaggttgagaaacttgcttaagttcacacagctagtatgtggcagacagggttctacttcagagaccatgtttgtagataccatgaagccattcagaaaagtggattgcatctatattcctcattatattcccagcatggttagcagaaggcttatcattttccattgcatgatgtcacttttaaatttcaaaatcaaactacataaaataacatgtaaaattacttgaaagctttaaaagtgctatacatatgcagagtattaacagtaaatcctagtgatggacagatgttaaaagctataagtatatgattcagaaaccatctaagaattttaaactgtggtctaattattatggaagcttactggagcctatccttgtgatttgttagaacattgtttcatatgccattttattcgtatctcttccaattcttattaagactagcactgctgttatgaatttcatggctttttttttaagttgctggatataagccaggttatcatataatgccctttactacctgtagtcactttgggataggtactgtgccttcaaccatctttgaaatcctacaactcgtaggctaggtttagatgccaaatagctaaagagctatcatgttgaaaaactattattagggcgggcacggtggctcacgtctgtaatcccagcactttgggggagccgaggcaggtggatcacttgcagttaggagttcgagaccggcctggccaacatggtgaaaccccttctctattaaaagacacaaaaattagcagggcgtggtggtgtgcacctgtgatcccagtgactcagaaggctgaggtgggagaatcacttgaatctgggaagcagaggttgcagtgagctgagattgcacaactgcactccaccctgggtgacagagcgagcatccgtctcaaaaaaaaaaaaagaaagaaagaaaaactatcattagacttaatttgtgtcatttcagaggacagaattgaggccattctgtgtgtgtaggttctggaaggacacatttcagtgcagaataaaagatgtagttgtagcttggtagactggctgccttgaaaattagtaaactgtcaacagaaatattcaaatacaggctagaaaatcctctcaacaaggaagtaaaggggattcctacactaagagactgaatttattaatcttcagacttggtctattatgacatttacttgaagtgttctaagaacttcacctttaccattgtcttatgtggtattgttttcttcagcaaaagacaggagctaagaatttttggttggcttatttgctgtaccagaggcaaataactgtgctgtgttggaatgacttagaagtagaaaatatttcgatcaggtgcaaatcatggtcaggaagacaacaaggtcaactttttaaacccagattctccagggtgaggatgcatcatgtacaaaacatgactgacactaagcaaagagtctgaagtggtttgatcagtatatattgattatttgatttattgactttgctgcagtcttcttggagctcttcagcatccagtactataaaactcactttttcattgtaacatttgacttgagcaaggacttaggtatttggcacaaatgacattctctcctcttttctgattaatgtggctctgggatcaaacaaagttagtgcaaatactggaatatttgctcaaatagagaccaaaagggcttaaaattcagtgcaggtagaattgtttaagtatcagaagggcagactttggtaatttcagctgcatatgttggttcttatttcattttggtagaaattgagtactggagactgcctggaagccagcctccagcattgacgtctgacagtaaccgcaaaagcagtccccctttccgctggcagagccaggaccacgtccgtggctgtgatctcaggggagggctcccagtccacagcctgggcttatgactgggaagcctgcttcttgtaaggtggggaaaacagagccaaactgaccccacagaatttgaacttggagaaactgtcgaatccaaaggatccatcaaggccagggacaacgcctagtctgaactggcgaccatgggctttttcagagccaggtgtcagaaatgggtaaatatcaaattgtgtctgattaaaaacaggagggagcagagctccccttactcactgaggagccaaagtcagctgaatggtgtttggctccaaataattcaaaagccacagtctcatgacccaaccaaagaaatattcaaaactagcctgaaatagaacagcctgttttcagaaatatgctatcaaacacatttatctttggctaaaaaacgaattaagtagttttctcttaaaatggccagatatccattaacatagaagagtataggataaatacctcttatggagatggtcagattcatgatttcatttaagttaaaaatattggcaatgataccgtataaataatatttgctctcatccaacacttttggttgaattagtctattacctggggaaaacactgaaataggatgaaataatactaagaataacattagaattatatatttgaaaattactgattatatagctatttcaccaatgagatattcacaagataaagaagagggataatgatagcccaagtggacttcccaataatgcaatagtgaagaaatcaaaatccagccaacatggacatgtcttatatcttgattggaaggtagataacacagtacatacatttgtcaaaactcaaccaactgtacactttacagctgtgtgttttcctgtgtacaaactatacttcaaggaaaaagtcaaatcaacttatttatggagctacaatttatgagaaagtacaacattaagcaagccttgggagaaaaatttcccagcattcaggaaacttgcaaatcattcgttagccctagacacaaatgtaagaaaattttaataataaaaattaagtcaatgatgagggatttgaagattcttaatattgtggacctaaatggagcctctatgatcattaaccctccagttacaaatatggtaaaacagacattaagaaaattttagaaaattttccaaagaaaatcagagtcagaatttgactagatggcagaacgataagcttaaagctccttctcctttctcctttgtcacattgacttcctcctgctcctacctgctaaatattctcaagggtctgttttcagctctctttacctttatttttatattgcactcccgttgatcctttaatttcaaagttgttatttctttattcagtcagtaaacactttttgagtgtataccgtataccaagcactgttttataggtgggtgatacacagttaaaccagaaagactaaaagtcttcactcacagagcttactttctactaatgtctgtgtacctggaagccagatactgatttctggaacaagtattctcagcagtccagacaccattgccctacaacttcccttgcatatcacgacagtgtctcaagctcaacgtgtctgtaatctcctcttctctccaaatcatctcctcctatttcccccagcctgaagatcgtcattggctgtccttgttgaatctctaggtcaaccaatttgaaaaactctaaactcttccaaattgactttttcttagatcagttcagaatctccatgtttcctcacttctttgtaatgtccagtagctttctaactcatctctctactacaatccccaactctgatgtgtcctacacatcactgcctggctaattttcctaaagcacacctcctataccaactttttcccaaacacacacacacactctctcttgcttttcctttgatttcatctgcctttcaaattaaatggaaattcctctatctggcagtaaagactattgaaagcatggcgccaccctccctttcaaatctgacttctccactacaggtacctgtacctactccagctgaagtggatttttggctgctcctttggcaggccctagttctctaccactctgcctttgcccattgtgtttctatctggactcattatgcagctttgccccactccgtactcatcatcatcctctgtgtacaactcactcactgtcttttctaagactcctttctcattctgatcagcatgatttttccttcatttgagtgtagtcatcactcactgcattgcattatggtcattctcttccttttttattaaaacaacacgatggattttcataaaatgacacatccttattgaaaaaaagtatacagaagagtaatgaaagtaaaaaccacctgaagctgtatcacccagagatatctggttttgaacatccctctagatgtttctttgtgtgtatacacaatttatgaagtctatatatttttccagaactgagatcaaattctaccttttttcatgttgatatattctgatgctcttttaatgttgatcaatagaaaactaagctataatttgcagtggctgcaaggtatctcatcatttggctttaccataattttttgctttttgttgttgatttttttttttagcttgtgttcctcccagtagaagatgagaggaggaggtgcttagcatgtgttctgcccatgtgcttagcacagtcttgtaaaatgcaagtgagcagtctgtcatggtccttgacagggactgtttgtgacttatcactccatgcggtttgggacctgggaaaatgtttagagatcttgagaacaggttagagaggattgacctaaagtcccatagtaaaattttagcctttaaaaaaaacaattattactgctttgaacagccttatgcccccattgcctgtaagaaagccattcattatttcttgttacataatctgcagagagcttattcacttagaaagcagtgcattcatcatagcttctatcttatgagtagctaaaagcagaatctgttctgcatctttgaggcattcttcgcagcacagacctcatgctatcactaattagccagagcattcccagccaaaaatcccagtgcctgtccttgacaaaaaagtctgttttttccacagtaagggtgaaaagcctgcctctctgtctagggacatctccataagacaagcaaaaatagggtggtggtgagctctcagatcagccagcgcaatgaaacagactgcagcctcttaggagacttactgtttgctgcctccctttctctgcaaagtgggatctccattagacgatgcctttgtactctgacaaaatacctaaccaccatgagacaagccacttctgcattattctgtacattgttcctatccattccccatttttggcttcagaagtcatcccctagccaacttccagccacttgcattaatgatgaatgcgattagcagcctatgctagtccattagggaaaagaaagaaagaaagaaagaaaaaccatgagattgtttgcttgtcactgggaagtgaagcttgacgggaacatcctcactgtccctccccaccgcccctcctgccatgtgcctgtgatctgtgcgcatgtgctcatggttgcccgtgttccatggctctgccatttgctcagtggggggacgttttcttagctgagcagtgcaccactctgcctgagggattgagaacatattgcttggcaggtgggcctactcagacgcactgactgttgtttcagcactgacagggaacatacatcatgcaggcccattatgccagcataaatccatggtaacctgttcaaagggctgcaaccagcaaacaacgtgtttgggtcttaataggtgatatttttgaaacatataattgggatctgagaagtaattctggatgacaagccactccttctgccatcctaacagaagctgggcctacagcaaaataccactcctgtcatgctgcacaaagatgactgccattccagctcagctccaggctgctgtgcacggcgccaacggtgccaagagcttgtctgtgcagggaaaagagccctcaggtttgagggctttcctttgtgccttgttgctctggactgctggcaaaaggagctcctaggattgttgatagacaatgtcagagcctctttcttcagcctactattacaagtttgaaagggatctagagtttgtttggcgttgggtagtggacagataatcctcaaagcagagggttctgatcaaagctatctttcatatcccccactggcctccagtaggagaatgagatattaataaagtccttgaaccgagtgtgaaggggcttggtatcactagccttgctggctgcttccctacacagaagccagacatgtggtgccagcaccttggagatatagtgggtaaagtctggcacagccctggtcacaaaaaacactttttccctgcgtttctaggatgaggaggtgaatgattagtttacacgagtttccatccattggagtcatgatacagtttccttacaacacacttgctccatgactcatgttctgcattcctgttgtgcagactctcacaagatgcacctcaccgcacataatcatctgttgctttctgcttatccactaaactgttctccctaaagacaagtaccatactttatttgtacatagccaagtgctagtttcatgggagacacagaaggactgaagaaaggaagatgttcattcataaaaagaaaagccacaaggaggtcattgtggagttgttgacttttttatcttcttgatttctaagaatcataacatgggtatttcagtatgacttgccaattaaattacaactgggtggcaataatatattatttaactctcattctgccacacaattaaacaagtatcaacacaacccaatatgcatgctacacagcatctgcacttttctcttgctacaacagaagtagtttccttaaagcaaattagaaaatagtctcatgagaccaaggactttataaagtataaggaccaaggagggccaggtgtgcacctgcagtcccagctactttgggggctaaggtgggaagatcgcttgagcccaggagttggaggctgcagtgagcaatgctggcaccactgcactccagcctgggcaacactgtctctaaaaatagaaaataaaataaaattttccggaccaaagagaagactgttatgatgtgaacagtagcagtcaatatttagaaaagttgtgttcctggtagtctggcacagaatggtgattatgagagatatgggctgtatcacaccgcagcagtggcccagctaccactccaccagtttcaccactttcttgtttctactcaacagtatggttacttacaacacagagatttgccagcccaggtttcatagaaacatagacgttggtcctctgtccccagatattctagttataaggcctatacgggagcctgggattatactttgaaaatgcttttcaggtggcttagatgcagccagtctgtggactctggtttgggaagcactgattagaagcatacaatactgagaagcccagtagttccctcagtctttccactgccatgtgccctctatatgtcttccctgggccatctgtctaaaaatgcctgatgtcttagacagaggctctgaggagccttaagagctccttgcaagacataaaaccaagacgctttttggtatggaagggaaatatcatttagcacatctccatgtccatcatcagttctacttctgaaatattatttaaaaacacatttattgaaatacgattcacttatgaagttcatcctcataaagtatacaatttattgatttttggtatattgacagccatttagtaaattgtacaaccatcaccactatctaattctagaacattttcatcaactaaaaagaatccccaggctcattccctcctacccagaccctggcaatcactaatctactatctctgtggatttgcctattctgaacatttcatctctgaaatatcctaaagtgactgaacgtaagtccagttatatctgcaagtgtctctaaaaatgtttttttctaatattccattgggggttgctggttcttacatcttttatagtcagaaaggcttcacttatctctaacttttacctacattacccttctataacattaactcatattcccttgtcttctctgcctctctctcatcatttcaccaacactcaaattctttataaattcaaacatcattatcaagtcacctcccgacttttctgtaggatgaatgatctgaacagtcctatgccccttcccagatttacccaatatttcctcctatttcttcttatttaaataaccaagtgttcacccttttctctaaggtggatgccttcatttgtgccctcttttttattctctttctcctgttctagaacctggctttggactgcatcttcattttctttcttcaacctacagtaatactccacgttcacactttttaaaaaatacctctatcctgctgcctcctcaagctaccattctctttttctcattctcttcactgccaaaccttttgaaagcacagtttgctctctctgttggtgcttcttttccactcactcccacttcacttcttgcagccatgactctgctcccgttactttacagaaatgtctctccttgtagttcatggcatcaagcccagtacccttccctgaccccattccctgagacctctaggtaacctggagctcagttgactattcctccatcgtgaagcactctttttcctttggcttctctggcactccacattatccggctacttttggctccagtgtttagtgccttcccaaatatgggtgcccactcttttatctgtctattttctccctttccagcctcataacaccatctggctcctaactatgtggataacttccaaaactatcttcaccacttggatgtcctgccagctctttagactcattgctcaaaacagaactcaaaccctgacaggctttccgtctttcctaatgttggccataatgtgacccaaggttgcaaatttgacttttttctttctgtctctatcacctccttggttgccaagatgacaagccatcatgtatataatagcttttttattctattgaagctgtatttcttcatccatcgtctctacttctcaatgtcattgcccaggtccaggctttcattggctctcatttggactatcaccagaccattcgatctctgctcattccatcttctacgttacggccagatagcagtcctccttcaacacatatgtcatatccctaggcagcaatctttcaaattcttctaagcctactgaatacatcctaaacgccttatcctaaattacaaggccttctatattattttccattccttcatattctgtatgttctgtcctaagcaaagcactgatcattctttcacctccacaatttctcatttacaggacctttcttgtcctgtattcttttatctaaaatgatgtcctttatttctgccaacatgattctatgtgttgaaatcctctcatccttcaaattctttctcttccatgaaatcttagaacagtatttctctctcctttgattttccaaaattgtatgaggtggcgggggtgtggagggtaggaaaggacatttagcactttgtcttgtatttccattatttatgtgcttgtcttatccagtcccgccttggattttcattgttataactcctgtgactgctgataaagtatcttaaatatagtatatcctgaataaatgtttcttcagtgaatgaattttttaacttctataaaatatagaagatgtaaaaaactaaacttgtagatgacaggctttatgtcagtgtcaagagagttctcagtagtttccacactattattattttcagtcaatctaggtacaaggctgaggtgaaagaagcttgagagaattgtagcaaacctgccatcatcttcatattgtaatgcctttgcatttgcataatattttataccattataagatactttcacatcttatctgaccctctctatacttattttaggttagaaagagatagttatcctaatatccatttcataatgaggaaagtgtattctgggcagttttaatgacttaattaactaacgtcaggttattgattaggggcagacctggacaaggggacctgttggctgtctttaaatatttgaagaactatcatgtcaaagaaaattaaatctttttttttattctttatttcctcagaggactagaacaaacacaagtgaattcaaactcaatgaggagataaatagtttaactatcagatccacttcaagatgatattggctgcctctgttgttcaagaggagctcagggagagcaagctggccaaccaggtagaggacagtttgttggaaagagcctcccaaaaagtataggttaaccaagctcccttctaattttgcaattttgactttctttttaggtcagcactgtgttactaccctgcataatctaagttttgatttctgtcttttttttagaactcaaccttaagcaaatttagccacagtgtggtccaggtcctagattttttatgagatggccactccaccttatcctacctactccttgcaactgatattggaccacctacaggtgggaatctaaaagaatgtatttccacccaatccttcagtgcctagagctgccagcccaatggggaaaaaaaacacgaagttttcagaaaatctcacaggtgccatcatcacatgtagccggcccaatctggcaactccagaaacctgtctggtattatggccatggtaggcaagcctagtgttctctcagaatgccactctctcattctgttggaaggaggtgggtgactctaatgagctccaaacttttccttgaaatggggagttgcctaaaaaggcaactgcctccaaacagccaaatggaaattatgatatttcactgaactcagaaccaaatctgccttttttttttctttatagaaacattttatgtgccatgtgccttgggagccaaaaagaaatcatactttggctccctgttccactttgctaagctcagatactgtaaataccctcctctcctctcataacgttaaatttttcatgaattcatcataaaggagccactttgtagatttggctggtaccagtgaaagacttcattttctatttcacaggaacttttcagtgcaaaaaaaattacgggtgcaatgttgaaagactagaattattcatcaagtcttcactgcctgcaaatgaagagaatttttctaaagcctatctgggagaatgcagacacagacatgcatattttagatggtgcttcatcttcaccgtagccaccttatctttctcagaagagtcaggagtaagagaggatatgtgctttcttattgttttgtggattcattcaagagttcacaacagctcacacatttcccccttaccttccagtgtacctggaactcaccaatgcaccgaagaagagaatatttccttgaattacgcattgatagaagtaccaatagctttgtatgataaaatgcagtggttctcagactttgacatgcatccgaatcctctggtgggcttattcaaacacatgcaaggcctcatgccaagattttctgattcagtagatgtgggttgaggcccgggaatgtgtctttttagaaaggtgatggtgctaatgctgcctgtacaaggacaacactctgaggaacactaacataatgaaaagaatttagaaatcaggaaaccttggttttagtcctgagtcatctaccaatgatggatctgtggccaagtccctgggcctcaagagtagtgactcctgcactatgtgaactagtgttactttgagaataaaacctgagggtgtgcaaaagaacactcagcactcagggctctagagggacttgaaatgttataattacaggcatgaggagagttgaaggaaaacaaatggaagaagttttaagatgcattcattctgtcaagtccaagcagagaatggccggcactcaactgctatgctaagaaggggccagcgaagatgggaagagttaggtagttcccccattctgtgacctggctctgaaaaagtcagatactctgctttattcatgttctatatgatatagccaggccgtgttagagcagtggtcctcaaactttcctgtgattcagaattaacctgggacattaggtaaatacacaaaggcccaagctctttcctacttcaaggagcctgggccttggggtgattctgatacactccaaagtttgagaatgaccgaatctgtgctgataactgtaaaaccatatcctgataacctgtgaaggaactgaatgccctagacagttttctcagccttgtctgcacattggaatcccctgcagagcttttaaatcccacacgtacaggccaccatccagtcctgttgtatctgaatctctgggggtgaggccctggtatcagtaccttcttacagcgcctcagtaattcacatttgcagccaaggctgagaagcaagcactgatttagaaagagtcccctgtcactgtcctcagcaaatatgttttgtttgtgttttgttggcttgtctctttcccatatcatgtggtgagaatattgaggccatttctttgtgcccagaaaccaacacagtgcctcactctgtgttttagatgctcagaacatgttggttatttgaatgaatatttcaaggtatttgaatgttgaattaatgaatatgcaaataaaatacaacaaaactcaccgcagaagtcccctacattgaactgttttgtgtaagcacaacccgttgtggagttcaggccctcacaataagagagtatttattgaataatttgcagaatcacaatcacggagtatctgttgaataatctgtaaaactgttatcaaccccaactataacttactcttccaggtgagatgaggagtcggggaaacatttgcctggcagagtgttaagaatgctaaaaaataataacaataaaaataaaaaaataaaaagcagcaaattaagacatatttgacacctactacgtggcatacattttcatttgttctcactgaatcttcacagcaaacttgcattctctctgtttttttctgagggaagaaatggcaaaagcaaatcgcctgtgttgggaagcacaggggagtttgttggaccccagagcttgagttcttttccagtatttattttgctgccattcagagcttccctagccacccctgctgcttccctgacctgctcctgcatggctcaccaatggatcctagtcacaccagcccccacagagtgcttcctgacttctccagtgaagtttcccccgggaaattctcactggcccatgatttgattgcctgaccaccttcaaaacgggttagataactcatagtatgctatgctaaccatgttaaaaagcttattctcatagctttgcaatggcttctttgtatgactgttcctcgccctagacagaaggcttcttgagggcaagaatggtttcttgcctatctttatattccctttgcctagtgtacttcctagcccattggagagactcagttttttctaaggaatgaatgacagcagaaactcatccatgatgagcaaggacctcctgaaacatttcagcatgtgtgcatgtgttgtgcttcagaatattttagaaacattttccagatttaattgaggcttctgggaagccttgctgtgttcttccttgcaaaaaatagaaggtcgttaccaggaagtctcagtgtaccatatttatctggtgagttttgaaaatactgagtaatgggactaatgactcaacatagtattttccaaactgtgaggtaatctttggactttgcaagattattatattaagtgtactttttagtctgtcagtaaaaaataaaaagcctgtattttcacattagaattcaaagaacatctgctgcgtattgtaaataacatattttgaaaaccaactgatgcatactcagcctgcctccgcttgctaactatagcaggtccttaagataagattcagtttgccattggtaccgctcttgctttgacattccactgtttggtgaaccaccgttttccagaaatctttagacaccattcaaccctctaaacaaactgagtacagtgaggttttcagcttcctgttttctagtgggattagaaagggaccctattcctagatgatgatgtgtttttcaaggagttaaacttagagaggttttctactggggccatttcttacccccaaggacatgcatcctctggctggaagctcagctcttactgccttgcagagagccaccagttgccacaggcaaccgactgctcccgacaggaagggtagtattgattttgctggtctgcctgtaggggagcgggccaaagaggaatgctcagaggggctcctctgtctggggtgtgcatttgcacagcagccccattcatgtcctccagcctgtatctcacctcctcgggagactgaaaaactcaatcagcttttcccttgttccttctcagtttgtcttgttagcactctttcttagcaagtaagcaccatatgtcttctatgggaacttgttttcaggagattcccagcgcatgtgtgctggctgggaagagaggaattggtgttttactaaccagcagcgcttgccagagtgcccgcttttgagtcctgcccttcctgctcatctgccccatggtctagtttgtcctggacacagtatttcactggatcttactggggtcgcagaaaattgcctggcttgtgagggatttttctgaaccaaagagagagcctgtgtggatgcctctctgtggttcctcattatcctgggtagtctgtgtctcacaagcacctgttcattgatctggtcctctgtccttgcgaagacgatagcacatactgattataggggctctatgtgatgttattgggcttccttgctcttagccagccacccatgccaaagcatgcagctgatatgttctgcttttgaaataatttggtttctgtaacacgaagcccaccacccccctttcaacctttaatacctgtcttctttgaaagccagcttgttgagcatccaatttgtctcttttcttcttcactttcccccagtttccttgcactcaggctgtcttttatcaaaaacagagagtgagccaatgacacctcatggcaagcagcagcatgaagcattttcttctttcaccttgacatcttttcggcaaagaaaaagcaagggttgggaacctgctctattcactttggcttctacagctacctcttttaaaactgctggttgttattgcctggtagctgtctccctgaaggttttaccagttgttttggaaggctggctattttctattcccttgggaattcaccttacacagtcatagatgcatgtgttatgtgtatttgtgttcatatgctatcaattagtaatgaaaaatcaggccaagcctctttggtacttttttttcccctacagatgagtagtcagtgttcataataactgccaaaacttatcttgagtttcctgagtgccatggtctcatgtcattcttacaacaactttttgaagtagtccccattttacagatgagaacactgatgcttgacaggttatgcaccatagtggagctaagacttgaatgcaaagattctgccttgaaagcccaggctattcaaagattaactggattgcctgggcctgatacggtatctctcagtcactcatttgaactttgccaaccatagtcctaaatgcccaatgcttatccttggaaaggctagatatcagcaaacatgagatgagttgaaaataatctttgttctgaagttctaagggataagacgcattgctaccaacatatgtggcctattaaatgatgattctcagtggcacagaggagattgaccactgtggtggggaaggtggggcaaggactgagagagagtgggggacagttctgttatagcccaaggtgataaaggagttgtgataatcactggattgataatcactattctagaaccatagtgttcccctaatcataaaagctactattagccacgtgttgtggctcacgcctgtaatcccaatgctttgggaggccaaagtgagaggatcgcctgcagccaggagtttgagaccaacctggacaatataacaagaccctgtctcttaaaaaatgtaaataaataaataaatgtttaaaagccactagtaagtgaacacatactatatttctggcattgaactatatgctttcatttaatcattctcattaccctataagaagatactgttatctcattttttctctgtaaaatgagatttctctgtaaaatgattcttagtggcatagaggagattgaccactgtggtggggaaggtggggcaaggactgagagagagtgggggacagttctgttatagcctaaggtgacaaaggagttgtgataatcactggattgataatcactattctagaaccatagtgttcccctaatcataaaagctactattagccaggtgttgtggctcacacctgtaatcccaatgctttgggaggacaaggtgagaggatcgcctctcaccaagtttcagagaggttatcctggctcaaacttgccacatcttaagtgaaaaaaaacttagacttgaacccaaatgtgtttgtcttcaaagcctatgctctattctttcctaattatcagcgtctttttgcccattgtgatatttaatcagaatcattatcattaatagctcatccaactgataaaggaaggaaataaatgaattttgtatttgtggaccagagtatgtgattgagctgagtatgcaaagatttggtcccctggtctactggatgatcttttcacaagtgatctcagttagctgccatgtgcttaacataggttgaaagttagttgacagctttgcttcactgaggattgtttccagaattatcagtgcttagtgactttgaagataaacatggattacaggttcaaggagcctacgagagtcagaagagttgggaatgtgttcccaactctttaactagctgtacagatctgggaactgcacttaactctattcaacctcagcttttctatctgaacatcatgttaggtaattccaagatatgttttagctctgaatgataattgctgtttaccgtcaagcctgtttgttttacacatacagaaaaacactcttaacccatgaagtatgtagttaattgagaaagttaaaggaaaaagtcataaagaagaaaatatgctatctacacttaatttttaaaagcagctttattgtggtgtaattgacatatgataagctatgtatatttaaagtgtacaatttaataagttttgatcaaagtacccactcatgacaccatcaccacagtcaagataatgagcatcttcattcattactccacaggtccccatctcctttgtggtcccttcctcctgcccattcacccagcccctgccacatatacaaaaaaacaactgctaagctacctgatataccttctgtcactatggattactattcatgtttagagtattatataactgtaatcttatagcgtgtatacttttttgtgctctcacattctgtataattattttgagatttttttttttttttggaaacaaagtctctttctgtcacccaggctggagtacagtggcacgatctcagctcactgcaacctctacctcccgggttcaagccatccccctgcctcagtcttcagagtagctgggattacaggtgtataccaccacacccggctaatgtttgtatctttagtagagatggggttttgccatgttggccaggctgttctcgaattcctgacttcaagtgatccacccacctcagatgcccaaagtgttgggactacaggtgtgagccactgcacctggcctattttgagattcatctatatggctgcatgcattgaggccatttctttctttcgctgagtagtgtatggatataccataattatttaccttttcacctactgatggacgtctgggttgtttacaatttttggttattacaaataaagctgctgtgaacattcacatacaagtctttgtatggacatatatgtatttgaatcttaaggaagtatctaggagtagaatggctggaactggtaggtatatgtttaatgttttacaaaaatgtcaaactgttttccagagtggttgtaccgtcttacatttccaccaaccgtgtataagagttccacctcctcacatcttcaccaacactttgtatgtcttttcattttagccattcttttattatttttttttttttgagatggaattttgctattgttgcccaagctggagctcaatggcacgatctcggctcactgcaaccttcacctcccaggttcaagcgattcttctgcctcagcctcccgagtagctgggattacagaggtgtgccaccatgtctggctaattttttgtatttttagtagaaacagggtttcaccatgttagccagactggtctcgaactcctgacctcaggtgatccacctgcctcggcctcccaaagtgctgggattacaggcatgagccaccgagcccagcctcattttagccattctaatacacatgcactagtgtctacttgtggttttaatttttgtttttctaatgactactgatattgagcatattttcatgtgtttgttttccatatgtatatctttttgggtaaactttctatataaatcttttgcccatttttaacttaaattctttgttttcttattgtgagtttgagattatatatgaaaaaatattgtttaagaaataatctaaaataaaaataaatatattcttttatttatttacatatgtatacaactccttacatgtatgtacacacacacacacacacacacattctgcaaagatttgctcctagtttgtgggttcttttcatttacttaacagtatctttcaaggagtagaaatttttaattttgatgaagcccaattaattaatttattcttttatgtgttgtgtttttggtattatagttttgcctaactcaaggttaaaagattttctcctatgttttcttatagaagttgcacaattttagtgtttaaatttcagtctccaatttctgagttcatttttgtatatgatgtgagttcatttttgtatatgatgtgacttcaattttgtatatggtatgaggtatagattcaagtttgtttgtttgtttgcttatggatattaaagtgttcccgcactgcttattgaaaaggttatgcattctctactgcattgcctttgcacttttgttcaaattctgttgttcacatgtatgtgtttatttcctcaccctttactcagttccactgatgtaattttctgtctttatgccaataccacatcatttggttactacagctttatgatatgcttgaaatcagggaatgttagccttccaacttcttttccaaattgttttggttattgtaggtttatatatttccatatgaattttagaatcagcttgtcaacttgtatggaatctatagctcactctgaggagaattaataccttattgagtcaaaccatgaacaaagtattttttcatttatttagatcttctttcatttctcttagcaatattttgtattttttaatgcacaggtctttcacatattttttgtgtgatccctagttttttatattttttgatgttattgtaaatgataacatttttaaaatttaaatttttgattgttgctagtacagtttatttttgtatattgatgttatattaaattatgataaatgcacatactattatagttctagtagcttttttatagattctctttgatctttctacatagatagttattatgcctgcaaataaagacagtttaactcttccttttcaatctggattactatctcttttccttgttgattcacttttagaacctccaaaacaatatttaatagaggtgagagtggatatttctgttcttagggcaaaagcattcagttgttcaccataagtatgatgtttcctttgggattttcatatatagccattttccgtttgaaaaagttcttttctaatcctggttttctgattttatcaggaatgaatgtttgatttttgtgtgtgttttttgatgctttttctgcaactatgaagaaaatcatatggtctttcttttttttttttttttttctttttgagacagggtcttgctctgccacccaggctggaatgcagtggtgcgatcatagctcactgcctccttgaactcctgggctcaagtgattctcctacctcagcctctcaaatagttgggaccacaggcatgcaccactatgcctggctgatttttttttctttttttgtaggaacaggttctccctaggttgcccaggctggtctcaaacccctggattcaagcgatcctcctaccttagcttctcaaagtgctgggattataggcatgagccaccacacccagccaggtcttccttttttagtgtgtgactatggtgaattatattcatagatttccaatattacgccattctatgtacattgtacatacattgctaaggtctttttttttgcttatgggtttgctttttagagctctgtatcatctttcttatataaattctcatccataatgcattctctacattctcagtttcagtttaagtggaggcagatcttggacacttgtcaagttttcaagtcctctaggtttaagatttgttttgttttgccagtcttttataatttccttgtccacacctaagtggatagcagtttatctttaagtttctcacctttagtgagtgtctaaaacactcttgtttggtttgagagaagcaacaattatatgtccatattcatagttcagcaatgaaggtaattattaattaaacgatataattgtaatacccagcacaactgggtaaaaaaataaaataaaataaaataaaataaaaataaataaaaacttgggatggattacagctgagtgttggtaagcatacagcccagtggaggagagcagaagtgtgtagactagagaatagccaactagactcagatttagtgtgcggtggtaagctattcagagagtggaaacaattagttactccagggaattacagaaatggaaactaatagagcttctgtaattctctttcattcctataaacagtattcccttccttcagcaaccagtgggcaaaggtccagaggtcaccttctatacgaggaacacaaactagtcagcactgaattatcctcacaattagaaaaacacctgtgaccaagtgtggatccttgcaatgggctttaactatacctgtagcaaatatatggaagaaccctggatttagagtcaagtgagcctgggtttgaatagcaatgactgtctctgtgttgttgagcagccttgggaaaattagtacctcagagggtcatctcaaggaataagtgatagaacatgtatgagacagacacagagttgtaggtatgccttgtgtgtggtttggatccttgttgcaagatgtttacactatctagagtggtgtgttctacccaaccatatgatcctcctgcccaaaaagttccctagctctagcctgtcgcaacatttgatgcaaatggagaaggaaggacattgaaggcagagaaaacagtttgaccgaggttaggtggcaaggaaggagaaagcatacatgggaagatgtgagcagtcaggattgggcacaaggttcatgctgaggtaggggggcagacaagctgaaaagtcgcctgatgtgcgaccatgccaagccgtgaagattggctggattctctcacctctcccctcacaccttatataggaggttggtaagcaaggagagtcactgaaacttttctttttaagggaacgccatggtgagagctgtgccagggattctcaaaccttgactgtatcagaatcacctgggagcttgttaaaaaatacatataccttgggccccacccagacttactcaatcctaatctataggtttgggtcaaggcatctgtatttttaacaagctccctaggcaattctaatgcacgccaaagttgagaaaccactgctttagaaggttaatctggcagcagcgtacaagatggattggagctgagagagcctggaggttcagagacctgcttgcaacaacaatcccggcaggagataatgaggttaggggctgtgggaatggaaaggaagaatcagatatgggaggtatttttgagaggcagtcagcaaggactgggcaacgaatttgatggggaatgtgagggagaaatgggacttaacaaataatgtcaaggtttagagaagctgctctccatggcatgaagggagaggtaacagaatcccctggggaccttagtcaaattgcacacacctgctcccctttctgtgctcatcctccacatcttcctccttccctgcaagttccctgagatgtgtgccaggatggggcatatcagctcctcctggggaagcctgcatgtgtagtttgagggggaaacttttccaggtgacacttctgttgcaagccacttgttaggcatctttgagcctgtgagaatagtggtgtggtgagattaggaggaaggagggaccaagctggagctgaccacaggacatgaaataacctttggaggctgtggaaatgtgagttcagagctgtggagcaagaagtgggctgtgatataaattcaaaaggccactgcatggaggtcatggtgaagacagatgagaccgtggagagtagagaggaaaggatccagaatgaagcttgaagaaggcctacggttaggagtcatatgcagatgaagggtcaaagaagagcaggctgcagaggtgggaggagactgcttctgcttcaaggccaaggcatgaggcagacatctagaaagatctgcaaacaggagggcagaactctagctcctctgccatccttccaccagcgtgattttgtgcaggaagcagtccagtcccccaggagtatgtggcacagtcatgtaaaggggttaacgctgtataggaccacacatttgaaaattttctttacaaaatccagtgtcttttgagctgatgtaccagagactgacaggctgtaacttcttacactattccccccaggtttctgatcaactcataaccttctatacacatttttggcccagcacagccaaatgtaaggtattaaaaatcattatagtgctttggggtccttgctccccgcaaagttccagacatgctgcctgtattttgtgatgtcacactgtgaaaataggatgttgtgttttggaggcacctccagggtgcccagcaattggcacatcttaagtgaaagaaaacaaattgagtgagcaacagtagaaaagaaggacatttgtatcaacccaggaaataaagaattacgcagagatgctatttatgctgctatgaagctgtgacttgatagggacagcataaaggttgcccactcctgacattggcaagacttcaggctgaccagagccactccactgaagtggggtcagctgtctcagaaggtgctctgtgaagctgacgcagaatcacagtttgctgtaaaaagggcttacacatgtaaaaccttgtattttgtcttagaagtatcctggaagctatcgcattttcttagtagagacacagaggcatcaagtaataaagaaacgattccaaggttccagactcctgggtagttgggcaggagactcaacctagagttctggtttgtagggtacagagagaaaggcttgcatgcgggaagagcacatttaagaatcacttggggatgggcgtgggttagattccagtctgttgcttcttaactgtgtgacctggggccattcatttgacctttctgagcttcagtctccaattgtaaagggcagaaaatcatatttacctcctgagagtagtttcaagaattaaggatgaaggcaccattacagcgcttggcatgaagttgatccccccaaatcgatgcccatcatcataattactgggtttttccccagtcgtctgaacactcatgtactcccctggatgcacgcaaagagacactgctgttttcctttggcatccctagtttggattttaaatgcttttttcctcattaaaataatgttatagctggaaggagcttaggtgcagttgaaataatactgttacgaaggtctgtccttcaaggcatttataaactgaatgggactttttgagtgggcctggacaccaggattttacgggaaaggtaccctagcccccttttttacaagtgaacttttattaagccaccagctctcagaacttgcagaattgctggaaaattgccttgggcagggtatgtaatcacaaaatgaataaaagacaacaggatgtgagtctttccaaagcatgggaatagcacactgcaacttcttgccatccctaccctgggcaaagatgcagctaaccagctacattgatacttggaattaagtcaggaggcttggccaggggcccccaccattccacaccttgggcctgactgccactctcagtacaggttgctaatttaaatgccatctcctggcactgcatgttgaaacaaactggaaaatagcagggcctttccttcatcagatcatcaatgtctgcctggcgtctgcctgcctactgtggccaacaacctgccttcctgtgagcatcctccaatgtacaaatacctcaaggactcctgacctctgggatttcatggctcctgtccattcttctctcattctcttagcaaaagaaattacttaagaatgggtgagggatggagacatctctcagctccctatggggtcttctttcctgaacaaactgagcagagccgcaaaagaatacataaggaaggcttggcagaatgttttgatacaaaattcattacaggtttgtttatgtgctgggcagtttgggtcctcttacacgtgtgtagacactgcattccttctggttcaagttttgtgtttagagagaggttttggaaggagatcaaagatgtcagattgctggcctaattcttaaaagaactgatttggggaaaggcttgaaaacattcatacccaggtttgaaaacaagaagtagcaatgagtccagaaagcttggtgacatggataacagtatatttttaagaaaaagagaatttgaatgtcttctgcacaccttatccgtccctaatctccatatcttccatatgtatttttcttgttttataacactgtctaagactcgagtgtaaaatccatcatccatcacccaaccctcacttttgagtgggcagagggtgttgtggaggtgactggaattcattggggtcatatctaagcatgagttaagagatctatctgggactttgtcttctttcatgttttttcttccttctttacagtacaccgtcaatagagattgctggcttgtcatccagtttcctaaatttcctgacttctgccttgtctggcctttattcctgtctatatctctctggcttcaaggtgataaaaatgctcacattttcttaggaaatattcagttgtattctctttgttgtgaaggctcctttgtccactccgtctcctccatttaggggaggttttcagggataattagtgaactcagagggatatgatgtaccttttcaaatcagggtctacttccagtttttcaggtttgttttaaagtgtgtggctcaggcatagagagcagcggttatttggacacctggagttacttggctttgctacccactaccttttaatgtgaagatacctcattgcattgctctgcatatgtgcagaggaaatttggggggaccctgttcacctttggcatatcttgatagttgtatgtgcctgcttgttgttgttgtatattgctacagcaatatggctcatcatctttctacctaagaagatacaggggaaaagaaaacactgccataatcaaaactacagaaatgggtttcataagcattttctctaactactgcgtctacccagatccaataggaatgggagggcattggcatcgttagaaaccggggcaaaagttcctgctgcaatataaaatctatagattacgcttggaatcagtggaaaccattgccctttatgccagctgcttcctgaaggagccaagaaaagtgtatagttcaggggaaatgcaaatataagctccctcctacctatagcaggaaattagaaacctctttggttagcacaaacagattatgatttttttgcaagagagaacaggagagaggaaagatacttgaggtggcattgtataccataaagctatatttatgtgctaagacaagcaattgatgttgttctataaaatatagtaaacacctcctccctgcccttttgaatgtcagtcagaattcagaatcatgaaattttatagtattactggttagaagggcttcccactgggagcagatgccatctctgtcttcatagactcagagaaagtcctgacatgtttcatggcgttcgtacgtggaagtctgtgaaatggaaaggaaaacagctttttctgtcaacctgtcactgatacaagcttttacattccatcagaatgactaaactttaaagctgttttcttcagtgctgagtatctctcagaactcccaagtgttatcagattgatagagtcccagcatatgatagaagaccaaagcattttgtggcatgatattaaaaattcattcaaatactcgataaagcgtggttgacaaaagtgtgaaatggaataaggtagagtgaatttcttcatggtttattgcccttgatttctctccacaaaataaatagacagaatggactaaaatctcttctttatgaaggtgggatcctggcagctgaaggcctgctcataaaaatcctctccgtgccacatacccttgcaatgttcaaagttggaagcaatggaaatttattgctgttatatgtattcatgtttcagactgagtgaataggtaggggatgcttttatgaggttgctgagaccctgtgaagaatagagaaataaaacacacttgtttttcccttgaagcttgtttttttctaggggggattggtgattttagtaattatagtggtattggcaattcatggtggtggtggcggcctggtggcagtcctccccctgaaggtatttaaaagaaaacactcttttcacggtctccccttcctgcctgccatcttgttttgaaagagaagcataaaatagcaaatctttaaagccactgcaagccaagcctgtgttttcatctgtctccctcccttgccaggcctccctctgcctttctgacctgccacccccttccttccttctgtccctccctcctctcagaggacatggggagtgagaggcttccccctgtttccctgcaatggtgggacagaatgcctcattggtttcagatattaacttctgtgctgaaaacccggttggagctggtgtgacaaatggattgtacctgctgctggaaaacacagccctgtcccacccgcctgcacacacaagccctcttccccatcttgcagagcccaacctagggagcagggaacagagagctgccccgcggcaccatctgtttctgccagcatctatgttgggccccgccggttacatctgttgagaagaacagtgtacttgatgagttgttggaaagaaatgtttagtctcccccatcatctctgttagccattacgaggctgctgggctcacgtgggtgtatctatgtgtgcttcctctcaggcctcatctgtatcaattggaaatcagtcactgggagttagttgcagtcagcagggacccaaggcatttcccagtgacatcaattcgtcttctcttgcagaaattcaggaaacaattaaaattctgatgcgttccagggaggatttcaaataaatcagccgatagctgatatcttgtaactcttggtagcaaagcaaaattaacaacccagccgcatctgtgtacagtatgctaaaataaagaaattaaccatgcatcacctccaatagaggaagcagctggcctgttctcaaccttcccataagtacccaaaacctactgatttgttaagttgtcattctccttatggacatcaaggacttcctgcatatgccaaaaactgagctggccaaataatcggtaagttgcggaaaatccaggcaccgattaagctcagttataactcccatgttatgcagaggaaagctgacattttgaggcggacccagttgatagctgctgaggaggtaatacaggatgcaagtaggtttggcagcaggtttagccagaattttgtcagaatttgaagattttggaatcataatcagatagccagtattttctctctcccctcaaaccaaatgcattgtgcaagaacttgtgttaattatccctgttaattacagtgataccacctcagcttttccaggctcttttttgcagctgtctttgtggtgatttcttgtcttaccacttgctgaccaatggaactcaccattcttgctaggttctcttaaaaagcagcataacaagaaccggtcgggagtatgttcccttgaaaaataaaaatctcagcatcacacccaagtaaaagccatgtgccttattgaagttctaagtctatagtgtgtttgtgtacatgcccgtcacataaagtgattgtttattagtttcagtggatttttttcctagaaagatgcataaaattttaaagtaaaaagaatatagtgagccaggtggggtggcccacacctgtaatcccagcactttgggaggctaaggtaggaggattgcttgagcccaggagttcaagaccgacctgggcaacaaaatgagacctcgtctctacagaaaagtcaaaaaatgggccgggcgtgatggctcatgcctgtaatcctagcactttgggaggccaaggcgggcggatcatggggtcaggagatcgagaccatcctggctaacacggtgaaaccccgtctctactaaaaatacaaaaaattagccaggcgtggtggcaggcgcctgtagtcccagctactcgggaggctgagataggagaatggcgtgaacccgggcggcagagcttgcagtgggccgagatcgcgccactgcactccagcctgggcgacagagcgagactccatctcaaaaaaaaaaaaaaaaaagtcagaaaatgagatgggaggatcgcttgagcccagggtgttgaggctacagtgaattgtaatcgcaccactgcactcccacctgggtgacagagcgagaccctgtggaaaaaaaaaaaaaagaatacagtggctggaaaacaaaacatcacttgaaaattttcccaccttttaaattcccagcactgggaaggaaggggtctggtatggtagtgatcgtagggtcagctcaggaaatggttcatagggtgagctcagtgagaatcacattaggatgagaggaaactcttaagcagaaccacagtggggacattcaagagtggtggagaatgaatgccattcctctgcctgtaagagggcacattatgagaaaggtcaaagaagtaaggaatggaggaagatagggaggtctaatcagggcagagagaacaggaaagggtccacttaaccccttaaaaacagcaactgttgtcacccatctagtgcttacagcacctggtgcattctgggtgctcagcatacaatccctgataatcatcacacttttgccgacaaagtacagccataaattacttcccccaccacctccccagtcagcagggagctgcttgctacaaatgagtgaaaatattcaggtactcttacacctagagatcatggagagaagtagttaggagctgtgtactattgagataggaagctcttccacacaccttgctgtgggcttcctttgcacgctgcactggttacatcagacatgctttgtgctctgcagccttcctatttaaacatttgccctcaaaaacttcacgacaagcatatgaattagcagtttttccaacctaaagagaattatctactgtctctagatgattctcaaaatatgctgatagcaatttgaagcattataaatctatccaggttggttctgaccatgttgtagaagtaatttcaactggcacgtcacatgaaggaacagatttgaaaacagtggtatgcatgcccctgaaggtttcatcttggctaatggtctcaccaccttatggcactactttggattgtgacaacggtaccaaagaaaatgtctatagtctggaaaagatttatcactaagtatgactgtctatcactctggatgtacccccttgttataaatctccagcaagactgatcacttggtatacgtaagcatgtaggtacatgcatgtacaagtcaggagtgtgctgtgtacttgtctagtatcacttggtgtattagtatatatatatatatgtgtgtgtgtgtatttatgtatgtataataactcatagcaaatgtgtggacatagatgagaatataggttattagtttggagaaagacttaccagtttgtggacattgtatatacagaaattctcaagatttctcacatgatgtgtgtgcatgtgggcttgtacatgtgtgtaggtgtgcattccgacagtgtcttccatgagcgatgtagggtattattgacttgaggaagcaatcactgcttacatgaggaggcgtgtcatcttgaccagcatttaatgggaggggaaagcctaactccgtaaaaacgcaactgttaaatcttaactgccttagcctttcattctgagctgagacgttatactaaaatttctaaagcagagacattgttatttttcacgtattatgctaataaaaatagtgactggtgtgacttagtgattggagaaaaggggcttaggactgtaaatattggtagactttcctttcggtacacctttataagttatccatttaatcttaaaggaaattcaaatgccaattcaactgggaaatcaaactctgatgcaggcaactcagggacctgttctctgacccacgcacttgaacagtgttcacagtgagaacagttgagtgcatttagaagctagatccacttcaagaagttagcagtaggaagcatttcttttcctgttggctgggatgtagaggggtgttagaactttttccctctacttttgcaagtatgttttagggaactttataattagcttttgtgcatattttaattatttttgcccatcatcaggtgggattaattttgactgagagcaacagtgtagtggttggtttgtctcatgtaaaaggaaggctgggcctaggctgcagctcagtgatgctactaggaactgaagcacttcctattactgctctacctcttccccatgtagaatgcagtcattacttatgttgcctcacagtcataagttgaacttcagatttcatatcttaaatctggaaagtacaaaaggctctgtcttaggagggtttgtcttttatttatttatttatttatttatttatttatttatttatttatttcaaacagagtctctatcgcccaggctggagtgcagcagtgcaatcacggctcactgcacccttgatcttctgggcttgattgagcctcccacatctgcctccagagtagctgaaactataggcatgcaccaccacacccggctaatttttgtatgctttgtagagacgggtttcgccatgtctctcaggctggtctgaaactcaggctcaagtgatccgccctcctcagcctccaaaagtgccaggattacaagcgtgagccactgcgcctggctgggtttacctttttattcaggtaaggacagtctcttctgggatttgtagcaatcattggccagaactatatcaaatagtcatcccctacatatgaaggaactaaggaaataaattattattattattattgttattattattattattattattatgtttgagatggagtttcactcttgtcacccaggctggagtgcagtggtgcgatcttggctcactgcaacctctgcctcccaggttcaagtgattttcctgcctcagcctcccaagtagctgggattataggcacccaccaccatgcctggctaattttttgtatttttagtagaaatggggtttcaccatgttgggcaggctggtctcgaactcctgacctcaggtgatccgcccgccttggcctcccagagtgctgggattacaggcacgagccaccgcacccagccagaaatcaattatttttaattaaacatatcactgccctgaaaaaaaaatgggattctccttaaaaaggaagaagggagacgtgtacctgtaaaagagcactgctggatgatatattcccctggcctctgaaaatgcacagtggtcaggccaaccggctcatttctattgcatgatatgcacaaatcaccattgaacttcaaaaaaatcctaaaagagcaagtctcaagacaggtaaatccacagccacaattactactaaatgagaacttttagtttggaaacaagcacctagagaatgccaaaaagtcaatgttcctgcagatactagaagggcacagcataggtaaacacactttatcaagtactgtgatactgggatgttgaagcttgcctggtcacatttaaaaaaaaaagtgtcattttaatcagaaaagttttaacataacatacagtcaacttataaaattcattacaccaaaaataatatagatactacatataattagagtcagatattttcacagtgttaatggatgattccaatcctcagtcaacagacagttattgggaacctactatgtgctcacagaccataggggaatatagactatctgaacagataactatgacaacatggcaggtactaaactgggatatgaacgaggtggttttgggaaacaggacaaaacagccaacgctgccaaggattgttgatgaaggagtttaaactctttccttttttttttccttttttcttttttttttttttttgagacagtcttgctctgtgagcgatctcagctcactgcacctccacctcgtgggttcaagcaattcttctgccttagcctcccaagtagctggtatcacaggcacccactaccatgcccagctaatttttgtactttcagtggagttgaggtttcaccatggtggccagactggtcttgaactcctgacctcaagtgatccacctgcctcggcctcccaaagtgctgggattacaggtgtgagccaccatgccccgccaaactctttcctttggtgtttatatcctagaagataaatttggccttcaacaaactatcccttgataaccttaccagaatacctgggagcagaccagggtagaagttcttatatagtcttatgttcttatttttagcttccaggaaattcaagtttgggaaagtaaagaatgcctggattgatactaagagaataagtgaactccaggtctcaaaattttgctaagtaaatccttgtcaaggatcttcgtagagcaaggaatctaagatgatttatgcatctgtagaataacaccataatgaagctgttaacctagccaaaagctttggtggacatgacaccttaaaggtggccattataaagtgagagcctctgacagctttttcatggttttagataagtgggtgtttgaaatcattctggcagctcaccaaatgtttctttgcatcttgactactggatgaatcttgactacaagtacagattttatgtatacttattaaaataatataatttggctgggcgcagtggatcacacttgtaatcccagcactttgggaggctgaggtgggtggatcatggggtcaggagttcaagaccagcctgaacaacatggtgaaaccctatctctactagaaatacaaaaattagctggccatgctggcgtgcgcctgtaatcccagctattcgggaggctgaggcgggagaatcgcttgaacccgggggtcagaggtcgcaggagccgagattgcaccactgcactgcagtctgggcgacagagtgagactccatcccaaaaaattaaaaaataataaataataatataatgtatgtcccagccaccccatgccctgtctggcactactgccagcactggggaactgggaggagagctgaggaacagctccccttgtaggctcctttgtcttcattgattgacatatccaaggagtcctgttcccagcagtggttccaatatgagcaaaagcaaatctttgctcatcttcaaatagccttgtgtatttaagtaaccagaatgttccacatttctgaaatgactatctcacctatctagaatataagttattctaggcaggtggcacctgtgtcttattcctctatcctaaaacagaggagggattcagtaaatgattgctgaaggggtctacattagagccaaaggtggtctgagcaatccagcctgttttagggacctgggtgaaaagtcctggggagtcagaagctctgtgaaaacaagtagagggaaacagaaaagacaacaaaggggtgacaatgtttcctactttccatttgacaaagaacctgggtgtattgtagttaatatccctggggggttatcctgagagatgacatagaagcttgttgtttttggtataaacccgcaatgtcttcttatcttcattcccctttctcattcctccttagagttacctaagcacaatttcttttcttgttttgttttgttttgttttgtttttttgagacagggtctcactttgtcacccaggctggagggcagtggcgtgatctcagtttactgcagcctctacctcctgagctcaagcaatcctcctactcagcctcaagtagctgggactacaggtatataccaccatgcccagctaatttttgtgttttttgtagagacgggatttcaccatgttgcccaggctggtcttgaactcctaggctcaagcaatatgcccgcctcggcctcccaaagcgctgggattacaggcatgagccaccatgcctggcctctctttaaacactttttgcttacacactgcttttggaatgaaaagaacaaggagacttcagtcatatcctcctggatttgaatgctaaggagctgcgtaacatttctgaaatcttcccatgtttattaataagagaataattctacctaccttgtagggttaaaggttgagtacgatagcatggaagaatttgcccagcacctagtaggctgtcagcgcctgttacctttcctttccccaatgctccctaaagctaagttcattggcccatcatgtagagtaatgggtccacaggcggtgaattacttgtgatgctcttccaaggactgaatgaggagagacattttaatcaaagcaccagcaaagcttttgtagcgatgaacatacaattagtgaccttctcctatcagggataatcagcagtgggactggcagaattggaatttttttacatgggtgatctgggcacagatactcagtcagctctgtgtcgcttagaactgggaggcaggaggcatttgcaggttggtcacaaactgggtatcagacatattaagcctgcattcatctgacaggcctccagaacgtgatgtcaggagagacgtttagcagtggggagacaattatgagactctcagaggtgagaaagaggattctgctcactgcctagaaagagagaatatggcattggaaagggggtggtaaaatatgttgcctgacacacaccgaaaaggcctgtcagttactgaggtcccatcgccgtctcaggcttagactgcatgagaggatctatttaggggaaaaaatgtatagcttagccccagtggctgctggggtgaatctccagggctcaaagcacgagttacagtttgtctttagtttacttaataagcttcctggactgtctgatttctttacagcctggaacagagggtaacaagtctcccagtgcagtggatccaaagttggtgggcttcagtttgggagcaaagagctcactgtttgggactgggttgatgtcatcattttatgacagcatattaacacagagtaaatagtttattccccagggtactcacccattccctcagaggtgagtgtcaactccttcgagagaggtctgctcacctaacctgccaattctcaaagagccccacctcaggcattctcatagcctttctctggccttcgtaggtctttgtcccattccccgatgataatgccttcatgacaaagatgaaatgaaggttgggggcagcctaggctgtagtcctggtgctgcaccactagccgtagagccttggccaagtcatgcccctctctgattttttcattatgtcaactggaaaatatagtcagactgcctgccctgcttgcctaacagcacagtctgaagcatgagctgatggaatacatgtgtaagcatattgcatagtttgaggaagtattcatgtatacagtggtgatattagacttaagattttcattttttcatgaaattgaaactagaccatctgaagtcattgaaataggaaaaacacatacagtattttaaattagttctactcatgcagacaaaaaaaaagtgtcctggtacatcgttgtttaagatctggtgatctgtagtgtttgtctaccaagtggctaccgtaagtggcctccacttgataagttgtaacaagatcacagcaaccccaacatctctgccactttctctttctctcttctgttttgggtggagagacatctatattgtggctgtctcagagttacggggagagcaagtcaacggtaacagggaaaaacaagccttgtgtgggttggaccagaccatttgtaaggctcttggggcatttgtgtgcacgcacacacagacgttaaccagtccagaaatgagtgtcattctcctcacacagcgccgacagctgagttcttccctgatatttgcagacctctctgaagcttgactttgaaatcctcttttccttgaaccctacgtgtgagagagaagcccttctttgccactcaagagtggttctgtggtaacagtggctctgtggatcttttgtccctggctggctccttcatatgttattgtaaggttttagtttgtgctggcatgcaggtgtgtttttttctcactcagattttctcttagatgctgtaatacaatctataatttttggtacaggagcaagtttttacaaaggaagatatgtgcaatttgtcattttccagcctgatgacatataattaaaccttcaatagtctatgccttcaatagcataactacaacaacccatcacactttggaaataaatttgtttcatattttatattatctggactctctttgtccagtgtgtaacaggcccccaggaaacaggaagtcccccactagtgagcacccctaatgtgaatgactgcacactcagcctattttggtgagaacaggcagcttgctttcggtgggctcttttgaatgggccttgcccaagctcaatgctctctctctcctcttggcttgtggcacctggccacagtagcaggcattgcctgcttgaaaagaggctgtccttggattttcctgcctcttggaacacagagcttaattcagttccctaactccgggaagaagcaatgatcttcagccctatgaacctgtccggcaacccacagcggcccacaaaatatgttctctcgcctacaacctcatcccagctgctaccacagccctgccgacgcagcgcctgctgcggtcacggtccactcccaagggacactgccttatgtcagcaggccctgtcttgattcccaggtgctgggaagacatgattgcagcctcctgcacccctgctcccctcctctgacacacacactctgagcctgcaaggtacagcagcccactaaagctctagttaaaagtaccaagttgctggaatgcccagggaagtgagaatgagcgggtctcacacagggatgatttgaaacaagccttgtggctttttaataatgtgccaaagcggtctcagtggtgggccagcagggcccccagtctatcttctgtgaaaggagaaagcccagcaggccctgccgaatgcagacagcccctccactctgctggaggagacagactccgagatggcaatcaaggcttgatttgccaacacatttccaatgattaaaatgtaattagcacaactgagtgcctcctccccagctaattttaatacatgctgtgacaggcaggcagccggctgtgcctttagcccagcagcagatggaggcagaggcagcgggagaggaaaaccattttgcaatgtgactattcgcatcacaaaaccatcagggcgctcagctcttagaaggcccttgatggcagcacatcaaattggcgctgtcatagctgaccgtggcaatggcagtcatccttcatactgtcccagaagcacagcgaggcaatttccaggcgtaaccctttaagatctagaaggggagagagagacttggagagcacacttgtcgtcttgcagtgacaggcgagagctttgcaatgtgcgctgtgaaacccacgctcttggcagcttgcaaaccgttacttacatgttccttttccaaggcacagtggagtgtggttcagaagctttggaaatagctgtttctccaaatgggagacaggcgtgagctgccttctgtgtgcattatctgaactgggaaggatgagcttttcagcctgagatggtatggcaggttggaggtttcctcttctattccattcatcccatagaagcctttgagcctggggcctctcatcatgaccatctgcttttctcctatcctgaagggcatgtcagacaagctgcaaagtccagaagaccgtttgcctatgctcctgttctctcacctcctggcagaaacactgggccctcaccactgttgtttggcctgccctctccttccaaggcaccacctgaaaaggaggcaagctccttggaggctaaggatcatttggacctccctgggattggggtgcacaggataatcacagggggcacttgtgatctttgggatctgtcacccaggcttggtggctaactttctgtgtgtgtgtgtgtgtgtgtgtgtgtgtgtgtgtgtctgtgtgtgtagacggggtcttaccatgttgccccagctgatcttgaactccagggcttaagggatcctcccacctcggcctctcaaagtgctgggattacaggcatgagccactatgcatggcctggtggctgactgtcatagaacaccaaagctagacaagcctaaataataacagtgacgatgctaagcatgtattgggcatttaccatggctgagaactatgttaaatctcttaaatgcattaattttctcacttcatacccacacaaacctaggggctccatattattattcccattttacggatgaggaagcaaagtcacagtaaggtgcagccactttcccagcttctgctgttaagtggcagaacccaaatccaaatacgtatctttctaacttgtgagtgggacaaaaaagtcatagctgagacatgctgcaccacagagatgcttcaccagtggaagcctctgagcagagaaatccgatctgaaaacaatgggattattctttgccatctaatggcctctgaagatcagcagccatgggaacctccagaactccatcacacgggtgacgtttacatgccgttgtgcatgtgtatctttttctcctctaaccgaaaaataatatgtaatcgttaaagatcaaaaacgacagtaaatgtaaagatgaaaataaaagtgacccaaactctttatcactcagaaataaacagtgtttggtgcatttttttccagtgttttttttttctttctgtgtgtatgcttagcaattttaaagtaatattgtatatataactctatgtatcttgtttccttcattgtagtagtaataataaaagtagcagtttttaatgtattttctccttactgctaccttgagaggtagttactatcacccccgttttattgattaaaaaaagaaattgaacctgtgggagggtatgtgactcacccaaggtcacttcagttaggttggtgaaaagtaattccagtttttgccattacttttgcaccaacctaatatgattttttttaaacttccctatgactgtgatcacttttccatttcagcaaaattctttatgaactttaatttaatgagtgaacacaaccctggcaccttgacctgttccccaatttggtaacatttaggtttatgaagtctgtgtactaggttagtgcagagagttagaaacaccaggattcaaatgcctggatcttcctcttatagatttatgactcttgacaagttgcttcatgtctttaagactccttctttcactgtaaaattggaaaactaaaacctacacactgggggctggggggtggggggagtttgctgtaaggttaaaaacgtgaatatatgaagagtctatcttagcagatttcgtggcccttgctatgtgctgacagtagccatataaataatgtattattgggtcatttcctaattccataatgaaatttttaaacaaattattatagacatttttgttcctttttgagactagttgagctagacagtatggaaaatatgaaggctcttgatgcatgcttctcttcttctgatgcaaattgcaaaattattttccaaatagaaattgacattcctccagaagtatatgagtgtctgcctcacgacagccttgccaacactgcatatcagcatttacatgtttttttctaatttgattgatgaagagaaatatatctctttttaatctgcatttctttgattactagtgaggtggaacatttttttcgtatgtttattagccatttatatttcctcttccgtgaattgacctctttgcttttgaaaggaaggatgagtctccaagggctagctagagaaaagatgctccagtgataattatctcagagccctggggtgaggagttgcaggggagagaattaaaggtctcctggggctatgaggcggctactaagtgagcggctttctacaccagagcgaggctttctacacagtcagcttgaaatcagtatttgttctctacctttgtatttgttctgttaagaaatattttggattttttagtgggactcttcacattctactcaagccagcgcttataattctttcagggcagacaacgagcatgcctgttcagtttgggttttttgctctgaaagtcccattggtttacagtgaagttgctgtaggtcttgcttgagtcttttatgatccctgccatccagccaggagctgtgactgctctgtaaccttcttagatttaaatctgttgcttgtgttctcctcatagtgttacagagcagcagaggccatccatactgatgtcttaatatcattctctccttagatttatagggtaaaataaaccctctgccatagaagtgcttattgattactgaagtacataataaagcctaagaataaagtaagaccaagtaatcggttctgttcctgggggatgacaataaactctggccgaggcagcctctgaaggttgccttttgccttggagctaggaggctcctttttaattggttgtcaaaatagtaagcagtgactgatagaaatcagacaaaaagagtacatactgtatggttccatttatgtaaaatttttaaaaatacctactaatctgtagtgacagaaggcacatcagtgatacggtaagggacctgagagagggatagaagctttggggagggatggacaggttcactgtcttgatcgtggtgatggcttcacaggtgtgtacacatatatgaaaagctatcaaattgtgcatttcaaatacgtgccttttaccaatgtcagttatatctcaataaagccacaaaaaaatagtgaacagtatcccataaagagacaatccatggctcactctgtgctagaaaaattttctcttttcttagaaagctatattttgacaaacattcagggggaattgtgagactacatttcaccttcacctttagctaaataggggttttagaagactgaaagatgccaccggaaattaaaaaagaaaaaggcataagaaggtaggatagccctctttcttcattcctttttctttcctacatctgaaccttaaaggtgccttttaacataattttttagtaaaacaaaaaaaggtatttagaaaatattaattcttttctctcatcccccccaacccttctgctattacatttcccccacccagaaaagagattctacagtgcagagtaaaaactactccaaaatgttggcagtctaaaagtggacaggcattttcaacacaaagagatgtttgttttccttgcattttaactcttaatttttgacacagtagggaactccagcatggctgccatttaaaatgtaacaatgccatgcagctctgattgcctctgtcacaggggtgttgtgactgaaggccaggagacaaagcaaatgaggccagagacagtgcctgctgctgaagtgctggtccatttctccacccgcatttgaatttgtcttttctctggctaactgcttttctgccctgatgaggagtcactcggggagactgaagctggaatttgtacaacctctttcagtccccttgattttaatcagaaatacacaattattcttttcctccaaatagagaaactcaatccccattttaaattcaattattgtaattgcagcattcagaaaaatagcacattcattttctaataagagattgtggataccaaattactgcatatagtatgtcaaaacaggaaacttgagactggcaaaccagtgggtgtttttatcttggcaatttgtattttcttgcagacaatttatagtaatcctacccttccttgtttatgatatagaagactaggttttaaagccatcctaaaataaagactgtttttgttgggtacagtttaattgaaaatctgttatgagtatgaggaattctacaaagggcaaaagtgaaggcagatacccaataaagggaagaaaaaaaaggaatcactttaggatcctatgtgacggtagcctaagatgtctttggatcttcttgaaccattctcattatctcaagccatatttatattcctttagccaagtttctcactatcttgcatttgtaaaaaaacaaaaaaagaaatctggttggtgagaagttgataatgtggccattatgtcttagcaatatgagagcaccattgtccctcttcctgctcaattccagttgctctagttggcttgaagtgaatcaaatgtgaaaagaaatacagtttttttattttgagtttcctgattttcataaaagagtaaccttaagatgtgatttcttcaagtgcatgctgttattttcttaggatttactgtcacctcaaaattatatccatgtcagccaggcatagtggctcatgcctgtaatcccagcactttgggaggctgaggtgggtggatcacctgaggtcaggcgtttgagaccagcctggccaacctggtgaaaccctgtctgtactaaaaacacaaaacattagccaggcatggtggcgcatacctatagtcccacttatgggaagctgaggcaggtgaatcgcttgaacccaggaggcggaagttgcagtgagccaagatcgcgccactgtgctccagcctgggcaacagagtgagactctgtctcaagaaaaaaaaaattatacccatctttttcatagacacattcagacacctaccacactttcagatcttttagtgttcatgccgccaaccactgtctctctcttgatctcttcactcagacactctccatgctaccttccctcaggtattttgctactgtaatttattaattctttcacatatatgtattgagcaccttctaggtaccagcttcaagtggagcaagatatgagcaaactctgagatactgtcaaggaaactagccaacagtgttggaggtgctagaaaccaacagttaaggtacagccagtgaagtcagagccctggaaagcttccatatggaagaaggaacagtcatttccatgtgtcctgaaagggtggtggtctgttggatccttgagtgcctactaagtgccaggtactttagttatattctctcagcaaatccccatttttgcagttacctctgggaatttttatctctgtcaagattactctcctggttgattttggtaaatcagtccttaaatcaatcttgaatataaataatctgtgagtagggctatcaaaactatctcctaattctgactggtcagaatcgctagacaaagtttaaaatatgtagcttcctacttgtaccagtaatcacctagtgtttttaatatccattctatttatctgtgtatttatttttccaacttaactttgaacattttaataatgtcaaagcccatatgcactatgcatagcataacttacaaatttaaactccaaatcttgtacctatgcattttactttagtccctgtgtgcaggttactgactatttgaagaataagtccaagctacttccatcccaaaaaaaaatgttcatcaagaacctaaagaaacacttcaaaatttcagctctaaggtgtctttcctttttggttttttatcagtgaaataaaactattagttacctggaagattcttcttgttgctcacttcgttgagagggaatgatggtttctggttttgtttgtctgggtggttgtttctgttttcgtgtagcatagtattgagtctttaaacacgtcctgagcagaaatccttgcagaatgtgacttcccctctggcaataaaacggtacaaaaattcaacccaacatttaaataattagtaagttaccctgttgttgtgtgtgatataacatatctttcatggaaataactggaaaaatgaaactattggtatgtctttctggctgctttcacatacctgaactgatttaattctcacaaaaatccggtggggtgtgtatcatcgccattcactggttaagaaaggtagactccaagaattaagttcctttccaaacacagcatgattattaagtggagggggtcagaatttgaacctacgtcagcctcagactgaatgagcacttcctgtgagccagggactgtgctcagtccctcttaagggagagctgtcttctgtggagcagaaatacggctatatggctgcattcactgctgcttgtaggcgctgcaatctcttttcggtttcagcttgcctctgtactttgccaagcaatcaatcaggaaaatattttgaagtagtttctttgtatagcctgagagagagagtgagatggtacgttatactggctaagaacatgaactttgaaggacataactgggttcaagtgccatctctgtcactggaagccttacttaccttctcatctctaaaatggaagggtggtagtataatactttcttctagagctgttgtcaggattcttggtgttttttgtttgtttgtttgtttctttgtttgtttgttttggacagggtctctctctgtcacccaggctagagcacaatgacatgatcagagctaactgcagccttgaccttccgggctcaagcaatcctctcacatcagcctcccaggtagctgggaccacaggcatgcatgaccatacctgctaattttaaaattttttgcagggacaggggtctcgctatgttgcccaggctggtcttgaacttctgggctcaagagatcatcccgcctcagtcttccaaagttctgggattaaaggcatgaggcattgcacctggcctcaggattcttttttgatgaatgccagccaacagctggcatttctagaggaaaacatgctctgccgttgttcctgtggaggaaccctgcaagatgtgaaatgcacttcaacaaccaggcttttccaaaatagagagctcagggctgccctgccatcatggacaccccatctctcctttagcttgagatggacattgaccctttggctgggaattgaatcatgttggtgatacttagcatggaaagccgtagctacattcagtgtctcacaaccttagtggtggaaggaagaatggttgcagcagcttcattacctggggaaaaagaacttggaattccaagcactttaagaaagatgcttttactttgagtgttggagaaaatagagcaattacctattgaagacaaagtggatgaaaaaacacctctgttcatgctaccctgatcatgtaatctattcatattcattctgccttcctgaaggtgattcaagccagactggctgttcctgctggctgtgcctttccttccccaggatacacagggcacatggtgatcacctgagattcccagctaaactcagacattttctactccaagaggagattcctcaaagggctatagcacacaggcagcatcagataatgtggaatgagtggaaggagggagggaggaggaatccataaatcatcaaattgttgttgagcatctttgagggtcctcaagaatacactagaccctgtgatgattccagggacaaccagcctgcactttctgaggagttcactgcctgcctggggagcaagacttgtatatgttaaattagcaaagaatttatgcaagacgtatgtgaaatcagtgaagaattctattctatctagactagagccagggagatttccaacacctggctcatgtatgctttttaaaaaaagatattcagtcttactgaagatgaatagatggatggatggatggtttctaacatctattgattgcttcctatgtatcaggcagtgttctagacatttttatgtttattacatatgtacttatacaaattatatgtttattaactcaattaacgttcttagcaacactatgaggtacatactgtcaatagccccatttaatagatgaggaaactgaagcacagagaggttaagttccttgctagaggtttcacagatggtgtacagtacaggcaggctttgcacccaggcagtctggctccatagttatatatgaaggataacgatgtggtcttttcaagagctgttggcatcttggttcacactgaaagctaccaggctttgttatctgttcctctggctttggcttcctgagtcttaagcacccttctcttttctagaacatagaccagcttgaaccaaccctctgtgattccaccccgcctctcccctggctgcaccaggcctctcatttgtagtttctcttactgagcacatttctaaacgaggacggttgctccactttaaggacatacaaatggcttgccctcacctgtcaagcatgatccttgtattttaccaggcccattatgaacgcaatctttctgttgaaaatttgcatacctcctttcttgaaaagtaatgacagcaatttctttccctccgctcactttctgagtgtctcatttaacggcacctgtgaaaccgacaggcacagagatgagaagtgaaagagagcagttgattaaatcatcatcaagtcgggcctcagaaagtcaattctgcttgccgtctgcaatgatatccttttatcttaaagtaatgagctatggcacttttgcatcgggtaatgcgataagttctattagcatgttccatttgcctcacaagcaagggcaagtcattttagctagctcatatcactgcaatcaaagcaattggcttcccaggcagagaagaaagggaaaaggctcagggtgatttctatggatcacaacacagcggaaaaaatagactcttgtattattttaacccataacatacttttcctttttactcatcagcaaatttgggttttattagcttacacaggactccaaaaagaacccagcatcagttgaagcaaacctgggggtgggggctcagaccccacccaaagcaccaagaaactatatatgggaagggaaaatcgccccattacagaggggtcacaaatagaattctgccaaagcacacaggcaaagatgtcttcctgatagtaacactgtggtctcataataaactcttgcttcacaccatcttcaaagtcatttgtaataggtccccaggcaagtacggattaatgctattgatgacttagaatcagtaaatcaatgacagagaagcaaaggatctgttccttaagcttaaaagagatcatttacaaatcaccgggccccagactgtcagttttacctttggacaagatacttatttttctgagtttggcaaccactgaggtttgtggactctgggttttaagtaaatttcatctttggggtttatgtatatttatacttggcaaaatgtgacttcctttcttagaggaaaacaagctgaactccccaaagatttgtgaaatattcacttccaaccccacttccaataactcaacaatactttaatgatctgtggaaatttacaacatacagattgttttatgaaatacacttggatttcaaagtgacaaaaaggaaaaaaaatattagaatttaatttatgagctttaaaacttcaagtttggacaacctgatttctgtcaatatatttgcacttctaatgggtggtagaatgaacctagcacatagtagttacctgaacattgttggttgaatgagtgtgttattatctgagacactggagggggaataagaagtgttcccttagccccctcagatcacattggttatttgagctctggccagttcaaactgagaacttgcaaaaatgtcagattctgagaactccccattcagaaatgctaggttatcagtaccgaattccagaggcttctgagagttgattctcttgtatctcctgaacaattgaagattggtggacctcatattattttcaaatgggctcattagtgattaccaaaagctttattcttgtaaactgttgtttggaacatgaatattttaattaggctttcattttatctgagctattttatttgatcaggcgtagttactgttaagatagaggggaagagtcgacgacattatttcacagtcagtaagaatatggtctcagtaagaacattttcaggtttaaaaatttaaaaatttctagggccccagtagctttaaatttcacttagtccaaaaccaatatgagagcaatgtaaacagtgtgaaattagggctttgtggattgatgaaaaacagacaacatcagagctgccatatgtggcacaaaatggcggcccatttttacatgagcaaaggattgggcagctgggcaggggatggtgaacgtgtttttagtcaccatgctgctatcttacttctttaaataagaaaataagtgtcatgttttctgcaggtggcttcttctgaaattgcttttaggtgagggatgtctttaaggtcttagataaaccgcctgccccaaaggagaatcgatttgttttgtcactggcaaagttaaattatacttgatgttagatattgtagtttacaagttggggttctccctcattttcctctcatttcctttaggcagaaacaagaataaaataactttgttcagcagtggtattcagccctgacatctttggtggcaatgataaatggatttgagatacgaaataactgttccagcaaggtccattgagcagaatagagagcaatgccctcctcaatgtcattgtatgtgatatattcaatgattgccactctgtgcttaagaatgcattccatcacaaggtacctagaattccatcttgttgctacattctgaatgaaacagagagatgtcacagaccttgactgatttcaatttggaccagagtcttaaaacacagataccgagattcccaaatgaaaatgaaaaatatttgcttttgaataaatataataaagtcataatcacatcttttttctgagccttttaatggaagatattttcttctgggccccaactctaggctctgctaacgattttaacctccctcagtatgttcacacatacatctctttgcgttaagcagtcatattagtgtttcttgtactttctctttggaatcacctgccttttaaatcatactttgcttatgctgcatggaatcaaccacagtttgaacaatactcaagaagaatgagattgacttgtcagtataattgagcatctattgtgtcccaaggcctagagatacaaagataagcaaggcactgtccttacctacatggagctcattctctggttggaaagactgttgtggcaaacaacggcagtacagttttgtaagggatggagatagaagcaattaagtctttctggaaaagtattggaagattcaaaaaaggaactgtgttttgaaggtgaatgtcaggcttttaggtagaaacttggaggaatagaattcccagtagagggaattgttaagtgcagatggctggtggcatgactgagcgtgagtgggcgtggttgaagcaaggtatgttaggatagtgccacacaatgcgaggatgccaaccagggccggaccacaagctgtttgcaaccaacctgctgtgagattagtatggggagtcaagagtaagcattgggaaacttttagagtaactcagtagcataattttgtgtttcataaatctaataattttttaaatgtattatatatatttgtttttctttttcatttttcaagaatttgactttttattatattttacaaaagtaattgtcgtaacatattagaaattaaagaaagcaaaacaaaaacaaatggctcttcaccacagaaagcttaagaagcattgtgttgagagagtggttgggatttgggagttgagggggattagaaacagaatgtgaagggtcttcataggccttgtgaagcatctgcatcaaatagaaatttaggaaatccactcttgtcaataaggacttggattagaaaaggaagagagcatagaccttggaaagcagtcattatcctcttgtaatgacaaaataaaaccctgaactaacgcagtagccatggccacagggatggagagttagaaagcagaatcaataacgtggggtgagagaggaagataagtccgctcaaggatggggtcaaggataaggctcttcacttacgcagttgagtgattgcttggtgatgctattaccaagggcaacgtgggagaggggcagtttcaggtgagcaaagatgttgagtccagatttagatggatacttgagtctgagtgttcgctgcacttcaacagggggcacatacccaacggaagcttaataatacttaacatttatcatctgtacatacttggtaccatgcactaagttgtttacatgtattaactcattctcctcttctagccatattttacagagaaatatactaaggcccagagagtttaaataacttttccaaagttacacagctggcaaatgtgggcatagagatttttgagtttcagcatatacatggtagaaaggaccaagggaatctttaaggtctcccttgaaagtcacatagaaacaatagaactccagatgcaactctggggagacagtgacattaaagaatatgcagaaaaggaagggccttgaaaagacagtcgcagacagcaatattggtgaatgggtgcaaagggaaaaattctaaaggatgtgcaattgaaacaatctaaataaccagcactggggaattttttaattagattatgttacaatccacatagcagattgcagtgtcgcctttttttttttttttttttttttttgagacggagtctcgctctgtcgcccaggctggagtgcagtggcgggatctcggctcactgcaagctccgcctcccgggttcgcgccattctcctgcctcagcctcccaagtagctgggactacaggcgcccgccagcacgcccagctaattttttttgtatttttagtagagacggggtttcaccgttttagccgggatggtctcgatctcctgacctcgtgatccgcccgcctcggcctcccaaagtgctggtattacaggcgtgagccaccgcgcccggccgtgtcgccattttttaaagtgatgttacaggataaattttactgattaaactgaaatatttgacgtgttatgtgaaaatcaaagcaggttccaaaatggtaggaattcatttttatttcttaaaatgtatgtttaaaagacgagtgggattatatccttaagactggaaagacttacaaaaatgtattaacagtgtttacctaaggattgtagatttatgggtaatttttaaaatgtatccagtaaatatgttttttttgtttgtttgtttgtttttgagacgaagtctcgctctgttgcccagggtggagtgatctcagctcactacaacctccgtctccctggctcaagcgattctcctgactcagcctcctgagtatctgggattacaggcgcgtgccaccacgcccggctaatttttgcatttttagtagagatggcgtttcaccatgttggtcaggctggtctcaaactcctgacctcatgatccacccgccttcagcctcccaaagtgctgggattacaggcgtgagccccgtcacccggccgtaaatttgtattttcaaaaggagaaagattgggtgggttggtttgttgtttaaggggtaagacttgtctgggaaaggaagactgtgcctccagcagttcacttttaattcatgaaaccaggggaagagacggtgaagatggaagttgagtggtttcagtattgagatggctggaaggactcaggtttaggaactagtccctttctaactgtgcatttgaggcctttggccaggcgtgcacacgtcctctttctctccttttgtgtgtgatggtttgggtcatgtctttgtctgaaggccgggtgaccatgaattcttatctgtgattgctgtaaggcctagttgtttctttttgtctcttttcatttcttgcttttaaaatggaggatatatttttagcttttcacagcgggctctgaaatcttgtcatggagagtacttcgtcacctcaagctggtagttagtgtgcaacctgtttgctaataaaccaaagcaggaccccgatgtcaaaatgcttaaaatggtcaaatccgctgggacgccgtctctgcatctgacatgccttttccatttcccagcctcatgcagaacataaacctgcatcaggaggtggctcaatgtgaactcttataaattggagtgggtatctagggattgaggagcagacacttcttcttttaacctttgaagaccaagaatcacttggccaaaaaaatccacagtgtattgaacttagggtgtgaaagctatacagtgtattaaatgtgaatttgagaccatgaattctacccacactgactctataaaacagcctccctttttcataaagcaggcccataaaccgctgccagtgaagcagaaagactccttaggactgtggctcgctttccgtctggggttgtcaacaaaccccctttatgagtggaatagacctcttgtatgtgtcgagcttctggctttttacagagtgtgttaggagccaggcaaggcaaacgttaggcgctgtttgctgagtgcatttattggctttgcataatttatgagctggaggggttgaccatcattcgtctctgccaggggctggcactcgaggctccagagagtggagctgtaaattggatggtgcgctcctgctgagctcacggcaaagtcctcaggtcagtatgggaatttaataccagaaatggaactgttttctcagcacaccatgtggaccccagtgcagcagagactgttttggcagactccacgactggccttgtcgaggagctgtcactcacccggcatgttgtgtggggagcctgagcatttttaatcggcttggcatccgtgctgcttccataatggataccagtaggtctcagttcttcaccatatgcttaactctggagacaaggtgcttctgggtatatcagtaattacttgatgcagaattaagtggaccttgaaattagaactggactgttggaaagcaggaagcttaacactttgatagaaataaccattcccagggacatactgccgttaggatagggggcacagtggtggttctttcccagctaccccactcctcgtcctccctgcacaccagatccttggggaggtgggcaaatgcgatgccacagccttcagctgtcattgattacctcacaaggagcgctgtgaacatctgggaacatgagcctgcctggcaaaatagtcttctgccttccacacccctcttgaattgagcgttgtcactcttgaaaatgtgcccagatcttaggaacctcacagagggcttaattaaaggcaatggagagatcacacaatcaggacagtattgttcctcatccacctgcggttctaggccttcaaagtcttcatctcatccaatttctttctcaactcatttgacttattacaataaagaaaccactcatcaggtcaaagaatgtaaatgtagacaatctgaggttggaagctgggttggaaatgatgcaccgtacttggttaaatcgctgtcactgaatatctgactaccctgtggcactgaggagccaatgggagaagtagaaaatgttctaatcctccagtctataagactgtgatataagttcctaaatgcttttactacggagtgcttagtctgaaaagaataagtagtccccaggttgtctcataatagcaagaagtccatttagatgggtgttctgttacttcccattaaaagctctctaataggagcttaaacaataaggtaacttagtgttttctgaataaaagtcctgaggcaggctgccctgagatgggttcagtggtccaattctgtcaggcattttttcccttggtcccactctgttgtttttgtactgagtctttttgcctcatttttgcaagatggctgctacgtatctggacatcacgttcttatacactcatgttcaaaggccaaaggcaggtggttccttcttttctttgtttactggggagacaaaattgtttctagagccctcagcagatttcagaatctcattggccaaagatgggccttcaaataagcgattacaatgcccagaggtttacctcttttcccatctttagcctcaagaaaaattgagaaagaaaatacctggcatttttaacctcaaagtgtcaggagaaggtacagactagggagaagggagttgtgaatggctgtggggatctagccagcagtggctgccctacaagcaaatttatttcctgtttctgttcaaagctataccaactcccatgtccaggtggccacactaaaaaaccttggcatcatcctagacacatccctgttacttgcttcccatatccatgtgttatcaaatcctgttggttctaccttcagaattgctgtgccatctgcttctgccttcctaaaccatggcaccaccttgggttagacagtggaatggctgccaaaccactctccctgtgacctgatttttccccactgtgcactctctccacgttcccacagaaagtcatcctcatggaagcagctctgatcatgccacacccctgctagtgtttgtatcccagcttcatgtcttactgctaaacggaaggctcctttagagccaggcctgtatctcaggtgaatttcagtctagtttagcagttccttatcaagggctgttgactgaatgaatagatatatttacctgctgagctttactctaacaaaacacatcccccagtttttcattgaatattgaattaacaaaacacttcattttttttaagttgtgttcttttttcccttgcttatcatgaggatcccaaagactggggttaattattaattatcactctctgcttatcccaaaccaaactcagtggttggaatttgggatctgtttgatatggtctgagtctatggccctaaagcatacttttttgcccatattttttatttactaccctgacctcttgtctttggcatactttttatagggaatgttccttctattctctgggcctctaaaccggaaaaggcagccatcacaagtggtgagccttggccattatgttctgtttccttcaaagttcaaatgagtgactacaacgcccagaggtttacctcttttcctgtagaaaagcaccggtagagatacagccattcacattagctgaagatagaatgtcttcgttaagaaattgattttgctctgaatttcattgaacaatcttgattcaccttaatcctgtggctgactcctagaggggcatcgcctctaccctgccatggtgggagggaagcgctcacttgtgtgattgagcaccttgctggactgacctgaggaagagccacagagtacaggcatcagatgaaatcaacaaaataacttttttgcatctggatagcattttgtttcagatgctgtttactagcacttgaactggagaaactctttctttccaggaagacagcattttttatttcctttacttatcttgcactttttttgtatgggggttgggggaggaggcatcaaaagcaaaaacatactcagttcttgcactaacccttattctcttgtcttcattttcagtgtgacagtgacagtgaccaggaagagaaggtaagaccccccctcccccattgtgggcacagcacataacacactgaacaccagagtcctcccacacacagctgcagggtaggatgccagcttcatgttgacaggaccttttctctttaggaaagatgggcattattcacacagtgacatttcctatgctatgacacgtttaatttgtcagatctacctttttttcatttaaacaagacctttaatattgcatatatgtgacactgagtttttactttatggaagatgactcatagactcaaaaacattttaaaagacaaaattatttattttaataaccatctgatttttaaaaatccatgatgagaacgttaaacttgctagtttgtgtttataatgtcatttctgcatttattttactgacccatatgcttttctgtacctattggccttcttgatagaaatgttaatggtctgtgtctaggaatctcatcatggggtacgggtgggcaagggaggtcagatgggaactgccctcttcccatccgggcggaccgccaggtaggaggacagttcttccagcaggtacatgctctgtttcgaggctcatgggcaccagcctctgtgtatccagatcaacatggatcaagaaaaggaactcagtttctgaggttccagaagattggatcacaactcggtaaagtgagctttctgctgcctgaagcaaagggattatttgtctgtttggtctttctttctagccgttccaatccccaaccaaagttccttccatttttactgctgctttatgttattttgaaaagagttacctgaatatcacggtttctgtattgcttggtatcaaaaggatggactcggcctcccttcccccgtttctggatctgtcctgtgccctgtgctttgactttcacctcctacatgcttgcggattttattcagaatgctgcagttagtatttagtgggatctttccaacaaacccagaatttttctctccttctctgctgccagcctccaagagagatctaaaggctcttgttctgtactgtcgttaatttgaattcagcatatgtagcctgttataaaatgcgagacatcatcatttgagcaggtcaagcatattcagatgaagacaaatggtgcttatttgatttccttaaaatcaggaaatgaaaaaaatgctctctggagaaatcatgttctgcctgacttggatgatagaccaatgcatgtcccccagataagaacaggctctcgccttgaggtttttatctctgaaggacggccaggactgtcagcttgctgacatgtgcattatccatgtcattttaaacaaagtgacctatggaagggtacgctgtgctgtgacatggtaatgggctgttggatgacagtgaaagtacacactggaaagggggctgtggattattcttttgtttaactgacaagtaggagctgcctttctccagcccccaggagccttagctccttggaagtaggactcctggtgtctcaggcagccagtgtgtagtgggtgccagggacatgtgcacagcagtaatggttagtgttcaagacacggtcattggcccccaaacccccgaggccacattcccacatggtgggcatcactggtacccagggagggactggtaccttctggccattccagatctatcagcaatggttgatctcactttctaagtctgtgccacttttccaaaaggataaatcttattcagggtcgtacaaccaagctgacattctttccttaaaaggaaatgtggggccaggcgcagtggctcacgcttgtgatcccagcactttgggaggccgaggtgggtggatcacgaggtcaggagattgagaccatcctggctaacactgtgaaaccccgtctcaactaaaaatacaaaaaattagctgggcattgtggcgggcgcctgtagttccagctactcgggaggctgaggcaggagaatagcttgaacctgggaggcggaggttgcagtgagcagagatcgcaccactgtactccagcctgggtgacagagtgagattccatcaaaaaaaaaaaaaaaaaaaaggaaatgtgaattccaaaaccatcaccagtcttcagcagtggtagaaggtggtaaggatgcccggttttgtgttccttgtaaatgtcttcaccagtggcctcaaccttgacacccaaatcacctagggagctgctacaagttccagtgcctgggcctcatcccaggtcaatgaccttggagcctttggggctgtcttgaaccatgggtcttgatgatcacctaactctggtaatttctaggagtaatctgcctctggttgtcagagggatctgggggccaatactgagagcaccccaccaggtcctttcccatcacctgaattcctgagtagttattgcctgggtttccatctctaagtgcaagaagtaaagtgtcggaataatgggtattgggaaggtagctcccacctaccactctgagcttgagtagatttcagggtaataaagcggatacatagttgtttataggcgagtccaagagtggcaatggcaagaagggaaggggtattaggagtgttcctcagattcatggcgcacctcctgccctgcacccccagccattcttcctttctactgtggtgatcctgcaggtcttaagtgggagccacaccataaccagtgttgacatcatctgcctctgttctgccccatgccatttctccagggggctcccaacaggagccattgagactctaattgccctcgcacctgcttggccctgttgcagttaagactgttaggcttccccttttggactgagattgtctggtgtttatcgccaactttaacaccatcctccaagacttctgctctgtcggagcctgggtccctgtcagcctcctctgtgaagaaacctcttgcctgtgcccccctcgaagccccagagctaaccagggctgctttcatgtgttgcttggaggattcgcattcgaatctgaattgctaatggtggaaaagatgccactcagtgtcctgggataccttcagcaagccccaccagggatgctgttggaggcaaaagtgaaacttgtcagggacccactgggatttctctctggaagacctgccattctcttactccatagggatctgcagaaccggcaggctaaaattagggtactgtgtttcacacagctgactgaattaagataaactctgctttcctctgatatgaagctgtaatttataaaatgatacccttactaattaacgtggaagtgactccgaaaggggctaaaaaagcagagctttccctaaatgcaggagacacacttgtgcacaaaaaggctttgatgagacactgagcaaagtatctcccttatcctcccctcccagccacgtgaatacattgcacattaatgtcagataaccacaaggacgttcatgaagagtagaaattgggctgggtgcggtggctgatgcctgtaatcccaacactttgggaggccaaggcggggagatgacaagatcaggagttggagaccagcctgaccaacatagtgaaaccccgtctctactaaaaatacaaaaaattagccgggcgtggtagcacgtgcctgtagtcgcagctactcgggaggctgaggcaggggaattgcttgaacccgggaggcggaagttgcagtgagccgagatcgcaccattgcactccagcctgggcgacagggcgagactccatctcaaaaaaaaaaaaaaaaaaaaaaagatagaaattgggtggggaattacagaaggctgtgaacactgcatcttagatgtgggattgttcttcactgtagtgagagctaagaaaagaggcagcacttggcacccttaatcacccaaattaagcaattattctgatcccccattcgaaatgaattggtatcatgagaacaaagaggcaacatgcaattgccaaatatttggcctatattttattgtttcctttctttctccagtactggcagcagcccatgatgctaagaaatatcccgtttggttatgaagttaatgtggagattaaaagtcattccctgttctacccacaccctttttcttgtgtatagcatgtgactgagctgattggaaggcatatagcccagtggccaagcacttgggcctcagtgtgatggctgacacatgtttctgactctgtccatttctattttgttgtggacaagccttggctttctcagctgtcaaatgggggtgacaacagctctacatatagtcctgtagcaattaaatgaaagcatttagggccaggcatggtggcttatggcggtaatcccagcacttagggaggccaaggcaggacaaagtgggctcttgtctttgagccctagagtttgagaccagcctgggcaacatagtgaggccctgtctctaaaaaaaaaaaaaaaaaaaaaaatcttaaaacttaaccaggcatggtggcatgtgcctatagtcccagctagtcaggaggctgaggcaggatgattgcttgagcctaggagtttcaagactgcagtgagctaagatcatgccactacactgcactccagcctgagtgacagagtgagaccctgtctctaaaaaaataaaaatatatgaaggcatctggctcagtgcctggtccatagtaactgctcaataaatgttagcttttgttcattttacttgagataaaatgagagaggacgcttgaaaaaagaggaagactagcatcctctttggaaagctggggttcttctagagaacctgctagagggtttccccagaatctgaggctcagcctttatcccaagggcccttctcctggacacaggctgaatggaagtgttaaattttgaagggttctgaaacagtgtctttttaaaccccttatccaaacatcaggccttcctctgagcagaacctggagccaagagcacgtgtactgtcctggagggatcaaatggtgattaagtgaattgtatagctcttgtcccttcagcaactgttcccaaatgccaaacactgtcggttcccagaaacccatcacaggagagatgttctggggtagggccagagcatctgtattttttaaaaagcttcctaggtaattttggtacacaactggttttgagaactactgccttatagtaaatgtcaaagggaaacatgatttttccccgtgtttaatgctcttgaaattttgactgcttaggagaaaaacttgaaagttgtggagatgttgcctgtgtgtgcagacatgtgccacccatgcttatgtctgtagataccgggcataagtatacatgcagtacacacatacacaatctcacagaaatgaatccttctccttttcctatcaatcttttaacatgactcctgattgcagttttttctctctgtgctgttagcagtaggaacaaccacctggagaaggtgtttgtgctcctgggctttgctttggtactgtgtcctgtacccaggacagcctactggcacaatggctaactgcaaatgcagtactaccgatttttcacacctgctttccctctttccacacactttttggtgcattcccttttttgtttagagacagggtctcgctctgttgcccaggctggagtacaatggcataatcttagctcactacagcctcgaactcctggactcaagcagtcctcccacctcagcctcccaagtagctgggactacaggtgtgtaccaccatactcagataacttaaattttattctgtagagatggagtctcactatgttgcccacactggtctcaaactcttggcctcaagtgatcctcctgccttggcctcccaaagcactgatattacaggcatgagcaaccatgcctggtgttcatttttaaattcatgctaaaagttgttgtgtttgatcattttatgttcacttgtgtgggaaggggcttctaagaaaaggagcaaagaaaaccagcaaagtcttatgttcctaactcaacacaaaccacatgcctaacttggctcgtgcaggagtcagaaactgctgagatgtcaaactgaagactgggcatgtggtttgtgcttacagtggaagagtcccatcccttggttggccatgtttcacactcggtaaggtttgtgcaccctcagcaacattccagaagctcagaaggccctcattgttgcttgtggaacccccagccttagttttcaaataggatatattttggtcaggagacagtttggaggtactgtcctattttgtagctagaaaggaatatctccacctttccagatttcatagcagcaaagcagacagccatcacccagggaaagagaatggatccatgttcttgtctttatatccctaatactttgcacagtgcttgatatgaattaggtgctcagtgttttgcaaaatttgcattttctttcctggatactcatctccaaacggaggggataagtgaaccaagttcagaagactcatactcaaacctgattgcacctcatacagtcgcaatgtctacttcctggacccccaaaatgtgtgatctcttcctcaggcttctatatttcatctacagttttctcatacaatatatctaagccatttataagtttcctaacttataaatagacaatttcttatggttcttggctgagtctcaggagatttttaatttatttttgttttttgaaatggagtctcgctctgtcacccaggcagaagtgcagtggcgcagtctcggttcactgaaccctcccactccttgattcaagtgattctcctgcctcagcctcccgagtagctgggattacaggcacccaccatgcctggctaatttttgtatttttagtagagacagggtttcaccatgttggccaggctgatcttgaactcctgacctcaggtgaccggcccatattggcctcccaaagtgttgggatgacagtcatgagccaccgcacctggcctaagagctttttattttggatgcgtgatttccgtgatgcccatctactcaacctcttcttaccccttcaggattttgtctgggttaaaatgacattttattgttcttccaaaatcatcatatttccaattggcttaattacattgcatacatcccaaatacacattgatactatccttggattaaatttctatggtaaattattttaaattcagaatctcattatctttttcatatgataacattttcaggcaaaaccaaaaattacttcacttatactgaacatgtatgtacaataatctgttcattactaccatgtcatgcacctgaaaaagaagttataaatgtacagattttcaattaaatataggtaagtcaacagaataaatacttgttattggaaatatgtcaggcattttcagctaaggttttgtttcttgaaataaacagtgagaagaaagaacaggttctagatgttctattgctcgcaataggtgggtggtggagaagggcactcagaagacccaattcctgatttctcactcaccagctgtatggccttgggcaagttacctaatggtgcctagcattagttttgtcatctggaaaatgaggcagtattcaatgatccaacattgactatccagattttccaaatagctatttacctaggccccaacagcatggcagaacccagagggaaattaatatgtgattgtatcttccctttgccaatgtggaaagaggattatataagaattgtctccattctttcgtctctctcagtcttccaagagagaataaacatataggggacatactcgggtatatgtgtgtgtactctcaagcaactgaaggaaacttacatacagacctgatgtctaaacagggtccttatctgtttgttggttcagtctttcagtcatacatatccactcattttttcacaagtgtctactgatgaactgacatgagaattatagttgcttaactctgatggaactgtcaccatgtacctgtgagtaagtagcagagcagttcatttaatctgtgttcctcaactactgtaagtatttaggaaagcatggggactaggtggagagctagcttacggaatgtgtttcaagaactcacttgtttggtaatgaccattacttgatctataaaaggaattgttccagaaacatcaaggttgagtgcatgattctgtgttcccacagaaaagttcctgctgcttccccttgggtgaatgagccatcgccttgggtgtcatggcttacctgaagggaaagttgtaaagccaaggaggaggctgggggaggtgatggctatcagccccatgaaattgaccatgagccctgagccacctgaataccaggagggtcatgagcagaggcatttgtacaggtgatgtcttgaacaacatgcttcatgttagtggcctctgatagagtgtaacctgggaggctctttggttgtcagagaatttgtcttatactgtattagggttgcagagtgttctgtcttcaatgaagatagaactttttggtcatgtacgtgtgtgtgtgtgtgtgtgtgtgtgtgtgtgagagagagagagagagagaaagagttaatcccccttgacaactcctggatggcaagatagttacagataaatgctcctcagaactgtgccattctagtgtgacaaatataatcaaatatctatattaggatgtgttaataattatctaaactttatactttaagaagtccccagattcaacaaatgaatggacttctgttttcttttttaattaaagttacagctgggaaggtcaaattggttctcttttatacaggttagagattttccctatcagtttccatgaggagcatgttgagaagttctagctgtagacctgcatgacctcttcaggtacccgaagaataacccaaagaaagctggaagcagctttctcccttgttgttctaaaccaggcttgactcatatacttacggagacagccgaatggggtctttgaaataaggaaagaccagtaagccctgtggtgggtggttgtagtactcaaggagcccagtttgggcttcatcttttctttctagtgctcttagtggtttttgaagttcctaatttcctggtctaaaaatatagatgctactaatgtcttcggtcagtgaaaaactaagattagggtcaataatagcaactaaatagtaataataagcaccacttcacatgaaagagaacattgcattattcaaaacacttttaaaaacatcattttataagatctgtttaagtatttattgtagggatctatatattctcacatacaccatcgttgaccatgtgccaaactctctgttagggcttttcaaggctttatcttctcaagcaggtgtcattgttttacaaataagaaaaatgaggcataagtgatggagctgagatataagttgtgtcttaggattccagaatctgggccctcttcccatgccgtgctgcttccccgtacgtcagtgtgagttgggataagcctagcagtgccattcaggagctcatgctgtcatcccctctgtgtctcacctacttgtgctgcaagagacctggatcctgtttatctatccaccctcacccccacccaaacaattgcactaactcctaaaaattcaaacatggcggtttctcaagaaacatggaacgaataaaatttgggtctactaacaacttagattgtacaggctcttctgaagtgggacttttttcttattttagcctggaatgcagttatccaaggtgagaagggaagggctatatacaaggtatatattttaactcttacagatgggtagcaaagtcagcccatgattaattagggatgtaggctacaccagtcggtggacttagcatgaaccatatttggacacagaactcagtcttcctttaagtgtctgtatatgtgtaaacatttaatattttattaaatcatagactccctgaaagcatcccatgcctagcatgtacttgacacatacggccctgtaaatattagtgttatacccagaagttgctttattggttatccaagtctcataaaggagaagggccttgcctctgtcactcagaaagcacaggaagagcagggctggagcagaggaatttcttctgagcttccagtccagagcctcatgaaccccatatggtccctgcagaccattttcttcctacgaccccacacaggagaaggggccatggttccatggtggctcctgcactgcaccctctaaggtagttttgttctgagttataattcgccccctcaagaaccctcttgtccatccccagacactgattctcaccctgacagaggtctgggtccatcagggccacagggccttttcttttttaacagcaaatgctgcgtgggctgttcctgcagcccaaatgatagtaaatacctgaagcagccatgtccatgttaaagattatgtatttgccactaaggggagaatatagtgtttatcggccggagtgcgtgccggctgagctgattacggcacaacactctgtcagccaatgatttgtcctgtcctttatcatctgtgtcactcagcagtgtgctggcgaagggaacggatcacccccttccctttttttgtacccattttgtgtagaaaatttgtatttactttgggagtgtaatttgttcctcatggataatgtgaccctgagcggagctggatcatgggttagttgaagtgatattttccgctaatggtagtcgtacatcattgctgtcagctcgggttaggaggcaagcacattacagctccattttacctctgcaggcatctgggattatttgccataaccgagtatgacatgaccgcactacagagtgcattaaaattttactggcttctcaggcaagttccccagctccagtgtgtgcttcaggcaggcggtctgatggggagtccaagggccctgacttcctgctcagaggtgctgcgggcagtggcctaagcaggggctactctctccttgccctgagaaagaagcagggaaagactctgtggggagccacccaggggatgtttatgtctctatacgtcccggactggcaagtgactagctgccttgtgtacataaccaggtgccgcccacagtggctgctgccatctgctctctctccttgatgacttcagcccccagggtggattaggcaaaaactccttctctaaggagagcccagggtaagtgcaagtctctgccaagccttgggctgatttgtattgttcttgtctgcctacgttcagactgaagaaaggaggcgtaagtcctcattatggcagaacccacgtccagccatgtagctggactgagcctgatagagtctcatcaacccagttagaaatgtttgccaaggtgttttacacattatcttatacagtcctcacaccaacccaatggagtgtaggcgtgattacctccattctacttataaggaaactgaggttcaaaggttctgtaacttacattatacagctaatggtagcagaaatagccttctgacttcaaattctatatggtttctagtgttcagtgctacagagagataaagaagtaactattgtttaaatagtgcttagatgtgctatacatatgttgacttgtttagtcttcagtacaatcctaataggtaggtgctaatattatcccccatttacagaggtgggaactgaatcacagaggtattaccgaacatgcccagtcttgctcctggttaatggcagaggcaggtttcaaacccaggtcagtgtggcagtgctcttagccgctaagctggactctcccacatgccacattccaataagcctgagagctgataggaaaagaccagtgaaaactgtaatacgttggaatacaaggaaatgttcaaagagtattttatcactttctgttgtaactctaacatccaacaaaatatcactcaaagaagatgttttgtgatgagctttaattaattaataagtcccatttgcagttagcacattacttgcatgcaaatgatgcttctaaggtgcttgaaaggtatttattttgataggttaagactaagcagtcactctggcaaatgctttattcttttatattcttattggaaaggctgtaataaacttatgttgaatcatgttctttaaaaggacaatttaaggttgtctcccagtaattagtgggatatggatgagggcccataggctgccatatagaataaaatgactgcagattccatattggtggattccgaatgctggacacttgaatgtactctcgtgcctacagtgtggacatgactttttgttctgacacggaaatacccctttttacctctctagccgcctcatcgctttctattccaagcttgaaatgttacccctcctggacagaatggacaagccattcttaccatcacctgtgtacatgatagggttgtaattcatgaatttattcaataagccagacataaagtgagttgtaccttcagggcagttttttaaatgctgcaacagaagagccatagataagcatggcttttctcactgagaaatttaaaattaagttagcacactaagaattgtcctccctgcccccgctcccctccttgggctcacaagcacacacattgatcttccctgctagattaccataggtccaggggattgaccttagtttctcctctagccttagatccaatcactcaagtagtaaagaataagaacaaaagtattgatccagtcatggaacagtaattatttctctcagatggtcgtttagaatgcagcaataattttaaataatgtattcctcagagacagcatgacaacatatgtggattatttagttggtgcgtttaagtaagttacacttgcaccctcacccctttactggacgtccaatgctgtgcaaggaggcctactttaagaagagtagacattgagaaaaatcagagtttacccaacaaatcaattaccaagcaattgttcattataaaggggcttatccattttctgtagctggacaaaataatggacctccacatgctcacatgcttacagtgcaactccacccttccgtatgaagagacttcatgaagtcattggatccttttgaaactcttaagttgtaacagctttgactgtgtttatgttaatagagttaccttttaaagactctttttgtttcaaataacatacattaaactaacaaataatgaaatgtttaggcttttggaatttaaatgtgttaaaataaccaaaccatcagaagggcagagccaggcaactggatatcagaaacagtgagcagagggctaaatgccctccttgctttgtctctacttatttttgcccgtccacttgaatcttgataatttcggagacttcgtttctccttttggtagaaatcatgacccatccacttttcagttttagctacaggcagagagactgtctctccttttccactgccattgctaagatccaagggagagattctgactggctgagattagctcaggaaaggattgtgggttggtgtaacttaagccaggtgcttacacctggattggtcagttatgggtagagagacgggaccatgttgtccaaatgtgcttctctagaggtgcctctgtacatggtgctggagtcagtagagaacccagaaagttaggagttgggcctgcagcagtgggttctaggaagcaaaacctaatcttcctgccatttggatgaggcactacttacaggcataaattcttgacagccatagaagctgcctgggtcatccaaagttgacactttatagtgatcacaaaatctcaaatatggatacgtatttacaattatgtataataattgcctaaatattcatagagtcattttaagtgctattcacagattagttctatcttgcttaagctattaaaagccatagaaatacacaggattttgtagagtgagagttcatgtgtacatgcacttagaaaagtccagaatttattaatattttaagtacacctatagtagctaatgaattactcccctgccccacccaagtataagacagccaccttgagagacacaaagatctcaaggaatgtcaattagtaaattacatatctagggtacaaaatgaaacttctttgtccaaagggattgtggtcaacctggagaatccaatttgcatgccatgcagtactacttaaacttcagcaggcagccttcctgaagtgatgttcctaagactagaaaatagtaactcactcatagcttctttcactcatgtttcattcaacaaatttaatcctcacttgtatgctaagccaagcactgtcatgggaactagggatgggaagaagacaaagacatagaaaaccttcagggaaatatggcctaattgaagggaaagctgaggtacctagatgaattacaagaccccgtagcgtatgctgtttctgaggaatggcatgatgtctgaatgcaaaaaactgagccatactctgtaagggaggaagcaattgagttagatcttgctgcagcacatggaatagatgttactaggtagcaagaatggggtagatcacaggcaaaggggatatcatttgcaaataacagagttaggaaaggcttagcatgtggagagaagcatgaaaacttctgtttgtttggtcagggtccatggcagtgttggggggaagatgagactgtaaacatatgttggtatacacagttccataaaaacaggccttgcacggcaagatgagagtttggacttgatccagatggaagccactgggtaccttatgtaggtgaatgacacatcagaattgacattttggaggaggattcaggcagtggcatgaaggatggagtgaaagggggtgaaagttgtcataatgggggatttgagaggtgatagagatctcaaccaaactaatgtggaaagaaggagtctgattttagaggcatttctgaagtgatgattttgtgaccactgggaaggggggtcaagggaggaatcgtggatgactcaggtttcaagtcaggctgactgggtcagtattgatgatgccatcaatcacacagcgaaagtggggggatggagaaaataggagctcagggaggggctttcaggaccttcagctggatgaggtcagaagagagtacatattgatgatgcaggagtgatcccaattttagttcagtgtctgggagacaaaactaccttagtagcagagatggagctataggggaatgagtgggaggccagccagaacactgggattttgtctgtgtctacaggaataaatatacgtggtgatgataaccattaaaaacaaaataaatactggggactagtagagagggaaggtagggaggaaggcaagagttgaataactattgggtaccatgctcactacctgggtaatgggatcattagaagcccaaacctcagtatcactcaatatacccatgtaacaaacatacacatgtacccccgaatctaaaataaaaattgaaattattttttaaactacaaaataactgtatattaatcgtagcacttgatatttgtatagcttttttttttactgtacatatctttattttttcatttgtggcaaaatacacataacataaaatttaccatcctaaccatttttaaatgtacatttcagtagtaatggtaagcacactcacatggttgtgcaacctatgtagtttttttatgccacatgtgttaaagtaccatatatagttcatttaaacctcataagaaacaccctggatgaaaggatgttaaatatttattttagaaatgaggaactttgaaacgggatgaactgaaacaaagtcgtaatgctttggtgataatatccccatgccttctagggtcagtattggggttataccacagtatccttagtgatgatattttaacatctaacttccagtggaccaaacagtaactcacttatagcctgagatcctattgctttccttaaggaaactggaatggaatcagccccacagcatgaactgggccacccagcagcagccaggtcgccgctctgagaggtctggttctgaggggctctgtgggagtaagacagcatgaggccatatagctttggatataggaaacgcctagaaaggtagagagatatgataccacacttccagctctagcaacatagtgctgtgtgactgcggccttgggcagtttactaatgcttctaagcttctgcttttgtgtttttttgtttttgttgttgttgttgtttttccttttaaaaatctagatataaaatacctagaattatatggcccataatagtaactactcaggtcaggcactgtgactcacacctgtaatcccagcactttgggaggccaaggtgtagaccaacctgagtaacatggtgaaaccccatctctacaaaaaaaataaaaattagtcagatgtggtggcaagtgcctgtagtcccagctaattgggaggctgagggaggaggattgcgtgagcccgggaggcggaggttgcagtgagctgagattgcaccactgcactccagtctgggcgacagagcaagatcctgtctcaataatactactattaataataataaggattcagtaaattttacatttcagtcccttccaccctgtttcctcctgctggtcccccaccattgaccgacttaccctgcaaaaaaccataacacacattagcaagattcatttattacagccaaatcagcaccccaggatcaggccttttaggaaatgggatccaaaacataagtgtcttaaagaggtagaagatcagagggctttgaaacatggccatgtcatcagtctgaaatttagaaagaagttccctgtggcaagagaatccgcaggaaatcactaagctttggaggcccaggatatacccagtaaagcacaggcggtgggcccccaagggaagatggacagcaaagacagcctttataatctgagtagatttcacccatgtccccctccacctaagctctggttttcctttagaggaggcttttaacttaattcctgttgaatttactaatgttgtgtggtgtgagattttaagtatcttctccagcctcctgggcccctctctcctcccctgtcccttccccacctccctatcctgtcttgaacttccaaccccaagagctcttctttacactgtttgctaaaatggagcctcttgtgtgatgcatacccaggaggtgaagctttcaggggtcctaatgtgtgcttcaggataagggcaccatgggtcccctgcctgccagtgtgcccctcaaagaatgtgggctttggcaacatggcattaattcactgccaatgaaacaatgatgggaattttaatgatagcgttgctgtctaaaagatgacgggggagacttctcagcgtctgtgatccagaaaacacactttctagtaagtatctcttatggtcagaagtgagagtgaaatctctgtcagtccttcctaagcattaccttggcaagcgctacagagcaatgtaacataggatgtgttcagtttaagtaacagaatgcctgatagtggctttgtccgtgtattagtttcctgtggctgttctaatgaattatcacaaacttggcggcttaaaacagtagaaatgtatcttcttggcatgctggatgctagaagttaagcatcagtttcactgggccaaaatcaaggcatcagcagggccacattcctcccagacgctctaaaggagaattgttccttgccttgtccagcttctggttgccaccagcattccttggctctggcagcatcattctcatctctgcctctgtcttcatgtggccttttcctctttcgtgtgtctcatctccgcctgcctctctcctataaggacactcgtggtggcatttagggcctatccagataatccaagaaaatctcacttcgggattcttaattagtcctatctgcaaagatactttttccttgtaaggtaacatttgcgggccttacaaaacacattcaaggcagacaaggagacaggcggtcatgtgtcctgtatgtccccttggctagaagagtccattcctaagtgtgagagagaaaggaaaagcaaagatctggcaaagaggggcaaggatttccatgacccatcatgattgtcccctgtgggttggcgttgtgctgtcttctgttagcaagaaagaggcggaggacatagtttgtgggtggtcgaagaactatgactgccaccaaggatgcgggcttccacacccccagtgtgtcagacaaaaagatctgaatgggggtctctctttttttggggaaggtaacgctgttttttaacgctattaaaaatctagatataaaggccaggtgtggtgtctcacgcctgtaatcccaacactttgggaggccgaggcgggtggatcacctgaggtcaggagttcgagaccagcctggccaacatggtgaaaccccgtctctactaaaaatacaaaaaaattagctggacgtggtggcaggcacctgtaatcccagctactctggaggctcaggcaggagaatcgcttgaacccaggaggcagaggttgcagtaagccgagatcacgccattgcactccaccctgggtaacaagagtgaaacaaaaaactccatctcaaaaacaaaaaataaaaatttatatataaaatacctagaatgatgtggcccgtaatagtaactactcgggccgggcacggtgactcacacctgtaatcccagcactttgcgactgagcgtttccctgctcagtcacactgataaaccaccatcgcctttgagtttctaactctgcctatctctggaatccactgaggaggaaagtgggcttaaggtttggtcttggattctgaaggtgcagacctcatcaccacctgctgctgtgcaaagcacactactggacctctctagaacctcagcaagaattcatacctcccaaggctgtggcaaagatgaaatgcaggcctcgggagtgctttgagctctagaccattccacgagctgctgttcctgttgtcactggacagtagggcccactgctgcttcatagcctaaagccaggtggagggagtccagtacccttgttgattctttgcttccctttcccttgtcagccacacccaccacacagacttccacatacccatgtgttgttgttgtttgtttgtttatgttcgtttgccagttctgacttaggagcaagcctttggtgctgaagttggtactgttctcactcctgaatgtaatgcccataatggatggagaatgtcaggggaattgtgggtaatagtaagattactgtcatattcccaaaccctggggtgggtgggaagaagcccctaaccatgcagctttatttccactgtgcttgtggtggggcctggaccaccttattcctggtggccttcatcttgggtgctacaggtggcaatggcaaggactgaagtggggagagtgaagatgcccgcagcatctgtgcctggccctggctcattcgtctgattggattgttagcaagccaaatatgacctggcctgcagggtacaagaagacatggaatacctggtaggcagctagataggaacgcgggacttcccagcagctgagcgtggagaggtggttccctacctggctacacatcacagtcactcagagtgctgtgctcagagaggcactttggcaataccctggacattccgattcagaagtttcttaggcaggtgtggtggctcatgcctgtagtttcagctacttcaagaggccaaggtgggaggatcacttgaggccaggagttcaaggctgcagtgagctgtgatcatgccactgcacttcagcctgggtgacagagtgagactctgtcgctacaattaaaaaaaagaagtttccaggtgaggtacaggaatctatatttctaaaagcaaccctgggactactgatgcatagcctgcctggcaaatacacagtttttaggagaaaaccatgagctttggggtcagggaaacctgtttttggtaacagctgtgctacttactagccatgtgagctttgtcagtcacctaccggcctctaaacttcagtatcctcagctttaaagctagtgtggtactaatacctgcctcacaggattgctgtgaggatgtaataagatgtttatgcacaggttatatgtatgcacatcatggtgctttaaaaaccctcaacttccccctaacccagcacggaagttcaagggcagactggcccactggctttggctctggtgcccccagccacttcccaccaactccatccatgtaagatttacatagccatggccaaattgttactgcaattaacaatcacacctaaaagcttttacttttacttttactttacttaaagggaactcttaaagagtgtttacttcatatcattagcaaatcattgttaattcttgtgatactcaccgtaataacatctatccaaatgaacatgtttgctcttaatgcgagtgtcatgtgcaatttgggagaaattctgttgtcatttagcattaattaatgcccacttactgtaaagtgttcagagacaccaatatcagcgagatttccagaccacatagacaggacagaagagctgggaaggggccagaagccactagcagggctgcactgtgactgaaggcagtggccctgggcacacttctctgctgagggcaggcaggccagccttctggctggaggatctaggtgtccacccataggtgttcagagcacacaactgggccatcccagcctggctccactcactgtggctggaaggggttctgcctctccatccccagcccttcaatcccacacaaccacctctgatgacctctcctcccagctgcagccaccttggatgttgatttttaacctgatttcacctggctgcacatgtcagctggtgggccctggagtgtgaagtgtgacttgcttgggcccctgcagccttgcctccctgcagcgacttcctgcagtttgactttggggcagcggctgccggagaagcctgaaagttgagctcaggaagtcatcttcatctccacccccaagcaggtgcttgatcaggactgtttattaatgtgttctattttctcaaatgcgtcctccaaaacagagtgtgtgtgagatactactcctgtgcctgggacagtcagtgtgacagtgaacagtgctgctctaggtgtggggacacagccttacgttccctttcttccaggcagctcagtgtagtggaaactacaataactgaccggggctgtgcccaccagctgtgtgagggggcctcagttttcccacctgtaaacggggctcactttacccaccccgtggaatggtttaattaggtgtgatgaagtcctgcatgccacaggtggtgcttagtagccatcgccttattaaaaatgccagtgatcaccgaggatcatgatttccctccccttgtgtccacacctcagacacgtcctctctccttctggaggggtaggaacagaggaacagtgcctctcacctgaggagggaacttctctgaatccaccaggaaacccagtcacaaatcacacagaagcagtgttcattttttctgtccacaaccaatatgactaaagtacggtggaaagacaagtattttttgtcctggtgaggaaaggtgccttgatatgtactttttttctgccttgtggatggactgcattggacagaggtgggggtggtggagggagtggaatttaccatggtggtacaaatgagtcagtctgctcaatagggatgtgtcccatacagagccgcagatgcctggtttaaaagactcaggctgcagttaactatgctaaactcaaattttactgagtggaatttagtctttctctgatgattaaaaggcccttcagaatcttctgagccgttttgttgaacagtgcttttttgttacttcctgggtgtaggaaatggtggggaacagagggttttgctggaacacccactggacttgtgtgtcctcctctcggtttctaagggcccctcaggccacacgcctcccatttccaagagagtgagaggggcctagaaaaggctgaacacaaagccccacaaccgccaaattccctttcaagggtgttacttagtaaacatgagcccttgagcccacattcttccagactgtgtctgcctcaggccacccctccttctagaaggagcagtgggggccctggcaggaggctgccggctcagcctggagtggcccacagcaatgctccaattcacagtgaaatgatttcctctgcctcgtataatttaacctgcccacattgctaaacttctatattacacatttctgtcaggatgtcagaagaaatgataagcctccttgaaacagcaacctctattacatgctaagagcattgcgcctggctccccccagctctggtccttctggtatgtttctgagatttttagcatggtctctcaagtataaagaataccctacttcatgaccccagcctcttgttagctgatagatgaaatcttttctaaagctgactctcttgtctattatgttttcaaaattcaaggttttagattcttggatggctgccaagtggccgggctttcttagtaggtgaattgctcctctctttttttgatccttaaacaggaagtagttgttttttagggtggagggaagcgggaggcatgttccacctcccttctccctttgttgatgtttccaggcaattggtggggaattttttcaggaatttctcctcggggaccatactttaggaataaacccaaacacggaaaagccatttccttgtctggtgggagcttgtgttttctcgctagattgtgtcacccagaatttgttgtggagcttcttgacaattgtgctgtgcacgtgactgcagcatggaccactgagggggaatagcaccaagctgctccatccacacgggagacacttgcgagatctcagggccatggacagtgcagctgcctgtcgctccctgcaacttactcccgacccgggcctcctcagagacagccacaatgcagacagtccacacataggatggctcaggactctcttcattattagctgtggttgtgtggtttccccgggagagagaactaagactgagtttcatttaaacctaaaagtgaggaagaacagatgccatattcctacccttagttgttaatttggattacaaacacccatgcttttcttcaggtcattagtcatgtggcttttttcttctttgtctcactagattctgtgggaacagatttctttctgcatagcatttagtggtgggaaaatgatgtttgctgaccatccttgaaattgaggcacaatgtagttcttgattaggaagactctggaataagcgcccaggagaaatggaaggtgtttggtttccaaaagtggtaccttcaactctttttgtaagctgagtgtgtttctctccaaagttcctagcccattagtgaactgtcatacacttcaaggccagctcaccactccgatagctaagctgtcatacatagtccagggtccgtgtgagccccagctcttttaaaactcctggctggctgtgtccagagaagacattcttatcagttttctcagttacttttgggaaaccatctcagagtgtaacctaagtctaaactcagacaaggcactgtgtgttttacaaaatacacatcccactcacctgggcttaattacctgtaaaactgaagtaatgaaagcagtgcctcaggcttctttgcagctcaaaggggatgggccagggattggaatgtagacctgggagcttcctttgggtgcctcctggatgaactgcactgtaggttcagtgagactccttccgggataagccaaggacaacagagccagactgtggggcagagggtctcatggtcctcatggcaaagccagccccagccctcagtgtgccctcatgactatgagtccagtctttacaacaggaacataacaattctacagaagggtggaggatctaacactgaacaagcaaggccccatggaccaggcccccaatagacgttacttcattcagtcatccccacagccccgggaggtggaggcatcactttccataccgtatagaggagggaactccccaccaactagtgaagtttaaaaccagcattccaagcagggctgcccagctaccctgcctactttgtcctgttgctgcatcttctctctgattcccctgaagtctgtgcgaagtgccacaggaggtcgaaggagggaccagaaaggtgagggtttcccggaagtagtggaagcggaccgtgtcctgagaggtccccagcccgagaaggaggcagccaacctcagcaaggacagcctggtctttttttttttttttttttttttttttttgagatggagtttcgcttgtgtcacccaggctggagtgcaatggcacgatcttggctcactgcaagctccacttcccaggttcaagtgattctccggcctcagcctcctgagtagctgggattacaggcatgtgccaccatgcctggctaatttttatacttttagtagagatggggtttcaccatgttggccaggctggtctcgaactcctgacctcaggtgatccacccgcttcaacctcccaaagtgctgggattacaagcctgagccaccccacccgctgagcctggtcttagagtggggtcagcttcggcttcctattgtgagaatcaggcctctggcacttatcagccctgaggcctggcttaatttacttcgaatgtctctgtctccatttcctggtctgtaaggtatcactggaagtgttctcaaccctttagtatgctttagtgtgagaaagcttgtaaaaatgcctgcatggtgccttgctggtgcccagtcagtcctgcatttctcggctctgcaaaatcacagacacatggaatgggatggtatgccccagaagaactgggggattgggagacctggcaggtgtgagccctgggtttgggaagggcagaaggtaagtggtgacagataagtctaggaaggcatttgggtgtcaggtcataaaggaccttgaaaaaccaacccctgggttagttgaagctttggtttagtttggtttcacggaggaacaggatgatgagatttttctttaggggaagatgacggcagcaataagagtgttggaaaagtcaccctgaacaacttttgtaggtaacttaagggcagaaaaaaggaactctttatttttcaagtggcatcatggctatcacagctcatcagtgcctggaacaacacctttaataatgtcaataggaacgcttcgaactgctgcagaaattctgcttcctgaatgtttgaacttaccctcccatttaatctttaaaccatcccttcaagagagggaggacacaagggtttttctcaattatgtaccactgtgagcttggcttagttaccaaaggctgatgatgggctcagcagtgggatccgagtccctgcgttcccacccaggcttcccaccattttcctcttaggtgcgcatccgctttgaagctgcattctctctgagacatgtggtggtaatgataatgttaatactagtaatgatcatagtaatcgctaacattgagaaagcatttacttattatatgccaggaatacgttgctagttttgaattgttttgtgtaattatcatctcctctttccaactaagaaaactgaacggtaatgagataaattaccctaggacacataacaagggtgtggtaggatagaaccacacccttcccaggtgaggagttgcctgtcatttctcagggtcctccgtggcacctggggacaggtggaggtgggcgtgggttgtcaggacatcaggggcctaactctgactctgcgtcaatcagagaagcttgatttttatctgtttcattggcctttctcaaaagagttgatttgagaaagtgttttttaaatagctttttaaagcggaaaggggccgtgtgcgctggctaatgcctgtaatcccagcatattgggaggctgaggtaggcagatcacctgaggtcaggagtttgagaccagcctggccaacatggtgaaaccccatctctatgagaaatacaaaaattatccaggtgtggtggcatgcgtctgtagtcccagctactcaggaggctgaggcgggagaatcacttgaacctggatggcggaggttgcagtgagccgagattgagtcactgcactccagcctgggtgatagagcaagactccgtgtcgaaaaaacaaaaacaaaataaaaataataaaataaagtggataggggttgattggggtttttcttttttggaaaaaagcaattaaaaagaagatggattgatagatacataatgagctgggtagatggggagacacatgataaagcaagtgtagtacagtgttaataaagtcagtggtgggtatataggtattcactctaaaataccacttttctctatgtttgaaaattttcataataaaatgttggaggagaaactagccaagtaaataatttctaagggcccttccaattttttaaaaaattttatttcctgcacttctctctacatcctatagttgtgatcatgtacaaccatgacgtgatcattaatctagatagatctcctagtcaccactggatgttgccactaaaaaaaaatctaggctgggtgcagtggctcacacctgtaatcccagcactgtgagaggccaaggtgagtggatcatctgaggtcaggagttcgagactaggcagaacaatatggtgaaaccccctctctgctaaaaatataaaaattagccaggtgtggtggcaggtgcctgtagtcacagctactcgggaggctgaggcagggagaattgcttgaacccgggaagcggagattgcagtgacccgagattgcgccactgcactccagcctgggtgacagagcgagactccgtctcaaaaaaaaaaaaaatctgctggggagaacaaagtcaatcatcactcatttggttctccaactacctgagcctaaattttgattggcaagtttggttgggttcagatactttcactagaaagccgtaggcctgtgagtctccagatgaaaggtgggtttagatctacacatctcctgtttcagggcagtgagctgttttggacccatctctagtagaagtttcttggagctctccagccacaataaaggtacagtgttcctgttcactcactttggcagagccttgaaaaggagcacagagacggtcaaatagtaaaatctaaaaacccgtagaaaaccctagcagaaagtattcttaaagacccagctgtatttttctgttcataagacccagataagcatagtcttcccatttgacattctgactttaacatgagagggagtttcatgcccccttggtaggacattggagtacttgttgcagcgtgcaagaagtggactttgtccagcttatatttagaataaccttgccagcacattccagggagttgatcaaggagttttgccaaactgtgataaatcagcacattgagcagcctctgatggctgataagcttgggagtgccagttaattgacaagaaccgcacttgtcaatcttttgaggtcatggaaatggatctcttgtctttctgcccttccccaagtcttcacccgcttgctctttggtagattgagcatggccttgcactgcatggagcacacctcccacctttgttcttgtgtgtttgctgagtaattaatctcattgtgctagtatggaaatagtctattaaaacattccggaggacaccatggagagggaggaaggaggatgaagactggcggagggagtagtttgctctgtttaattggttctttcacctaatggtagtttgtcaattaaggggatacttagagaaagtgaaattaatccatgtgggtcaaatgcagctattaatttttaatcaaaacacaatgttcaacaaatctgtagctgtgcttagtacaaatgtaagcatgccaccagcctcttcccaaaggatgtgggagcaggcacaggaaaggggggcctgttaatctagcaaatgtttgcctcctcccacactccctgtgaccctgaggtaagctccgcagagcttcgttcttgtctcttcaccatctattgcattgcctaacacatggtagatgctcagtgatattgctcttctggaactctttccatccctattatgtgcacagctttggagtacctcaaataggttttaggcataacagctattctctaagagctcctagcctgcttgagaaagcagaggaggcagttatgaatgcatccccaagtcactcagagcaacgtacaatcaagtacaagaatgtgtgataaaccgtggcatttgttgagcacttgctatatgccagatacttttaagcacttcacataaaccaagttttttaatctttgcaacaacacaataaaataagtaccatttttatcatcctattcataaataaggtcactgaggcccagaacatttaggtaacttgcctagggtctcacggctagtacaattagtctgctagagggttgcattcattacctaatattataagacccagagttgtcccaagagagctggcattgatcaggggttaaggtatgagtttattttggaaagtgccagaataagatgctccaggtagttggaatggtaatcagcacggttttgtggaaaaggagtgcatttctggttaactggaatatgaggttggtgaggttgaggtaggtctaggttaatacactttcagggtcttggataccaggatgagaaattttcatgtcggttattctgggatttctttattgtttatgggttgtttcactttggaggagcaagtcccgttcctctatttctgcacttgggcattgtgccctcatcattatctctcttacctcctctgcctccctccatctggcatctttcttctcatttatggcatccttagctcctcctgcttcccatttttagagagagggagagagaagagaaaatcaagaaagtacaccagccggcctacttctactgactttcagaggttgaatgaagcttttctcagccctctgccctcacctcagtttggtcctggaactttgagaggaaaaacaccagaaggacttggcctcaggaagttttcttctgcctccccttactgagcagaaagcaggttggaggaaccacttggctctgtgacatttatagtgacatggtttggagaggtcaggaaggactgtcccagtggtgtctcttcaggctgctcacaactgcctgaaacctctcagtaggagaggtttctcatgatccagtgaaaaatcaggcttcaggtgtacatagtttaggataggctacagggtatgttaaattccttcacattggccagaagctggagaaatgtgaggacaggtaaaatccttggatattttcttctttacttccaaggtagcttacaacctggcctcttgaagtcattgggctgatgataactggtggaaatttgcaggtaattgccaatgacaatgagggagagaattggggaatagaggggccctatgaagaggatcctctgcctcgtattccatgcagtcctatgggctgctgcagtaaacctgggaggtcatcaggattaccacaaagactcgtgattgggtgggtgtccctctgggcagcctagtttccctagacatacaacacgtgttcttctccagcagtgcaaagctgagaaggggcctgagtaatcgttctggtcttgctccaggaggcaaagccacagctgtctgtgtacccccatgcaagtgggcaggaggggttccagcaaggctgcttgctgggggagacagggtggagggaggaacagcgactctggatcatagagcagaggtcagggaagcacagttaggatggaaagtctcgggcagaaggtgggtagaggtggataggcagtgtacatggtgtttcaccatgtcatcttgaccaggaacacggtggagagaacagatatagctgactctgtgtgatcagtgattttaaaatgacactagtgtcagactcttaaccagcaagggaacacatcttgtaaatctgggaaaactaggtagcccaaagggacacccacccaaacaagagtccttcatgttgaagaagaagaagcacttcttgataaacaatgaaacaagctgatatggaagaaattgttatgtcatgggaaggaggacatttttggtacctaatgattaatatgaaataataattatgtagtgattatatccttgcctctcaatctaagaatactcagaacattgtcatagtgaatttcagtatcttctatgtgaaaagcagcttagctagtgatatctgttattcatgcattcattttttctttcctttgccatatatttaccaaaacctaatctctgctaggtagtgaataaggcttttgggatgcggcaacaaacaaaatgggcatgttcactgcccttaaaatgtaaggtgaaatacaacctttatagtgtccactttcctgcgatggttaaggttttcttcgtggacaaatacatgatcaattctatagctattccatgcacatataaagaaaagtgaataatacctgttcacaatctcaaaatacctgttaaataaaatgtatcaattttaaacattagtgtgagacaaaaacattaagtaacagattgtgtgcgtgtgtgcaggcatgtacagttagtcttgaaaagatcaattgggagtcagtggagcatttaaagcagggatagacatgatcagatttgtcatttaaacggtaactttggcagctgtgtggaggacggattgagggaggccagagtgaagatcagcagtgaggagagactgttacccaggtgagagaggatggtgactcagagtaggcaatgtgggggctgagagaagaaaaggagctaaattcttcttggagatcaaataagcaagatttggcaactgatggaagagaatgtaaaacaattatctacttcctaggttggttgtgggaactaaatgagacattattcgcttcattttacaaacaaggaaatagagactccaaagtgattgagataaacgtctgacttccacacagcctttgatctctctactgcacaaggcataaaaagggtgtaaacagaggtagattcacccaggctaatggctgaaagcctcaaggcccttcacttgctgggatctcatccaaggcctcatacctaattttatattcataactttgtattcattttcttaaaaagcaccctccacaagggtttaagcttcagactccaggaaacctctatctacctctggccaagtaagtaacctcattgggtaggactgaaacttgatgggatgagacctaggatcaaaatctgacccagcaggcagagaaagtagtgtgtttaggttgggatcaactgggagagaaacagatgccatattggaggcataacaaaaatataactgttagtgtttattgaatacttcttgtgtcaaacagtgtatttattgactttgattttttgggggaagtttcttgtattatatcacttaattcttatacaacccaacagggtggttgctttcattatccccattttatatgtgaggaaagtaagccctggtaagagtaagtaaattaacaaagtatcacaatactaagcaggtgagcagcactggcatcttacaggcctgactttgatgtttgaggctgtccttaacctccactgctagagggactgtggtccgaagccagcacctctgatagattcttgacatgtgctgggcatttcctctcctagaggttggaggaagcaaggtctaattctgtcctgctcctttccaaaaaggaattgcttggtgaaatgtcagtgggagaaagtaatcaccccaccttcagatacagagttgaggacttatctgacatgtgccggagaagacaagaagattctgaggcttgaggccgaaggagggcatcaagagactccagcagccttattttgttattatgcggttgttattttgactcaacagttggctctggtgaaggggagagatggggcttatatgcaacaacaagtgagggcgatttgagggaaaacatgtgacccagactaggagcattgtgtccacattaactgaagctcacagaaatcctaaggataagtagggttttcagcgtaattttgttttttatgttctgatcaagattaagaaaaggaggctttgtcctttgatggaaggtgtggtgttgatggatgacccagagaaagcagagaggttcacctcctgctctaccttcctgtccagaacatgatctttagaaggaaaggtatagaattttcttggcttaaagggactttagatccaagatcagtaaagagattgccttgaagatttaaatgagctcacgttttcctgacctggacaagttacctccccacatgctgagagatcttgtaaatgaaatcactgacccctccctgccagagatgttggagaaaggtgggacatcaggagagaggctgggagactagaggggggcaaatacattgcgaaatttttaaagagaaaggagtgttctgtagccacaggtcagtgagcatcaggtgctctacaggatcctagacccggtcagcatggagcaggctggtgaagaggaagcaggaatcaaagagtcgggtcactaagactggtcactggagcttagcacctttttttttttaacaagcttactaggcagttaccaaaagtggaaagggcagtcttactccctcttctcaaggtcttcgacaaggtcttttatgaagcctttgtggattcggtgggaaactgtggagtggctgcagcaaattggtgaatttgttgaactgaccaagttgatggtcgctctacagtttcgtcacgggactctgccctatataaaataatcgtcagtagttgggtaataattattctgcaccaaagttgcagaagacagaaagttgtgaggaaaacagatagcttcagatggccaagtcagaatttgaaaaagaaaactcattcatacagtcaacaagtatttgagtgtctgttacatgccagtcatatatccatcacggagcagctacttctgggttgattctcctagtatggatggtaagcaatgaagaaatgtgtgtggtgtctgcatgcaatgtcagatgatggtaaagaatatggaggaaaaatttaaagtcttaggagataagagcaaggtgtgaggggggtgctattatgatacagtgatcaggggcagcttctctaaggaagggcccaaataaagagaagctggtagatacccacaaatctgggggaaaactatacctggtataggcaacagcaagagcaaaggccctgaggctggaacatgtttggcatctctagaaagcctgagtagctggatatcagtgagagcaagcatgagaggtcagagcacagcttgtccttgcaggctatgggggatatcagatgtcctgagggagagggaagccactggaagcttttttgatatataattgataagatccgactcgtggtttgtttttgttttgttttgttttctttttaattgagtcagagtcttgctctgttgccccgcctgcagtgcagaaatgtggtctaggctcactgcaacctccacctcctgggttcaagcgattctcctgcctcagcctcttgagtagctaggaatacaggcacccgccaccacgcccggctaattttttatttttagtagagatggggttttgccaggttggccaggctggtctggaactcctgacctcaggtgatccgcctgccttggcctcccaaagtactgggattacaggcatgagccaccgcgcccagccaggttcatggttttagagactcagtctggagataagcttagcacagtgtgatgggctggctcttcaaggatagcatgacacacatggcttagcaatggtagatgcgagaaaggcctagaaattttagtaaaaattcaccctaatattagcaacagtgttatttgcctgaggaaaaaactaacagtattaaatggtatttggtatttacagtgactggtagggattggtttttaccctccctcccctgcccaatctctgaagtcttttaggataagaaccgattggttaacaaagcttcctggatgaactcagcaccttattcagctggccactgccagccccaaccaacagagaaaggagcatcagtgaaccagttctggtgaaccagttcaccccactgtgaaaactcaaaacccaggagatgtggtagatggaaataaggatgtttaaggtaaagagagcctcatggtcaaggtgaatcactggattcagatgtttggaagtctgctcaatagagagaggagattaaatttggccacagcagttagtactgtgacagatttcttttccatatataaaatatgcttcctagagtcaacgctatctaaacatggactgggcccacgcagcatctggctcatccctggacgtgtatgtaaactgaggctggataagctttgggtgcagttatgtagagacttaagtcagtaaatggacacaatgcagtctgataaaggaaagagggtggaggcggggagacaatcaggaggagaaaagaggcagagaagtagaagcctgtggttgtggagatggtctgtaaccccaccgggagcagcagcatctgaactggttctccccttgctcccctttcttttgccctccagccaaaccagtaacaaagggcattgtctagtagtctgtgtcagcaataaaagccatggggatctgacccgcggcagtgtgtttcagcctgcgaacttcctggatatctttacggggaatcattcccggggaaggaagggcaggctggaaataatataaggagatcaagaaggaagtcgagcaagtgacacctttaaacaggccaagcgagccgggctcttccccctgggacagttagagttatgcagagctgtaattaacccagcagcccactggatatgtctatttcaccgcacaaaggctgttgaaagaaggattcttgaagaaagaggttccaattcaaatggtatttgagtaagtcccttgtcggatatactgtttctagagtttatggctataatcaacaaaacatggccattctttcatgcaggtttctcatgactttctgaataccaatctttagaaagaaaaggggaaaaaaaaggcatccagaattgtctaggggtagaatgggggaaagggaaggagggggaaatatggctcgaatcaaattaaggacttggttttcttttcagaggatgttgaaaacatttaaaaagcaggtgtgtccttctttcataaatgaagactctgagatatgtaagaaaattttcagttgtgtattcaagtccctcaaaatcattttatcaacctccctaatttcaattaattttttaacaaatattttttgtatgcctaccctatattaggcactattataggcgctggggatattaatatctctctcctgccttcctggagctaatagtggggagagatagacaaaaacgtttaagtatgtagactaattggtgtgtgagatgatgtgctatagagagaaaaatagcagggagggaaatacagtggggagggatgcaaggaaggccttgctgagaaggtggcatttaagcgaagatctgaaggaggtgagatgtggatccggtgggtgtatgcgtggtggggtcagcgggtggggagagacagcagtgcaggcagtgtgcacagggattcgtaaggtagcagtgtccatggtagtgtgtgtgaggaatagcaagcaggctgaccgggccagagtggagagggggagagccagagcactgggagatgagggcagagaggtcagttatggctggagtctgcctttgccctcaataaggcacccattcagttactcaagtgggccagcacacagtggtgtgtcctcccacatgctctgagtactggccattcagaatggttcccatcacacttaaaaccgtagagaataaaattacattgtcactgtgctactcttcacccttggatagtcctagagtcctttggcgtagcttttacatagtgtgccacatcccactgtactccctttcctgagaacagactgatggaccgagttacgatttatatgagagaaccccaaatcagaattcctagccatgtctaatttatatatcagcaggcaagttgttttgtttcttgtttgggttttggggcttctgttttggggtggggtttttttttttttcccagtaccgtaacttataatctcagatcatggaagagcattctctaatgagctttctaaagccaagagctctacccagttgctgggtaaaggggggaacatggagaattagaatgtttacattgtaactgatttatgtacactatatttgcatgtaagtgtactaaaatattttttaaaattaccagccattaaaaatgtgtttgctaatggggataagaatgctggatacaatgaggtaagctttgtttaaaaggatttaggagactcacaattcataatcaatatttcaacacactcgtctgcatttttagggcaatagatctgtaagtagaaacaggcgtatttgaagaaaaacattagtttctgagatctggccagctcctgttcttaccactctgtcatctctgattggattagacgtcacagaaagggcctcagatccttgtttcacgttaagtttaaccactccagttgaataccatccttgtggagctcagtggagagaaattaaatttctatcaccagaagtatggcactgaatcaggtatcaagggggctacatcagtaaacttcgttggctacaagatgtatgtccttcctgaggctctgtagctgttaagttggctctttccaatcacagtctgatctttcattttcccgtaatgcagttagacaacctagttattcaggcatagacttctctgtttttcattatccctgaataacatttgatgctgaaatagggaagacgggaaggacgggggaggggagccaagcatttttcacagcttgtgtgaaatgcttaatatttgaacgtctttaaaatatactgtacacatacattccaattttataagactaacataacatgttcaaaagttttatgaatttcagcatgtaaccagagtaaacgttagcctgttttaaataagccataatggcctggcaacaaacctgcatagttagcaaatccctcctctgtttatgggcagccattcctcaccaggtcactacaaaatacaagttttatcagtttctgtggactccgtaagttggtctgtgtactgagttcagcatgaatctggttttaagagcacaaaaccaagggcatcatgatgaggtgatatttcgttttgattttaatgaaatggcatgaatctgacttgcttaagaatatgtccaggcctctcgtatcctgtgggggcaacttggttcctaaatgccttccgtaagcacagggccacacagacgtagcaggcttaccccttcctcactggagtcaagagagtgctttgtgcctagaaaatgtttgtttttttggtggggcttttttttttttttttacttaggttggaagcgccccccagatgatgctttttaaggtaggatctcctcttaacaagtgagagcatcaaacatgctgggtcatgcccagttccatcccatcgtgtgtcctgggtctaaggtattagacacagtcatgcctctcaatggtgaaggttctatgttaccagatcatatatttcatggaaatctgctagctcaccagataaaatcctcccagcttcttcaagcgtggcagaggagagagacttcccatgtgttaaaaatctgctaaactttgcagccccaactcttttgcccgtagactcaccctggcctcagccatccctcaggaatcatctaccgtagaccaaactggcttcaggggatattccaacccctgatgtactctggcatcaaaagctcctttaattacaaataggacaccagagaacaggttggagcatttaaataagactgatctaaaggctgtgggccaaagatttctcacagagggcaacacgtaattaggtaatctgactcacaagatgaagtttactcgctttcattgtggtgccccccagggcagccttccccacctgccctctaggcctgtgtccttgtagcacttaccacttgtaagcccagccttctgggagaccctcagtcaggtccagatgcttccagaggccgactccagactcatccagtttcttctctctttgtcttataacagtcatggtcctcattgctccctaaaacatcctacttagtatttagagctcactatacatctgttcaaagcttggcttttggaagtctttattgtaccagtcttcttacctcctgaaataaggaaaatataagtataactgcccacagaggcatataaaactcctttccatttacctcatttattcgtcttatttaggggaagcgcagttcagggtgggcagtctagtttaagccattgagtctagtttaagccgttgttcaccatcatgattttatagcctttagttttattccctgtcagccatagacatccccagagatgcaagaactcatgcaggaaaacccatttaattaggacccactgtgaaggaccaggaaacagaccctaaagcactttatgacggaagctgttgatcaggaaacaggatgttttcctttccctgggtttaggtctggctcatactcctttggggagatctgggggcctgtctccatctccacggaaacagaacctgtaaccttcccagaatcaggttaccctagagggcagtgacatttatatctgcttttttgtttgttcgttgttctctttcctaagacatgtaagtggcaggttttgaactcctggatctctgcccaggggcctggcatgttgtatatctgccattctgatgtgtggagggcctcctgtctacactctctctgccccatggctagagacagctcattctgagagattctttttttataggaaggcaaagctcacctatccctaacatgcaaaaattttcacttgaggaggcggggaactggtttagtaaagatctttgcgtgaaattgaatccagtccttgccatccttcatgttcaactcaagtcctccttctataatgaagtcttccccagccagaagtgatctttctctttccattacatcagggccttttccacattcccacctttcccccctcatactgttgactagttttatttcccattagtgctttgcaccctagtgctcctaggtccatttaaagacctaaatggctgggatcacatcttctacttggttatttcccccacagcattcgatcacttataaactgtgttaattttccccacagtgcctcacatagagtggtgctcaattacaacttactaagtccatttgaaaagaaatacactgttggtcaagaaatctgtgtgctgagtgcttcaagggacacaggcagtataaatgagacatcctgccctcagggaatgtatagtctgagtggggataagacgaggccacatgaaaagtctactaatagcggccagggaccatggcttcctacaatacaagcactttgggaggccaaggtgagaggatcacttgaggccaggaatttgagaccagcctgggcaacatagtgagaccctgtctctacaaaaaactttcccaggtatggtggtgggtgcctgtagtcccagctactccagaggctcaggtgggaagactgttagagcccaggaggtgaaggctgcagtgagccaagatcacaccactgcaatccagcctgggtgacagagtgagactgtgtctctttgaaagaaaaaaagataaaaaaagcaaccagtaatacaattccatataggatctgggccagaaaaaaataagtactgattgtcatgatcatggtgatacgttagttatcttgggtatatacactgtttttacccatccccataacaactctacaaagtagatggtgctagacattcttagtctcagctctcttgtctttagagtgaggacaaatgattcgtccagtgagtacagagtgctgggattcagacagctctgtgagccctcacgtgaggctcaccctgggttccaatggctcagagcttctcctcttgcttctctctcattacccttgtgccctgcccactcccaacctttcaaatatattaaggaggattaaccatattgttcactgctattaaacaagaccagagacagagtctttccagcagaggtgacaccttggtgtctgaatgagaaaggagttgtccaaagacatctgccccacacagaagaaaattagacatatcacatgcctgctttgttataatggcataaaagtatgtgtatgttttaataagtcatgtactgagtgtactcagactatagcatatccatgtgtattacggtggttaagagctcatctctttagtaacaaacaggggttcaaattctgactttaccacttacaagctctatagccttcagcaagctagttaacttctcaggacctgttttttcattgataaaatgagtggggtaatacctagctcaaaaatttgttgtaatatttaaatatgaatgtaaagcacagtgcctgaggtcactcagtgaactgtgattgtggtgagcatactgttatatcccttcctgagccacagaacttgaatttgtgttcagagctggagactccagaacatctcccaaagggaagcaatttaaagttgaagtagcctctcccttctgtcagtgaggatgccaggtcttttctgagtttcctgtaagtcctctaggatatgttactttggataaagtctcactactttgacctgtggaaagaaattactgtccaagtacacaatttattttgacctcccaacacctttggacaattccaggctggctccaggcttcatcagaacaattatgtcctctctgtggaaaacattcctttcaaatgaatcagtagttactcaccttttcttttcccagccatatttttcagttgccaacagtgggatcagtgaggggtagtggtgtagctaacattagcccaatatagataagctccagattatccgtcatcttgtttgaaaaaaggcaggcctgccaaatttgcctacagttcccagtgagggaaagaaacaacaggttctatgaagaggaaggcacagaactagtcgtggaagtcacttttccagactccctccgttactcaggaggaaacaaacccagagtgtcttcttcaaggttaaactccctagaagctgatggaacctggccagaggctgtgaactttgcacagagggcatcatcagaatcaccctctgctcagtggatcgctgccctcccattactctgctggcacgtacctgatttggttgacatttccataattaatttataacagcaataaccctgagatgagcctatttataggtttgtgcaagctaggtaagaatatagattaaatctcagatcattaacatacttaaaggacttgggagagttttgtgattgtcaaatgatgtgattaaaaggcctccaagcttgatgtgtactgggaatccacaagtttactttccttgccaagctcagaaacaacaaaatagcaaaagataagcttacattccacccattcaccaaagatgttgggtcatccggggaactggaccagggtcatcactgatggtctacagctgctgccccacagatgaggatctgtgagcgtggttctgacccttgatatgccagcaagtgtggcaccaagagtcccatgggaagaattgctgtgactgtccacagcaatagagatgagtgtgagaagcacacctattagttgaaaggatgctattatgacctggactgctgtgcagacccaatcttactttctttcctcctttttatgttctgttgttctggttgttaaccttctgaaaagtaacatggattgcttttctattataaaagtaagacgtgttcaatatcaaaaataaaggtaagtacagagaagaaaataaagatcactcataattccaccacccagaaatacccactgctgaatttcagtgtgcatccttctaatagagtcttcattctgacatcatgctagtagaactgttctctggacacagaggcctcccattcaggtgcttgctttgacagatgtgtttcctactgaggaaagcatcttatactcagggggtgagaatccatccatcaagaagaaggaatgactaagggactccctgccttgcctgcaggaggctcttcaaaaaactaccacccagaagtagttccctctctctcttctttttacatttacccagaccactcaaccctatttatccttttcttacctgtatatgcaaatatgatggcaccaccaacgtcatccacctctttcgttcaagaccataacttcttttaaggctctcatgagtccttcacaccaccctccagcatagagaagggctcttcacccattattcccattactagtgttcaagacttgtttttttttttttgctccagttttttattagcaaactagctacaaaatgctgaaaatcaagttaaagttaatacatataagatcatcataaatgattgcacatgtacacagataattattactttcatttgttttattattttaatctacaaactttgagctctttaaaagtggagattagatgttatgtcgccagacccttaacttcgcacttggcataatataaatacttgattaatatttattgaattaagatgaaaatgaagagaaaatttaattacccagtctactttttttttttctatctcagtagttaagtgcagagaaaaaggaggtcatataaaaatgatgaaaaaatagtaccttagaaccatttttatggtgtatcagtgcattttttgtgctaaggtatcactgttaaccctagtgtggaccctttttaatgactttttaaaatcttgacgatgtccttttcacttctttcctaaatgaacattaatataaagccataaaatgttccttggagggttttatgagttactgtgttgtaaggttggggaaaggacacttggagccatttgttttatggagcttgattctgaagtccagcaccgcccctgacccttcagaggcacgctctgaggcatgaagcctttcttgaggacagtgagcactgccacttctccccgaaatacaccagccacactcctacacttgccacttccccggagtccacagtgtcaacctcaagccctgccctccacgagtagcctagacaccgtggagcagacgttactgatgatgcattgaacagctcttcttccacagtgcagatggattttccgttcaccagcatgaatcgcttttgccatatataatatcatgtagtacctgaaaaaaaaaaatgatgccaaagactagagatttggtcgaggacattggtttttctggctctttttgcctccggaactcttcttcagtttatatcagatgtggaagggaagcctaatctataaaacaaagatgggggtttgagtccccggggtttcccctcaccactgtgctaaccctaaatcagctttcaccacttacttgaaaaacccagggcccagagaaaccaaggtgtgagagtgtgaaaggtaagtgcaggacagatagacgataacgagggtgatataaataataatagcttacatttttttaggtcttcttgtgttccaagcactgtgctaaacacagactgtccccccaaaatatggcaaattgtgatgcctgaggcagagtatggtatggctgtctgggaactcttgaaaaggatattggattgcttgcaggcaagaaacaggccagattatcttggcagatctcgctctcactgtggttcttagcctttattacactgttggaatgggtttctcacaagtgatatcaagggaaaaaactagacggatatgtccagtgtatgtgtacgtgtgtgtgcacatgcacttaggacaactttgagccaggagtgtgagccggattagcacactgagttgtactttattctaacacatgcagctcagtagaagtctcatcttaagggacatatagaatgttgaggtagaaatagctcagaagaaagttgataaagtaataggatacgtgcttttgccaatctacatggccatatccttgcatgcttattttgacagaagagtcacagaacagagcaagttcttaaggctcattcattcccatttccctcttgacattttgagcaaaggactggagggaccaatccataaggggaatgcacctggtcatcttttcctgagcatcttgggatcaggtgctcttgggaataagatgatacgtatacccaagagcacttgatcagtcaggcagtgagtccatcaatccacagccctgttctgtgctggatcccatacctttgtacctgtgtggcaggagacaggaaggatgtgtggtggaaactccaggaacttagtccagctgaggagatgatacagacattggaaaacataatggaccaccaggaaatgataagcttaggaactcagagaacatcatttctaggatgaccagagaaggcttcaaggaagaagagaaatttaagcagtgcctcaaaggttgggtgggatgtgagttactcagctggggcagggagtagtctttgcagggagggaaactgctgaggaaagatacggaggtgagccgtgcacattgttcctgttggaaccacacatgtgtaaaggctctgagatgagtttagtgagagttgaaggctcatgttgaaaaacactgtgagaggcacacccagtacagactgtggcaagtgttgaatgcctggcggagaaacctagagccttttaaatagttctgagcagggaagggaggcaaggaaagcagttaaactggttcagctctcaggacaaatgtaaaatgaagggctcatgcttgtgtgtcagattgcaggtttgcttagaaagcacagtgcagggagaaacccgaaggagcaggattctgtcttctggagccctaaccaagggaggccgaagttggtgctttcattgaacgtccatgttctgacatgaataaatgccacgtcatgagtttgtggtcaactcctgtggtcaacttttaagcaagctttaaaacaacagcaaattgcttctatggaatttctcttacagcatcttgacattctggaaaagccagtgcagcagtcaagggagtaggtcctgtcctgtcatttacccaggcttcctagattcaacacatccctgtgggtcccgtcacacatctcaccctggcccatttaactgagctgggcctactgcagaccttcagatatttaatttgtaaacacttaataaagcactgtcagtaggtcggcttgtcttctctgtcggccacatcaaaatcaatacgtcccctgtgtattctgccatgattgtctgggctggggaatctaataggattaagtgtttggggtcctatctgacgccacagtccacagtcctagttagatgaggttaaagactggcttgccattgtggaggcacgattgcttaggggtctgaaaaatcattaaagcttgtcctcttaaacgttgattgttccctggtgatttattgacaaaacacaaaaaagtgctctatactgcactctaattatatgtatgaggccataagatctcatgggaaattaaataaaatttacagcttgatggttttatgctcctgggagacataccttcttaataagatcttatagctgggaatatttatgaggttaaagtccgtaggcttgagcaaaagacctaacctttccatgggaggtggggatggggtgcgttttgatttctttgaagataaatgatcgtaatgaaattttcaggggtttaggaaaaagtgttcagtaagacacatcaagcatttctccttaaaacctctggaggacaaagctgtaagggcacggggatttactgcgaccatttgtctcacataaggcccccatagtcctactccccacctctggggcacttcgtcctcctcctgtactctctgtggcttcctcgtcttattagcccccatcacactttgaaaaggtggggaggatcctaattaagggcaatgatgtaagaggtcaaggaagggaaaggaatttgagtaaggaaaagggagaaagactgagagaatcaatacatgttaagacagcccccagaggagtcactggacatttagtattttaacgggtcaccttctctttatgttaagggatggctgaggaccaggctcagattccacaaggattatcctgtgctgttctagacaaagaatcagagcatatctgggataagagggatttggggggagggcctctgcaggtgtcatgaagatgaagatgatatttatttgttacctttcttgactctgaatagagtgcttatcccaacgtctccgtgaatcctaaacgaagcttcatgcttgaaagtgggctgtttcaataagagtgaggagcatcgtttatgcagccccattcctgctgctttctctaatagttctgaaatggcaagaaggaggtaggtaggtagatagagagctgtcatatatatatgtgtacacacacacacacataattcctatgtattgaattatatttttatctactcaaaggaggataattgtgtggaactcaaagcggttgggacatgtcatatgtgatctatttttctgtttattttttctattgagttttttatatgaaatctgcatggccccttctttgtgtggggggttggagatggggagggcattgacagaagggttggagatcaagctttagagggacttggaacagatgggcacatcacctctctggggcccctgaatttgagagctctgctcccagccttttcccaccaggggagctcatgactggctgtcttctactgtgtgctccagtttatctccaagggtcaagcaaccccaccttgagagctccctacctaggctcatgtgaaaagcaaaggactatgtgatgaggatgaatggatacagcgtttgacctgctagggtgaggcaagtgaattgagaagttcctgactttcctcattgccaactagtcatgttcctcggcttccctcttccagaataaaccaaaataaaataaaagggactgcaaatgcccatgacttagatgtgttagagtccagcttctgtttcccccatttggtcctgattttcgaagtgaaggggagacaggactgagtggcatggtggtgagcaacccgtgtgcttagcccagcggctctctggtttgtcattgtggtatccctctctggaccacagtttcctcatctggaaaatgaagatctaaggctaggtgattttaaagtccctttcagctctaaaatattattttacagttgtaggatttatggaggagaacggcattccgctctatcccttgctttagccttttgaatgaaagtgagatgtctcatcagctcagatagagccagctcaagcccagtgtctcagataaaaggagaaagaaaaaaaaaacttattaaagatagctaagttcccttgataagcagcaagtgagaaatcctgatttaatttaaatatgatatttctgtcttcattaatttaaagcatgtatatgataatgtatccttttttatttagtggtctgccctgaagggaaagaaaggcttgattgtgaagcagaggggcaaaagcttgggtatattttaataaagatgaatatccctaaaaatgcttgaattattatggaagtaagatttgttgcaagttacaaatcaaagcctgaattgtcacttatctcctaatgatacttctacacagattattaatttcattttagaagcccaatgaatgttatattttatgacattgattaaacatcttgctgccatctaaccatccatccttttcattttcaaaaatccatatcggaatttaacaaaaacagctcataaatttgtattttacagcctagcaaagttgactggttctctactctacttaccctcgggcccattctgaactctgggcttgggccatttccactcttagaagtcagcttttccaaactgacatcatgttttgtggtcagagtagtacttggggatttgtttggaagagcacgtgtggcttctggagctgcaaagccaccaggggagttctgaggtggttggggttagcccctgacgggaactcagggtctcagctttcattctcattcttagacaagctagttacctccctcctcagtatcctagggataattatgccctccccagggggctcccagtgccactgtggggatgaatgagacagtagatgtgaaaggtcttcttgctctttagaggcaagcagtgtggtaatggatttaagagccaataaagaacagtgagattgtaggtttaggatcaaccttaggcattataggaaaggtgtaggatgacttgaaagcagggataaaagccttttgaaaatatctccaccatgttattatttatcaaacgtttgtcaaaagaagtacctctggacatagacagttctcaaaaaagatatacaaacagccaataaacatatgaaaaaatgctcaacatcactaattatcagggaaatgcaaagtaaaaccacaataaaataccaccttactcctgcaagaatggccataattcaaaagtcaaaaaataatagatgttgccgtggttgtggtaaaaagggaacacttctacactgctgatgggaatgtaaactggtacaaccactatggaaaacagtatggagattccttaaagaactaaaagtagaactaccattcaatccagcaatcccactgcttggtatctatccaaaggaaaagaagtcatatgaaaaagacatggcgcacacatatgtttacagtagcacagttcacaattgcaaaaatatggaatcaaactaaatgcccatcaatcaacaagtggataaagaaaatgtggtatatatacaccatggaatactactcagccatgaaacaatggcctttgcagcaccatggatggagctggaggccattattctaagtgaagtaattcaagaatggaaaaccaaatgccgtatgttcttacctataagtgggagctaagctatgaggatgcaaaggcctaagaatgatatattggactttggggactcgggggaaagggagggaggtgagtgagggataaaaggctacatattggatatagtgtacactgctcaggtgacggctgcaccaaaatctcagaaatcaccactaaagtacttatccatgtaactaaaaaccacctgtaccccaaaaaactattgcatttgtaaaaataaatttctgaacccttcaaaaaaaaagtatctctggtttcacgagactcatatgtgtgtttcctcaaaaccactgtgggctcatcctttccctggattggctcccattaggggaccccgtgtgttcctgtcacatttccttctttataattgtgatctttatgattgctgttcatttccatccagcgagggtgctggcacctggatcgccatgcagggtgcagctgtggccagctcttcctccaggaaggagacctgaagagacgtattctgagaagcctgaattcgactctacattgaaaaattaaggactggcaaccaaaggctgtcacttgttgaagaaaaaaaccttaattaaaaaataaataaataataaataaataaataaataaataaataaacctaatgaagctgagggtcaaggggcatcgggataaactgttttgcaagggttgatgacattaggaaaaataactctattaaatcagaagtctgcctctgccaggtaatccttaccaaaagtatgcaagaagcttgagagatcagccctagaaggaaaggtgccaccccagtcctccaagggcacagggcacaggggttagcatgtaagcttgctagtcaggctgctgaggctcacatcttgtctctcgctgtacccttggggaagttatcaaaccttgctgatctttggtttcttcatcagcaatagccctgtcacctagggacattgtgaagattaaatgaagtaatagtagtatatgtcaagtgcttattagtgcagtgtcaggccaaagttagtgcttaataaatgttagttgttgtttggccaggcacggtggctcacgcctgtaatcccaacactttgggggctgaggcgggaggatcacttgaggtcaggagttcgagaccagcctgaccaatatggcaaaagcccgtctctactaaaaaacaaaaaacaaaaacaaaacaaaacaaaaaattagccgggcatggtggcacatgcctgtaatcccagctacttgggaggctgaggtgggaggattgcttgaacctaataggcagaggttgcagtgagccaagatcacgccactgcactcccgcctgtgtgacagagtgagattccatctcaattaaaaaataagtaaaaataaatgttagttattgttgtcacgcgttggctggtagtctgtggtggtggtgctggtggtggtggtggtagtggtggtagtggtccttttggtttcgtttgttttgttgtttttgtattcccccccccccaaaaaaaaagaagaaaaggttgcatatcatcactttaaaagctgaagcagagcttttctaggccccacagggcctttccctgtaggcatggtggtaaactggtgtttagggacagagcatccttgagtgaggttggctgctgaggacagcccctccctatttgggaggcaagggagttggtatgataggagcgttactgggagaggacggtagccgcttagtgtgaagacttctccagcatgttgtgaaatgttcttgagtgacacattttgccctcctttttctgactcatctacctcatccttctcctttcctcccccgcgcccccctcccagccaaccctccatagtgtgctccaacactggcgatgttgcataaagggaaaatatggcgtgtttacagagagaattttcaagaagtgttaatttaatatgctaaagtgttcccttcagcattttacctttcttgttgttttcacaaaacagccaagactaaataatgagcccagggctgtgccctttggtagcgtgatagctcattacccactagcggcctccatctgccctcatggctgcatagggagccattacgattatgatggaaatctcagaagccattaccaagatgcaacagagggcctactgcagacagcctaatggactaatttgtaattgggagagggaaatgagttagcgagctggggccggttttgatgagagtggaagtgcgcatgctaaatgtgataaatgaataggaatgtgtgtttgcacagtgggctctacaagctttccatctctcctggggactggaggcgtgctgacaagccgtgaggagcgaggaggaaaggctcaggggaggcaagcaagattcaaggagagtagctaaggataaatcggtgaggaaaactaatggcagtaaaaatccaaggaaatgactgcatctgccatgaaagtagtaattaggaagcattcggtgtgcatgtctttaaccgttaaaatagggggatgagtagatggaaggctggggcggtggtgggccaagagagaagcccctcgtagagggctccgaagggagagcatcctcagacctggtggtctgggcaaatgctgcctgctcagaacggagccgagtccagaaacaccacgggcaccgcccttcgaggggcttctggaacccagcaatgggaaggcctagcaagctcacaggcagccattgtgcaaggcaaggaggccaggctgcagtgccagacctgcagaacatctgtccttggagggctggagagtcgcttcataagccctcgtgcccggcgctctaagctgaggagtgctgggcaccagtgtggctatggacagatttctgaaagctggcctttccttctgtttgtcatttggctcccagcatttcatctgcccagcctggagagtgcgccaggtgccctcatggaggccggggcttttgtttccactcacactgatggacctggtgaagggtaatccccccagtcggtctgaggccaagtcctgcttggagctgtcctcattttctgtttctttttggcattttctgtttctttttggtgtatcttctcagttctgtcccctaacctccaagccctggtgttctttctcctcagtcagaccttcttagccctgaaagctgcaggccaagccttaatgggcctctttttcccagcaacctgccgtcctcaaccctttctctggatctcacttttcctcatgggccagcctgaattgagcctcaggatcgtcctagctctcaggattcctcctgctcccaaacattctcatctcttttcctgggaggacctttcagccttcctaaatagcctaagggaagacgcgtatcccttcagggaagaaggaagcactggaaccaattaactgaaccccagcccagggctcttagaaccctttcccaaggtgagacagccacgtagctgactctgcctgcagtcccacctctgtcccacgggctcacttttcccatcacattccctagtacacaggaaaagttcccattttcttcaccaagcactagaagaggtttctaattagctccctaatgggatgatgacagtcctgttcagcaaaattttattgtcagcctatttgattgattatgtgagtgattgatcccacctactttgaaaatgaatttgaggaaaccaacaaaaaacacagatacattgagaccccaaagcaactcattctgggagaaggcaatcaataaatacaaaaggcagaaaaacattctcaaaacatagtacaaattaaagaaagttattgaaaaaacacaaatgcggttctgctgtgacaagcagtcatagaaaaggaacaactggatgaatgtcatggattaacaatggaagcatattatttaatcaggggcaactgactttttcccatccagtgtccgctgttaagtatagcattggttatgtcatcaatatccctaaaccaagagcctcatcatacagtcccatcaatgttgtataaaagacctagattttctgtgtaaaggtattgcttagatatccttcagtaaacccccccagaatgtgtcaacctaggacaaagccgtagagagacgacaaaaatcaggttcctgctgtgcccaagttcccactttagtgacgtagagatttatacttgggtaactctaattcagttacacagacagtaacaaagcatttagaaaatgcacaggaggacatcatcaacacatttgacaaatgtttcttgagtacatcctgtgggcaggcactgagctaatcactggagacacagcattaaataagtgggagaacatggcccatatcctcatgaagcttatgatgatcgaattctgacccaaagaaggtatggtgtgaggggagtatttgagctgagctgtgaagctagaagttcattagaaatcaacaacaatgagatacccagcaaaaccccaaatatttagaaattaaacaacatatttctaaaaaatccatgggtcaaagaggaaatcacaagagagattagatactattttaaactaaatgaaaatgaaaatgcaacacatcaaaatctgtggcatgcagccaaagcaattcctcagagaggaatggttgtgttagattacattaatagaggaatgcttgtattagaatagaggaaaggtctaaaataaatcaaaattccaccatgaggaggtaggaaccgaagaacacagataaacccaatgtgagaaggaaggaaataataaagaaaatagcagaaattattgaatagaaaacaacagtagagaaaccaaagccaaaacatggttctttgaaaagattaacaaaattgagaaacctgtagctagaatgaacgagaaacaaataataaaaaaaagaacacaaataccaattcaccaagaatgaagaagatgttatcagtgcagatcttacagacattagaaggatcatcaggacaggagctcgacaagcagaggggaggtaacgagttgctagttctgtgtgggtttgtggggtggagagaaggagttgccatagcaggcaggagctgaaaagatgtgaaccagaattgttggtttctacagtgacccaggacctgtgtacacagcccagttgactgcaccctataccagcagagttcccaccgttgagtggtggtctaatgtgcatgttagaccatagatgccgagactgacaggtcaccaatggaccataatgcttggctttcagggcacctggacttgctcaaaacatcgttgagcattggccagtaagtcaatctgatagatctgggtccacagcccctagaacataggggactttatttctccctgccaacttctggcttctgatcattcagtctcatggatatcaaaactgacctgatgccatcctgaggccatgatatcatcctttccacagtttatatgcttctgaaaatggagctttctttttaaaagattaagtctgaatattcatggcagaagaagcttgccaaagctggctgctcacctccagctcccaagtcagtatcagcctgccatggcttattccagacccagacaacatcaagagagaaggcgggtgtggcatgggccagtttcatccactggtcacaggaccggcacctgtcagccatgaggctgtagacagggtcctaaagtgcaaagaaaaagctgtcaaagcttagttttctccccctgctcagatgtttacctggcaggagtgcctgccgtgtctttgtgtcattgttgctctttgtgcaactggccttccttattctctcattatcacacactctctctctctatctctgtctttcatctgtcctattattcatctgagtgtggactcaaaagaaccagattctgatcctgggcaggctccctttcctttacatatcttaatgtgaccatccataaaatgagggaaatgagagtgccatctcataggctcatggcaagttaaatgacttggtgtgtgtgcgtgtgtgtatacacacacacacacacacatatatacacataatatatatgttatatatacacataatatatatgttatatatacacataatatatatgttatatatatacacacaatatattatatatacacatatatgttatatataatatattatgtgtatatataatgtatatatattgtgtgtgtgtgtgtgtgtgtgtgtgtgtgtgtgtatttttttgagacagagtctcactctgttgtccaggctagagtgcagtggcgcaatctcagctcactgcaacctctgcctcccaggttcaagcgattctcctgcctcagcctcctgagtagctgggattacaggtgcccagcaccatgcccagctaatttttgtatttttagtagagatgcggtttcgccatgttggccagactggtccctacgtcctgacctcaggtaatccgcccgcctcggcctcccagagtgctgggattacaagtgtgagccaccgcacccggccaaatgagttagtatattttaaaagcactcagaccagaacttgacacctaggaagcactagatgttttaccaaatcacaggcctaggtgtggtgttcttcagccttcctggcgcctgtgttcctcaggctgaccacgctggattcctcttctgttggaagctcctccaccccacccctcccagtggagacctgcctgcctcactgcctgcaggcagcctggcccaacagctgcagtataggcacagggggcattgctcaggggtgcaggtgttccctaaccctaagttgagacctgagggtctcattaggtcctccaaacttccaagattgtatacttaatgaattggagggtttcaccttcccccaaatagccattgagcgaatccagccaccactcccgtcaggtcctggctgttcatgttgacactgatgctggcgagaggggagtatcttgaaagggcagaacaattggggtgaggatggggaagaaaagggagaaagagatgccctcaggtggggaatttaatttagtcacatgatagtagcatcaggcacttgtgttttacttttctcagaacattctcacatgcattctcttactgtatccttaccacaagtctgggagctagctgtggccgaagtgggtattttctctagaaacaaaagagctgaagcctaggaaggctgaaggacttgctcaaggtcatgcagctacctagagacaaagcggagaccataagcccagaagtgctgattcccagggctccctgcaggggatcatgtatagagagtcactgtgaactgctgtctgagcaaactacgtgaccccctcttggcaagacgaaaggccttggcttggagcaagatggatggagaacactccgggcccacactatgctgttttgaaactgtgccagagaagaggagtggcctggaagtgcagccccctctgttgggtgtttctgagaaagtgtttttctcctttgctggatttaatgaataaattataataacttttgcgtttttatccacattatgcatgtttatctgcccttcccccgtaaaccccctttcccacttccacgtagtactatatttcttttcatgttttatctttgggaacttgccactgataattatttttttaaaaagctcattcctagtgattgctggtaaagatgcacacctcttcattttctaaaaatgtatatgctcaggaccaaaaattcagggaggcatgtgtgggaaaaggtatatttccacttccaaagagagggtactttttcagaagctcagaaaaggaaaggggaaaatgttatatgagccctggtggtatgtgagctccttgggggaatacatggttgtcttatctgtctccagctctttgaatagatcttgcatgcagtagcatgtgagtacattgatggaatgcatgtaccaaggagcagctggatggctgatgggctggatggctaagtgagtgcatggatagatggatgcccaagcaacaaagtgaaacctcatttggcttgttgtgtcagagagccttcttaattactactctggatttcactgctatattctattctggccaagtcttggaatttctttatgttctaggtgggaaaagattacttctataattcatcaaggaaaatactaacttgctcccccagagagctgggggaaaacacattaatataaatataattgaggagtggaaacaaagtctaggaggagttaaagcataagtatcagcctggatgtgaattctaatataggaattagaattcctatattaaaaattgtattagaaacctttactttcttgtgatttctgttagttcagtaagtaacctttcttggaaggtctactaattcctttcaaaaaagatatttattttatatcttactataatatactaagcactgttattgctagggtgttttgaaggggcaggagatggtatttaaaactgagttgcagttctaggcagttaaataaaatccactgaccagaaaaaaatatgtaaaatgataaggcaggataagtattcactgccaaaaagtcaacaaagaaaatagtaaggatttatgttcagcaatccctgagattaaaatttaaaataaataaatagggatagtacgatttgaaatcggcgtcctctttgaactaggaattcaagactcagaataaaatggtccttttcattgcagagctgatctttgtgaccaacatcttgtctccaccaggaacattttagttgagaagcaggagaagtcattgctaagaagcttggattttcaaagaaacagatatcaaattgagaaatctctactaatctttcccttcagagtctaggcttgggtattttttttttcaaaactacatttattttacagataatcaagactctgacagagttttatgtctttttatcactctttatcttgaaaagcattgttggcctaaggttgaatcagccaaacactcagcctcatgaagagcttgtctggggcccatggcgaggaaaatgccagaatgtaagtgctttagagacgggagccataattgcaatgagaaggggagctgtggctggctctgactgccctgcttcccacattttcttttaacgagtgtccccacgtccccaccgcccctcccccccgacactcagatcccttcagttcccactggctgccattttcccttgctctgcagcctccaactccactccacttaagagaacagactggagactgctggaggccctgaagtgatttattgcttagcaggaacttcactaaacttcccaagttgattttttttagttttgaaaatcaaacaaagttcaaaaagtaaacatcacaggttgacatcccagcccaaagctgaggaaaaatgtctcttgttacattttttggcacataatagaatttatgagcattttcagtgttttgatttttttccccagtcactgttattccttaccctccagagttaggtgtggagagattatgttggcctgtttccatggtgacactgaagaaaagtaattttttaaaggaggtttctactgtgttatttcacatgcatgaaacatcaacatctatgctgtgtggctattacccctaaacataaagacacagaaatggttggagtattttatataaatagacaagtagggtgatattttccttggtctcgtgccgaccctagtaacaaaagtctctcagttacccagggcacctgggagagagtgagggaacagttctgttcagtgttaagcaagctcctctcctgtgaataaccttttctttaaaaaaaaaaaaaaaaaaaaaaaagctcaagttgaaagtccaccccccttctacttaaactagggaccagatgaaaagttccttttggggctcactgttcaaagaaccaggattaatctctgttttcgatgtagcttacttggtcaaccactgcaagtattccccttatctgtccaaggcgttgtctagaatcttcttgccccagtaaacagttgcttacagtctcctagagtgaggttggttagggtaagtatatacctttagcagcagaaatttggtgaaactctttccgccaccctacacatagacacacaccccccgcacatgcacacgtcacatcagcatcaatcacacaccccactcacacacaccacgtacacagtcgcacacacacaccccacacatgcacacgtcacatcagcatcgatcacacaccccactcacacacaccacgtacacagtcacacacacacacaccccacacatgcacacgtcacatcagcatcgatcacacaccccactcacacacaccacgtacacagtcacacacacacacaccccacacatgcacacgtcacatcagcatcgatcacacaccccactcacaccacgtacacaaacacacacacgccccacacatgcacatgtcacatcagcgtcgatcacacatcccactcacacacaccacgtacacagtcacacacacacaccccacacatgcacacgtcacatcagcatcgatcacacacaccactcataccacatacacagtcacacacacacaccccccccacacacatgcacacgtcacatcagcatctatcacacaccccactcacagacaccacatacacagtcagacacacaccccacacatgcacacgtcacatcagcatcgatcacacaccccactcacacacaccacgtacacagtcacacacacacacaccccacacatgcacacgtcacatcagcatcgatcacacacaccacgtacacagtcacacacacacacacaccccacacatgcacacgtcacatcagcgtcgatcacacaccccactcacacacaccacgtacacagtcacacacacgcacaccccacacatgcacatgtcacatcagcgtcgatcacacaccccactcacacacaccacgtacacagtcacacacacaccccacacatgcacatgtcacatcagcatcgatcacacacaccacgtacacagtcacacacacacacaccccacacacatgcacacgtcacatcagcgtcgatcacacaccccactcacacacaccacgtacacagtcagacacacacacacaccccacacatgcacacgtcacatcagcatcaatcacacaccccactcacaccacgtacacaggcacacacacacaccccacacatgcacacgtcacatcagcatcgatcacacaccccactcacaccacgtacacagtcacacacgcacacaccccacacatgcacacgtcacatcagcgtcgatcacacaccccactcacaccacgtacacagtcagacacacacacacaccccacacatgcacacgtcacatcagcatcgatcacacactccacgtacacagtcacacacacacacaccccacacacatgcacacgtcacatcagcgtcgatcacacacccctcacacacaccacgtacacagtcacacacacgcacaccccacacatgcacacgtcacatcagcgtcgatcacacatcccactcacacacaccacgtacacagtcagacacacacacacaccccacacatgcacacatcacatcagcgtcgatcacacatcccactcacacacaccacgtacacagtcagacacacacacacaccccacacatgcacacgtcacatcagcatcaatcacacaccccactcacacacaccacgtacacaggcacacacacacacctcacacacatgcacatgtcacatcagcgtcgatcacacaccccactcacacacaccacgtacacagtcacacacacacacaccccccacacacatgcacacgtcacatcagcgtcgatcacacaccccactcacacacatcacgtacacagtcgcacagacacacaatcacttcttgaggcttcagacaggttgctttatctagggcaagtcaaagtttggaaacagaagaggtcatgatggattgttgtgctgtttcccttacgtgtaaccatggttagactttcttgttatgtaactgagaatacttggtttttggaaaataaaatggagagcactgctttatcttggagaataatatcctcatgcatgtggagaatgcctttaacttttccaaggttcttcctacatgttatttgaatttcctaataattctgaaaggtagattttcttggcattccccttattttaaagctgcagggacagaagtttgcgttacctgttcattaggggcatagctgagtcagggattctggaccctcggttttcgctgaggtcctgtgttattaatcctatacttggcatcttccacacagccagtctgagaaagcacagggcctgcagcttcctgggacagggtctcagacacgcagagaccatcaggaggagttcactctgctattaacaaatgtttactgagcacctgctacacatcagacactactccagccgcaatagtccaaacagtcaagaatccctacattctatgagtacaagggaatggtgagtgaatgagtaaaacacataatgcatgtgtcagatggtgattagtgccaaggagagaaagaaagcaggaagaggggtagacagaatgctgggagtgaaaagaagtgggaagaggtgttattgaggggtgacattggaacaaagatttgaaggtgctaagggagcaagttttgaggatgtctggggaagagaagtccaggccaacagaaagatcaaggagtgtggaaaccggcatgcgttgccttcctgaaatccacagagccgcatactcattgcatgtgtgtgtgtatttgaaaacttcttaaattctgaggttggtacatggctttaatttttgccttaatggcttcctgcacttggggagctctttaataggtgcattctggtagtagtaatcatcagtcctgggctggtatcacattacctatgtggaaaaaagcagaattgctttggcactgattgggtcttggggtggtgactatgttttcctggtttttaatgcagatcattgaaaacatgtcagggcctggtctcaagtgtttctcttaaatgggatagaatcatgttcttataagcagagggtgtaggaagggactaggtggggggttggtgggcagaagggttcttatattttaaatgccagtcagctgcaaccactagttaactggagcctgttcaaactcatttggagaacagttgaatttttaaagtgccttttgattctctctttcatttattttaactgatctgctgggattaggagcttggtaggggaacaccagaatgcttgccaaaatgtgtgaataattagagctgcgatgatgtgtgccagatagaaggggagtattcacacttctgattagattcagctaaatgcagttgtaaatcactgctgccacagtaacagcgccctgtcaggactgagcacaagaggaggctcagggcagtgaagagacgcagggcagccccaaggcatggggctggaccgaacctttgtggaagaggagggcaaggagaatggctccagtcaccagcagcccctgggacattggttttggcatctctctttcagctcacttctaccgtgttgagtcttgctgggcactgaggtggccaccatctcagcaaatgcgagtaagacgggtccctgctctcgggatgcttacagtctcacggaaggtgaatgcacaactgtggttcagtgtgatgcatgtgtccgcaggacagacattgtgctaaagggtcccagaggaggaattgggcctgctgaagggaaaggagaagggataggtggaaaggcagttatttccttcagagataaaagttgacatttcagagtgctcagcaagataagttagtggctggaggagttccaggcagagggaacagcacatgcaaaggcacagacaggcaaagccccacccagtctaagagtgcagtcctccaggatggccggggaactgggaacaacatggaagaggctggcggtgcaacttggaaacactgcaaataggttgggtcagaatgtgaagggtctcaagtgctcataggaggaagctcttcttccaattacgtaccactcccaagatcccagctaccccttggagagggtgggtttcccacctcagccagagaaccctgccttagccacagtcatcgatgggaatgtgttagtattctttggacaggagaaataaatgttgagaaccattgctctcaccagtggagagtcttaggaggttaagaaggtgaagaggaactataagatggttaagttaaaaagaaaactggcagaagctttggtgtagaattgttagtttacagcaaggtaagtctgcaggctcccagatgtagataggaggttacagtcaaggtctgaccaaatgatagaatccatttcaagagagatttcagagtggaatccagtcagacttgttgaggaagactccagctgtgtgctgggtttcttgctcctttctgaaccatccttgcctgatcctgacttttctgtacgtgtggagtgccatagctcaagacacgatgtccttcggaaaatagacagtgagtgtatatgttttacagtattgcccaagaggtggaatcctgtcatttcctaatcacaactacacgtttcctccctctccagcactgctctgctccctttacctaaggttgctaaaggtactggtggtcttcaaaaaaaaaaaaaaacaaaacaaaaagcaaatacccacctcttactcaggacaccccagtcagtggatgccttctctggcccctctcccgtcctgttcttggaaaagcagcctactttctctgtcctgatcatgcaacaagttgctctgaaatgaaccagcagcttgtggtgggaataaaagcccaggaaaaggaatgcagaaggaaagtgatggaacggcatgaaacccaaagcaattgataaaaatgagcaccacatggagaatgtggaaaggagaggcaagcataaaaatcacaaccacatctgacatctctagaaatggagagagacaaatgaaatctcacatgtggctttcctcaagtcagaaagattccgcttctccattcaggggcgggatgaaggagcctctttggaagccgtgggcctttctcaagttgttctaccacgcctttcatttctcccgcttcagccagtaagttcaagtgcttagagaaatgcttagcctctagcaccttctccaggcacaaaataatgggttgaccaaattgataattttttttttttttgagatggagtccctctttgttgctcaggctggagtgcagcagcatgatctcggctcactgcaacttcagcctcccaggttcaagcgattctcccgcctcagcctcctcgagtagctgggatttcaggcatccgccaccacgcccagttgatttttgtatttttagtagagatggggtttcaccatgttggccaggctggtctcgaactcctgacctcaggtgatccgcccgcctcagtctcccaaagtgctggaattacaggcatgagccactgtgcctggcccgaattgatacctcccaaagtatgcatgaaggacaataatttgagatatgaggaaaaaatctaaaatgactttttctacttatttttatctcacctattcagatttatttcgtgaatgtgtattttagaaatacattagtatactggtatatcattaagcatatcaataagtaaaaatatctcgggcaagttaaatgagttatttgtctgtttttactctggggggcacatgatcagaatgtgtgaggactgggagagtagttagcagtgtcactagctgaatgtggggccaggaagaatgctctagaactgtgagtccttgtggaaacaggggcattaactggatcggctgcctccttctagcctatgagatagcctgttagcttcccttgtagctcaaagagcccctggaaatcagtagtcagaacccagagaaagggaagttctacccgtaaaagagatgcccatgttttcttagctgatagtcactttgcagagccacacccacaggtgacaaaagcacagtggaacttaccctcaggccctttcaccatcacaggcctctcttctttcctggttttgtcgttgggtaggggtggtggtgttgcctcccggaaccctcatccaggctacatgagacatgcagacatgctccagtgtcatgaacctccccctcaacagctccttcccccctttctccacaacacaaacaaaaccatcaaactccatatgattgttataatctaactgtggagtcaggaatactgtgctgccctacgtgatgctcttttcatttttgcagccatctagctttcttttccccctaccccagcaacccacaaacttaaactccaacctagttcaacctcagaaatcccattaatgtcttagaggcaggtggcctgaggagcccttcacttctgctgtcagctgtgtctccatggctcaggaacttaccctcccacccagccaggctgctttccctgtcaatagcattctcattccctccatgtctgttagaacttgaccattagtcaagctgttcctgagatgtgtctcttgtagagatgtacactggttagaaatggaagcacctccgtgactttcctctccctgtcatggtgacagcagtgtgacaggtttgacagttccagtttctaggacctccagctgcaagtgctgcttcgaccatgtgcttacgaattgcttcaggtccacctcgtaccctttccctctccagccatgtttatcttggctccgtattaatggcacaccttctgaatgttggacaaagatagtagctcttgtgtaagaacacactatcgacagcaaatggaagatgttacactttaaggctgccagttgtccccacttgtgccatactgaaataggagatggcctgcatctgtttgaaagaaattgagtgaaataatagttggtgagtatagtcctgaaggcagtgaactgtgatggaatcaaggatctcttcctgttagagtgacttttgcccaccgcttccagtggtgcttgtagaacttaggatctcaagaatattttgtgtcccctgcagaaaagtagcaatgcaggttgttcacatccagaggtcatgactcccaacagactttgtttatagcagcccaggctcagtgaggtgtatagtgggaagggcccagtaccacatgggcagagaagcactcattaacttcctacctggttgtaaacattagaaagttcccattcagaaaagtacttaacagcaaatatcacagctatggtatagtcctgttctgaagcggatgtgttttacaggtgaagacttcaggaaaacagccaaagaagatgtgatcttccaagatatcatgtaccctccattgtttgtcagtagaggagttttgggcatttagggtagactcctcccacacatcacaaaacacttagcaacactgctttgcccattaaataccagtatctatcaccatcaccttgactcctgaaaaacagtcccacacagttgcaagtgctccccagggtggggaggaaaggagcacttctccagagggagaaccaggggaaacgaggtagcagcacccataggtgtgcctgtgcactgggtgcagctagtcggttatttcactcagactcttgatgattcaacacattttggaaagagaaagtttgtccccaaaagaggcacctgactggcccaatccattgtcacatgttaatggctgtcacatgacagccagttgctggatctgtttatgtcaccaaatagtcactgtctaattagacttacaaattctaagtgtagcattagatttacaaagtcagtaaactgtgatgtgtgcctgtgttatctttcatgatctgacagatcatgtttgaaaattggcccaagctaggcccagtggtttgtacctgtaatcccagctacttgagaggttgaggtgggaggatcacaacatcctgggaacagagcaagactcccgtctcattttttttttttttttttttgagatagattctctctctgttgtccaggctggagtgcagtggcttgatcatagctcgttgcagccttgaactcccagcccaagtagtcctcccacctcagcctcccaagcagctgggactacaggtgtgcaccaccatgccctgctaatgttttaaattttttgtagaggtgaggtcttcttatgttccccaggctggtctcaaactcctaggatcaagtgatcctcccaccttggcctcccaaaatgctgagattacaggcgtgagcctactgcacccagcccaaaattgtttttaaaaataaggaaaaaaaaaaaaagaagaaagaaaaccggccaaaatgcagagaaaagtttgactatcaatgcagcattactttggttttattttacatcagccatctcccctccgctcaagatttgaggttgcttgttagttgaactacttggcaatgaatttgtcattgaaacaaaaattttgaatttttgaatatgagaatttcattaataagtcatgaattgtaagcttgggtgtgaaaatctttataatactttatagtgagacatttctcatctgtcgtcttgcaggctactgcacaggagctcgagtacatagatttgttgtcaattaaatattaaagctttataggctatttttatttccttctgcttgcattccttcctccagctcctaatagccacatgtccagtctttaaatggagccaggtttagagaggtctaatgaagagggtttactgaatggggaaagggcagccaccgtgaccccatatcacacctttgccacacaatcagagacctctgttgaagctattctggaaaagatctattcttaccagaagctgtcctgcgctgtcagtgaaaagacattaggtgcaggtgtcaaacatgactaatgaggcatgaggagtcgacagcaaaataacagagattatgggcagagaggacttgcagatgaaatgtgaatagcagtgtagatgtgtgagtgatgcaggaaggaaggggaccggcaccgaggagcagtagctgtcccacttgcgggaaggttggacaatatcagttacttgattggtatcttctcctttgatatattaagtggacaaacatctaatgttttcctctcgaaatcatgagtttcctgcaagtgtttggggcttggtatccacgtttctgtaatcttctaagacaagccagaatctttttctgtttttatatttacacaggttttattgtgaaattgtcaggaaggatgaggcatgtttcactcattaattttcattgtcatcaaaacatcagagttacagtgcagtatcctgctattccagggcccacaggagctctgattgataacattctaccttcacaaaggttgtaatctaaatggaagaggctggaaaaagaaaaaagtatgattagttgtagttgtgtcaaaagctgcctctgaacagaccaatacactaagcaatcagagatttcaagagaggtagcagggcctgagactctaactcagtgaatcttgcttcaccagatgtggagtctgtctttggtggtttcgcagagcctggccctgagcctccatccactcagcgctcaatagatgactgtaagcatatttctatgcgttcattagcctcagggaggttgatttttacctcctagaggtgaattttaaagacttcctttttggatgagaaagagaaggctggtagagaaggaggagcagaagcaccatgaaatcaggtgggtgatggtttcctttcctggtgcttttaaccagttctcccagagtggagataaacatgaagttaatatggggaatgttgatcttcctaaatgcagctccaaatgatagacccaggacaggtttccaaacagctgttattcagattagaggcaaggacttgatgtattgctcccattagaaagtgtcctaatggaaagggcctgcactttctcctggccccatctgaattaaacaattggagtattttaaatcaagggtcataagtgtcaacaagatggagagctttgcctctcgattaaaagaggcttataagttacttaggaagttcctgccgacacagattgcacgtggctcctgtgaaccgtggttatacccaggctaagtccagccgttgtcctaaggagggagcaggccacctcagacagaaaatgcagctggagaatttaagtctcacatgccaagatcctgctaaccagagggtttgggggaggtaggacctttcatgtttctctgccaacttgtccccaaggtagggaccacaatcctggcaggccgggatggggaccaaagtggcacttgcctttcataacatgtttgtgcttgtttccgtatcagtaatgtcttagctccttatcaggttaattacccaccccttctttccaggctccgagtagaagtcatgctccaagaccaggcgctggccttgaacgtgatgcctcctcctggtttgtaccttgtttgagatcatctcaggcacagagcactggaacacggggagccacgtgatcccaggtgcaggctgagccaagcatgatccctggggtgtctttttctcccctgggactgacattaaaggtgcaggagccaatcaggatcataacagaaggtagaagatttccccagattgagaggagaggagagaaagagcagggcaagggggtggtgaggagcgagagagcagagcccgaacagcagtagcgagggcaatgcatctggagctacaaggacagacgtctctaggtagatgcccttatggcagcgcttctggagagagaagaaaatcccagtaatattaacagggctacaacaaatgaaaattggaaaataaacagatggaacatgcctcatagtttagcttttatcatcaataattctaaatctgcaagtgaatatggctaactgtagttcaaaccatctgcctattactgcctctcacttgaagagactgtgttgcatcccactctccaccaagactgagaggaagggagggagggagagggagagagaataattattctcagctgttctgtcaaaacagacacgtgctccgcgcccagcgtaaaggtcaactgcagatacaccatctatctctggagagggcagccagcagtcccacgctgctctcctgggcttgtggggaccccttctggctgcccttctgagttcaaatgtaagcgtctaacaggcaggctctgttgtttatttcggggctgagattcagcagtttcttatctatatgggggaaattaatgcaggtacatgtatggtgtgtcccaacctactctgggccatgtggagtcccctctgtgcctttcaagtcttctggaggctcatctggggtccagaacagtgctgtgagagatgaaaggacacgagtgctgtcccagcgcagagagctcagaatctggggaagcctggctctccaagacagggaccactgatgctgagtgagcaccaacccaaattaggcctggtcttcaccaccctcttttggaaaatgaacattttattcagaaggcaatatggtaagaaccttgaggaaataagtgtaaattgtaaatcagccacaaactcagttttagcctaccttgccttgcgtattccctcttgcaagactaaccagagaaacacagaatcaagcctttatcatttggtaaattgtttcatcaagaatactggcccaagcatggtggctcacaactgtaataccactgctttgggaggctgaggcgggaggatcgcttgagcctgggagtttgaggccagcctaggcaagaccacatctctacaaaaatttttaaaattagaaaaaaaagaaagaataccatatctgaggtgcagatgagtgtgcaagtaattctttttgttgttgttttaacatgacaacagctggcttttttatggagcttccctgaacattaaaaaaaagtaactaaggccgggcgcagtggctcacacctataatcccagcactttgggagactgaggtgggtggatcacctgaggtcaggagttcaagaccagcctgaccaacatggtgaaaccctgtctctactaaaaatacaaaaattagccaggtatggtgacgggcacctgtaatcccagctacttgggaggctgaggcaggagaatcgcttgaacccaggaggcagaggttgcactgagccaagatcgcaccattgtactccagcctaggtgatggagcaagactctgtctcaaaaaaataaaaataaagaaaaagtaactaagacataaaaaccaacccaaaataagatggggcacctgaaaagtgtatgtgtacacatgtgtgtgtgcatgtacctcatatgggcaatgcatgtgtggacacaaataccaaaaatattccaaagacttaattttttaggtgttgactactgtttgttcatagcccaatggtgttaacaagcagtagattgttagtgacaatcacactctctccagcacttacagcagaaggcttgatttaatcgaagagctgtcatttattattctgttgtgcaattccatgggggtagctaactgatcaagctcgggctacggggagcagagggcttttttttgttgttgttatgtctaaatcctcaatacaaattacagtatttctggactcccagtgggacccattagagcctgtggggcattaacgatcattaatagtgctgtcaaaaaggaggggggtagggagagaaggaaagaaagggagggaagtgaagaaagggagggtgcagaatagtagccagggagaagtgtggctttttttcagaaatggaaaattaatacatctgctttgttcacagtgccgagcatttgatgtttattaacaggcatcttaattttgcagattagtaccagtcgggttcttacttccgcatattgaaatccttccattgcctcagatccttcttctcttttcctcatccttcctccgccttcccaaaatctttctctccccagtagtcagtcctgaatctccaactccaacaatgaagacagaaagggactgagaaaatatgagtggggagagtgtcttcattcagaacagagtgtgtgcgcgtacatacatacaccacggttacagccataattggcaatcttgcctgtgatatcccattaactgtggttccttgtaagcatttaactgtatagttagtaatcaggtagaaatgttttaatcacttactaactagcatgcttatcagtgtgatggagaaagggcaaggtattaattagttaggataacatgctaatgtttgcattgtaacacttctgctatttaaagcaaggaagaccctgagtttgagtcttattcagaactgaagcctttttctagaatttttgttctctccaaattccatatctatgctaagctgacttgccttttgcctccctatggttgcatacttttctcctttcattatatttttcctttcagtctcggactcttgagatctagtcttctacatccatgacattctcaaaccacagaaaggaattttcccacaataataataggtgtgcattacactttctttcttcgcagcaataagtgccattacttcattcaagtgttgagtacctgtgatgtgctgggcactgtgcttgacacagggaatacagcagagggaagaaagaaccaaggcaccattcctgccctcatggagcttctgctatggtgggagagagacttgggaatcccataagtccatttagaatcacagccatggtgtatgggagaggcattgggactatgagagattataaggtattctgacttgggaggaaggttgggaaagtaccctacggaaggtacagttgagcagatagaaaagaaaaatagattgctgattactttgttccaggaaccatgttaagtatttttccatggattatttcatttaatccttataacagttctagaatatagggaggattctttagtttacagattaaactaaggtttaaaagagaatgagctgctgcctgtctggcccacggtataagcctactgcatagctcattgatgaatgaaccccaggtatggagaatttgacccttggatagtaactcttccatcttctctttttcgtgtcttttgacatttttgagcatagataaaccaggctgaccaatgcagccattttactctcatcaaggactcagaatggtgtgggtactgtgcacttgtttgagacaatgcccttccttgctgatagcttcccgaattgagcaaagcagatacaaaaaaagtgagcaagactctcagcctacaatctctagtgtggaagaaacaccctatttctttgctttcttacatcaacttcattttctacttgaaactgtaccccctaaagggaccttgcacttaagtcgttcccagtgcatcctacatccctagagttgtgtctgtgttctgtgtctttttgccaagggatgttgaaggctggaagtcctctaggtcttaggtcccccagatcactgtgggaagaccccacatccccatccctgtgagccaccaggagcctggtgtggccatttctcctggggccttgcttcctcctgtgagccattccagaatagggtgtggggccctggtgctctgacagccacagcttcctctgcttctccattctgggtgaatcttttccttagcgaagcccttccccatatcttaggcactacaattctttacttaagctctcttaaactttatctttctcattccattagattttcatggccattgaacttagcaactgaagaaaactagtttccctttcctatagggcagagagagctttagtaaccaaatgttcctaggaggagtggggaaacatttttattttcattccagtaacacagtggttctcaaagagtggcccaggtacccaagggggatccccaagaccctgtcaggagttctccaaggccaaaactattttcccaataataagacattatttgcctttctcacttactatcattctctcacaaatacatggtggggtttgccagaggctacatgacatgtgatttaaaatattgaatgcaaaagcaaatatgagaatccagacatcttctataccagacattaaagaaaattgaaaaaaatgtaaaactcactaatttttttgttttgaaaaagttatttttataaaaatgtatttaacaggtaataggtttattgttatttttaaatgaataaacattttacagttttctcagttttaatttatttatttttatttatttatttatttatttttgttgagacggaatcttgctctgtcacccaggctggagtgcgatggcgcgatcttggctcactgcaacctccacctcccgggttcaagtgattgtcctgcctcagcctcctgagtagttgggattacaggcacccaccaccatgcccggctaatttttgtattttttgtagagacgaggtttcgccatgttggtcaggctagtctggaactcctgaccttagtttatctgcccgcctcagcctcccaaagtgctgggattacaggcgtgaaccactgcgctcggcctttaatttttaattagcatagcaaaagccttttggaagttctcaaaaaaaaatttaagagtataaaggggtcctgaggtcaaagcatttgcaaactgccacagcagagcaaaggaagaaaagaaaaaccaaacatcagatttccagacgaaatccaccatgccacaccggcaatttccaaatgcggaaactggattgtgtcatccagtgagagaaactgttacttggatactttggccctacctctcttattttttttttctcaaatttgaagagatcataataaaacaacctcctaaatctaggtaatcacacatcccagtttccctgggacagccccaacttctatatgccctttgtcctgtcataattttttatttttatttttttcattttaaactttttttcattttctttttttttttttttttttttttttttttattgagacagagtctcactctgttgtccaggctggagtgcagtggcacgatctgggctcactgcaatctctgcctcccaggttcaagcgattctcctgcctcagcctcccaaatagctgggattacaagcatgcgccaccatgctcagctaatttttgtatttttaatagagaccaggtttcaccacgttggccaggctggtcttgaactcctgacctcaagtgatccgccttgccttggtctcccaaagtgctgggattacaggcatgaaccatcacatccggcctgtcctgtcataatttttaagtgttcccactttcactcttcaaagtgtcctggtttgattgataaattaaaggtcagcctacctgaaccccacccaacttcatgagcttataaatgacaaagtaaatacaaaatttctatagtccagagagtcaagaaagcatcccatttggattgactggctgggatgtggcagagagcatgcatttatttgtctgtgaccttttcctgtttcagctgtgaatatgggtccccacgttgatctcagctagggagctgggtattaaccatcaaggcagtggtgaaccgggtgggcctcccacacaaaaagctcactggcaactagcaaatccagatggcgcacatatccatgtgatattagccacatagaggcctttgcggggctttttttggacattgctaagcctgctgagtctaagatttcaaatgctgttttgagctacttgatttagaggtgaagccagaccacttggagggaagtgtgaaattctttggagttcttcaactcacttgtgactctataaaaattacccgggggccagaagcaaggaaggaggtaacgcttcaagtggcccttctgcctccacagcacttttcagattagggagtgacaggggctgtggaaccgtttttccctcccgctcctcagtaggaaaacatcgaaacatccatactgtcagctgacatgatttggggtgagctttaaaggactaaaggactccccccagaaggctgaaatccttgttaagcaaggaactttcatctcaggttctaggctcaggagcatggaaattggaattctttttaattgaccatatggttagttttgcagctttgtgaagctataaatctttggtggagttgtaacccagcagaagtgtcaccagaggaaatttttttttaactttttcctcttgtttcttcccaaaactcacttaaagaaaaaaaaaaaaccatgcagcttttgatatatacacactggtgagtgaagtgtgggggggcagtaggtcttggacaagtgagcgtggcagggatctgtcaggcagatccagcagttccagccccattctgagagctcgcaatttagcttttgctggtgccagcaattataaaaggggcctactcagctttaagcactcaagtgttgatggacaaagtgctagtttaacagatctgcgtaatggggaacaggtggataaatacaggattagggagccctttacagtaacagccttattatcacatgttatgtggggtttttgccttcatttgacaacttgggttgtgtaaaaaaattttaagtaacacaacatagaggaaacccttcataacaaagcactgaaacaattaatcaagatttatgaaacctctgggtagtagtggtgtatcaaccaaagtggctatttctgatcagacccacagcctcctaaatgaataaatggagagcacagcaccagaagccacagcctccataagtggtacaattgttttccataattgaagatagcaaaagcctgtgtacgatcaaagaccattccattaggagagtgaggatgtaataaggggacagatttgagtctgcccagcctggaaggcatataatctatccccctgtctccaccacagcaaaccccactggtgaagcttactccatctcaaatggtggctgtaatccaccttttgcccttaggaaattgtattagtccagacctaacccccttattaagaggaagcacttttgccatagaaatcatctacttttctgtttccttttttttttttttttgagatggagtcactgttgctcaggctggagtgtagtggtgcaatctcggctcactgcaacctctgctcctggattcaagtgattcgcatgtctcagcctcccaggtagctggaattacaggtgtgcgccaccatgcccagctaatttttgtatttttagtagaaatgaggtttcaccatgttgcccaggctggtctcgaactcctgacctcaggtgatttgcccaccttggcctcccaaagtgctgggattataggtgtgagccactgtgcctggcccctttcttttaaatcaccataggatttattaaatgagcactgtatagatttgttttacaatttttaacctttatgtaaataatgtcctctcttttacccctttaaaagctgtttcttggctacataatatgttttggctgtttatctatatgagatagagctctagtttattttaactgctgtatattattttattatgtgaataaaccatactttattaatcctcctattggatatttagattgtttttcatttttaatataatgacgaagtccacagtcaaccattgtttctttatgccaaggattaggtttgctgggtgtgttagtctgttttgcattgctataaaggaatacctgagactgggtactatctaaagaaaagaggtttattcggcttatggttctactggctgtacaagcatggcaccagcatatgcttggcttctggtgaggcctcaggcagcttccaatcatggaagaaagcaaagagggagccaatgtatcacaggggaagagagggagcaaaagagatgccaggttctttggaacagccagctcctgtgtgaactaagagcgagaactcattcatcaccaagggaaagccattcatgagagttccgtccctatgacccagcacctcccactaggccccgcctccaacactggggatcacatttcaacatgagatttggaggggacagaacatccaaagcgtatcatggggtcataaggtgtgagcatcttcaccccaactgcttattgccagttgctctgcggtggttgaattcatgcgtgtgcctgggaagtgtctgagagttccctttcaccatatcttgctgaacattgactgtcaacagacattttaatattctcctgtgtgataaatataaaataccatctcactattccgatcatttggattttcccaattactagtgaaattgagcatctttttacacatttataggctattcaacataatatcctttgtccatatttttattgagttgtttatcttttttgtatttacctgtaaagctctttatatactctggatactaattttttttggttgtatgttttgtaaccattcattatttccttgattccctttattaagtaacagaagatataaccaaataggttggaagctatagcatatagagtcatgcaggtgatgctcaggagttaagagtctctcctgcaggcagtggggagccgttgagggttattaaaatgaggaataacatgatcagatttgctatagaaagaaaaggaaagcagcagaacagaggaggatggattgcagagaggagaggctagacggtggtgccaattaagaggcttttgcaagaatccaggagagaaataatgaggacctgaacctaaaccatgacagtgactcctaggaggatttccaaggatttccgggaactatttgagaatgggatgggcaatgctagtgagaattcagtggagcattttaatcagccctttcctattgattcacagagttcctttcccatcttgcctcggtgaggattgtttccatcatcccttggccactcaagtctacttaccgggttagagacttgttgggtctatgatgtccagttagatttcccttcaacgagacccagggggacattctgccagccattgacagatcttaattctccctttggctctcacttgttcccttcatgccaccttgtttgcctctccctgactctccctctctctctcttttctctttttttttaaattttatttcccatttttaaatcatgcacagtataatacaataagcattaaatcatgcaaattggtctaggttacattttgaaaaatgttaagaggaaactgttaagagaccagtttctgacaggcaatgcattttaaagttgagggatttgaaatatttcagcagtggacctaaaacagcattataaattagttcaacttatcagccctaaacagaattattcatcttccaaaagggtatttcatggccgctgggcccaaacgatcgttcaccttcatttctgccctgctctaagggtaggtctcactttactgaattctcctgattcattactgtgtgttactttatgaattttttatcagcattttaatagctctttcagatgattgaatgtaactgattcttgtagcagaacactgattgaacagagagacagtaatgtatgtcgtaggggttagcttcaagccaagcaacagagttttttacctataaagatgtgctttttctcccctcactaagagtctctgcagatagaagctgcccccctcctccttccacacacccgcaccttacccaccaggatttaggcaggaatctgccattttcagtttccggcatggtactgccagcaaagagagggaaaaatcagcccaagcctgaagcaccctctttttgctcatcaaaagtatgaaatgattaagatttcggaggttcttgggataagagaaagacattagactacctcagaccagcaggaggatggtctgtgggaagagcattggagtctgagccaagcatgaatctcagctgtcccttccttgctgtatcaccttgggttcttcgtctcattgtcctgagctttttcactttcctgtagatcagaataacccacctttcctggttattgtgaggattaaatgagaaattgtattagaaactccaggcacatcagaggcccctcaggaaatgtttgctacatatgaataacgtacacgaaagcacttgtgtggcactgtacaaatataacttattaatataagccacagtgatgcttgaccaagaaaagactttttataatactgtatgctaggttgaaccatatgagattctattttaatagacccaaaatggcaacttcatatggttcaacccaatattttacattgtttgatcatctgtttcctggttacaatgaaaaaaaaatgtgagggatttgtgtttgggtagtgggggaattatatagctataaggaatattagagataattaggtgcaattttctctcctgatgagaaacccaaggtccagaccacactggtagtaagaagtagagatatgagaacacactcagttcttcccaaatcccaggacttatgcagcatatcacacagccttcctgaataagggatttgttttcttataacaagtatataaccggacttgaaagagaatccagatcctcttcagccttgaccaggattctttcttctgtatatgctcacctgtgtacagcacccaacactggggaggttctcaagagggtttcttagacaactgattgacttcaaatggcaactagagagaaatcaaaatgagttgtagacattggtacatgggtttggtggtatcagataagtgaactgacacctgaatcttagctgcaaatcccagccatcatttgattcttggtgtgtcttctacctcaaaatgatacaaattggagttgacatgagtttttagggaatctacagaaccaactagagttcagtgttttggggcaaattgtatatacacatatatacaaattgcatatacacatatatacaaattgcatatacacatatatacaaattgcatatataatatatattataattaaataaaatatatataatgtattattacatataaattatacatgtataatttgcccagaaacaatttgtgtccagttaatgatagaaattgttcacttaatatacacatacatagtttgcatatgtatacatatgaatacacacacacacgatttgtgtccagttaatgatagaaattgctcacttaatcatttgtatgtatacatatatacatacataatttgtatatacccacacacacatacatgatttgtatccagttacattaatgatggaaattgctcacttaagctctgaaagtcatcaaccaatccagaaaaatacataaatggaagaatgggctggcaagaaatgagtggaagtgaaatgtcttatttggcaaatgaaaatatagccatttgggcagatacttactcatgaaatgctgataaaatacttgaatcaccaatatccttgtttgcttccctgtttatgtcaacatcttaatgtgaaatataattacaatgaacattcagaaacagaatggcaaagcctggctaaatttattctaatgtccattcttatgctgaaagctaggtctccaaatgtacttctaaaattattttttacaatatgtactttaataggattgcaggattgaaatatagcttttgtggggcaatcaggacgcaggggagaagttatatgaaagttgggtaaagattgggggattttatggctgattttcatgatcctgctaaatcatgtggtcacagtgggatgaatgaagaatgaacactagaaaaacgtgtctttttgggctgggtgcggtggctcatgcctgtaatcccagcactttgggagaccaaggcgggcggatcacgaggtcaggagatcaagaccatcctggctaacacggtgaaaccccgtctctactaaaaaaatacaaaaaattagccaggcgtggtggcgggtgcctgtagtcccagctacttgggaggctaaggcaggagaatggcgtgaaccaggagccggagcttgcagtgagccgagatcgcgccactgcactccagcctgggcgacagagtgagactccgtctcaaaaaaaaaaaaaaaatgtgtcgttttgtttgtttgtttgagacagagtctcactccatgacccaggctggagtacagtgatgctatctcagttcactgcaacttccgcctcccggattcaagcgattcttgtgcctcagcctcctgagtagctggcattacaggtgcacaccaccacacccagctaatttttgcatttttagtagagacggggttttaccatgttggccaggctggtcttgaactcttggcctcaagtgatctgcccacctcagcttcccaaagtgccgggattacaggcatgagccaccacaccccgccaataatatgtacctcttttcacccatgtagttactgcttatggacttttctccattaaaaaaaaatcaaaacactaaaagcctttatttacactgtttgctctttcttttacatctactctgtatcttcttcctaattaagaatagttgggaacctccagggtcaaatagaaatggtggcatcaacacggtcatagagaactctgatgttcaaaggacatggccatggaaaatcaaagggaagactaataaagttaaaggaaagtttcaggtttgttgggcccaaggactcctgaaaggataggattaatgtgttttttgagccaaagttctgcccttgaaagggaaatctcctctgagctttgagtagctggtgctgcatcctttaaaaatgtattggatggaattaatagtgagcgttgccacatcccttcttcccagcccaaccaagaaccagggaaccagtcattctgtcacaaaatgaatagaagttatatccaaatgccaataaaacccagttagaatttaatgtaggacataactagagtgttaaatatgacaaactaactttgagataagtctgagagctcaagttccaacagaaacaaaaccttttatggacaaatagcttcgtatctcatatgctactcccaacagctcatttagatgaataatacagattctgcattggatctgtattggatggaggaaattgagacatagagcagttgtgacttgcctgaggacacacaaagttagtgacactggcagggttctaccatatcactttacttaatatgagcagcttctacttgattgggtgttctgtcagctggccatgaggaggggcaaaggaagccattcaaggaatctgaattgccaatgaggctgttagctgagtctactttttgaaataacttcatcatgatataatttatgtatcataaagttgacccatttttaagtgtgcaattcaattagttctttatatattataaatacaaatcctttatcagatatgtgatttccagatgttttctttcagtctatggcttgtcttttcattttcttaatggtgccttctgaagcatgaaagttttctatttcaatgaggtcctctttatctctttttttatggttcatgcttttgctgttatgtccaaattcaaaggaatgttttttaaaaataagtattatcaagtcttgttctctctctttctctctgacacacatgcatacacacacacatgagcaagcttaaagtcctgcatgaccccagatttcatctggaataaaacccaagtctgttgctgtggcccacaaggtcttccctgatctggcacctgtgcctggtctctcctcagccacatgttccagcctcactggcctcatttttttcctggaaaacgctaaatatgttcctttctctgggcctctgcttttgctgttttctctgcctagaatgttgtctccagcaattcttgtagctggcttcctcctttcatccaggtcccacctttagatatcacgtgcatcatgatcacgccttagattattcaggagatatttattctactaaaagagccttcttccagccaataaaaaatacccttttaaaaatttccttcgcagtactttctgagattattttgactttttaaaaatttacatgtgagcaccgtggagaccttgtctgggtgctcactgcccctttcttggcaccttgagcagtgcctggtacaaatgagcggctgagtaagtatttgtggaatgctcaatgaatgttaaactgagaagcagttcagagatcagagtcactgtttaaacaaatcaggatcttcaacaattctttcctaatgagcctttctttgtcaaactcatttcattccaatcactcctgtgtttcccccacgcttggagaaacaatctttctggtgcttcctttcattttttttgcagatgtccttgcattggttcatattcttttcttccttggaagtttcccaccccaccccgaattaggaagttcctcagggacagaatccatgtcaactactttatcttctgtctctccatgcctagcaaatgctaggtgtttggtcactgagtagatgaatgaatgtacatccctgaccttcacccttgttccttgagtggagaaaaaagaccccaggctgtgtgtactcttcatttctggaatgagggttcttgtacatcccatcatcagctctcctgggcttttattctgaaggctagtggaggcacaactgcaaaagactttgcagatacgacgtgtgaaatgccaagaggaagaaaaattgaaagcaggagttgcatcttgccatgtgatgtgaatacctttctggcactatgacagtctcctcatggtgggcagtgggataccatgtgagaccaagcaagggcccaagtcacctgcagctctgagatgcctgcagaattctgtggaaaacttcccaaatgcacttagaccccagggttttgatgatgttgatggttctctgttcagttttttagtttctgtcaaaatgtattatctaaactctttactcagtcctacctacaaaatacactttcatatttcttactaatcactttactactgaagtaaattttactagttcacttttccagtggactttgattaggacatgagaagtatttgttggcacctataggcagacttagatgcaatgttttactttgatgccaaaagtgggggaaggccttagaccaatagcatggcgtttgttattttagtttaccattctccctccaaacggcccatttcactgagactggggctatcttgctgcagcttggagtcaaacacacatggatgtgactctgcctttgcctctcagagcctcagtttcctcatctataaaatgaggctaatagtacccagctgatagggctattgagaggatcacatgaaataacatatcagatgttcttattacagtggttaggtacagagtaaatacagaataaggggtagctttattatgaggatttatatgattattagcattattattgctatggctgcaaccagtactaccaagaagagaaatgccactcaagcgaggacaactcagtaggtgtgacgtttaaaccaacagagaaatcagtgcatttttacttatttatacctttacctggttccataaaagttttatccctgtttctaaaaagaatgcatcaaataaattgaagtgaacacagaaagaaaaaatagcaactaagaaaaaaacacagatatgggaaactttttttataatttcagctttcattttggattcagggggtatatgtgtaggtttgttacttgggtatattttgtgatgctgagatttgaggcatgaatgatcccatcaccagatactgagcagagtacccagtaggtatttctttagctcttgccttcttccctctctccactcctctagtagtccccactgtctgttgttgccacgttttgtccatgtatacccaatatttagcttccacttacaagggaaaatatacagtatttgtttttctgttcctgtattaatttggttaggctaatggcctctagctgtatccatattgctgcaaaggacatgattttgttcttttgtatggctgcttagtattccatgatgtatatgtaccacattttctttatccagtccactgttgatgggcacctaggttgcttctgtgtctttgctattgtgaatagtgttgcagtgaacacatttgtgcatgtgtctttttggtagaacagtttattttcctttgagcgtatgcccagtaatgagattactggatcaaatggcagttctaagttctctgaaaaatctccagattgcttttgctgcagaaaacttaaagatcatgtaattgccacaactgagcttcagattttaaactgagattcctggcagccaaggtcaacttcactacataattaatttaagaatgagaccgccatttcttcaggattcaaagctgcttctaaaactaatttccaagataactttcttacctgggactttatgcagtgaacagtattccaacaacatgttctcctcaaatgcaataacagattttttatggctgcttctggtagcacctttttgataatagcaaagcagcatggcattaaaatacaatccggtgacagcagttctgtgtggggctaaggtaatatggccctagtgtgtagctgtgaggtggtcagacttgatccagggatagaatgtagagtgttttgaagaatggttgaactgcttgtccttcaaataatcttttgtaaatattgcttttctcagcttgccttttgataggagttgaatagcagacagtttgagattgtattctctgacaaaagcctggtgtgtttgtattctctgttcctggtccagggcagagccttatgccttagaaatcagaagtgcaagtggtaaagttgacatcttactgtaaaaattggactcctgcctgaacagaaggccattctccctctccctaggtggagctgcaggaatacttgcaaacaaatctagactcctcttcaggaatcagtttgggggcgtctaggggtctagtgtggcattcagacttgctgccctgggccttattcagtaggtctaaactgcagtgcagcgcactctggttaggggtagattcagaaggtaagatggcgcaaggacaagctctagcctatagctggaaagtacaacgcaccgtgccccacagcaccctttgagagacacctgcccagcaggaaggaggctgcactggaaacatcacctgagcactccaggcgaaaaccggtgaatcagctctagagggtggcttagatctttcccgcctgggtttctcactgccctgccccaagcagtagaaactgtaattccttcacacaagtctaagcaacatgatttcttcataaacctggcagatcaactggctataaaattttctcttaagaaattaaacaaattaacctgttcagtgaagttattcgaacaaaatggttacatttggaggcaacgctactattttaggttgctgtagttactgttgagtcattctttctgaccatggatgccaagaccatttatctattgacactagtttatgtcaaggtctataaggaagaacttgtgttaggtagagagaaaataataaagcagaaaggaaccatgcagatgatccagtacaatcttcacattttccagaggcctggaagtatttcctcaaagcctgggggaagtcctgactctcccacttacaatggtcattattccatgtgaagactgtttccaccatatagttggtcaggtatgtgtattagggagagataaaataataaaatgaaggtggctgttggattccttagaatccaggggcctcatccacattgataaatatttatcttgttctaattaggacctacatgcctacattaactggtggaagagctctcagttgcattaagctccctggcagaaagaaatggcctggaggctgcttcctctcaagtgagaaagggtcttccaggactgttcgaacaaaaggcatcagggaagtacctcttgagtctgtcctgtgaaagtcaacccagtttcttggctttccaggcagcctcacattgccttgactattactccagttcattaaatgttaatgggttatcaatataggaagagtaatcccctgaagtccctttaatatgttttattcttcctctcaaataaatgattgattaacatcaataggaattgttcaatatatgctgtctgcaagactccttgctccttgaggctttctcctgtggtttatagcccagtgcagacgcctcgatgagatcttaaatagagagagtggtaaaagtttatgtcagctcgtcagtgaaatggaggtggggaaggatctaataagtgcactggcttgaggatgatggcattttcataaatcacactgttcttttccctcttggtcggtcctgcttgtagaatcatagtatcttagagatggaaagggccttgaggttattttttccagcttcccattcttcaaggaattccttctatagctttcctgacagacagtcggatagcacctgcctgtacctccagggatgggccttaccttcctcctgaggcacgccttcagctcctctgcagttctgctagtggaagattttccccattccatcagttgtcatagttcctattcctttttctcacgactcaggttagagttgtaatcttccatttatttgattgcctctcctaaaagactgtaagctccaggaggccagaggccctttccttgttagctggccattccatatcatgccttgcccattgaagggactcaatgtatatttgttgaatgaatgaatgaatgaatgaatgaatgcacttaagtttagaaattccagaaagaactaggaagatattacataacatgaaaatggaaatagagtattttttcccagataccagctgatgtgctcaagatgactttagggtgaatatggaggaaggagtgaggggaagtacccaggaaagagtgacgggttatgactgagcaacattcagagcatgggaaaaacaaaaggatcttgactttttaatgcagcctggtaaatatcattgagatttggcaggaccaaaactgagcattggaaaagggatggaaaagtcttccctatgaggaaaggagcccacttgtggagaagatgaacactcgcatggaagcccacagaagtgagagaggtggcctggaggagggcactcgagtgaggagatgggcacctccagccttgggtcagtcacaaaggaaggacagaggcaggaaacaggagcattctggacagggggccctggccgctgctcacagcagctcatcttctggcgggagagggttagctcctgcccagtgtcctcacgtacgagagtggtgagtttctaatgcatcacctctcaccatgcaccccaagacagctgctcttctgaatcctacctagagaaaaaaaaataacccacacaattctcgctgtctctcaacctcccacatctaatgagtcacccagttttgtcacttcatccttgggatgtctcttgacatgctttttcttcctttccactaatgtagctcagatcccaaattctctctgggaccatcacttgccatacgcagctgagtcacataaagaggttgcccttacacaacagatctctgctcactgttgcctaagacaccgcacgctctgctgacatcgtttattcttcctgaagagtcctttagttcatcacctggtgcttgctggccaggttctataccatcttcaagatcctgcttctgaggccgtgtgcggtggcttacacctgtaatcccagcactttgggaggccaaggcgggcagatcatttgaggccaggagttggagaccagcctggccaacacggtgaaaccccatctctactaaaaatacataaattagccaggcgtggtggcacatgcctgtaatcccagctactctggaggctgagacacgagattcacttgtctgggaggcagagattgcagggagccgagatcgtgccactgcactccagcctgggtgacagcaagactctgtgtcaaaaaaataaaaaatcctgcttctgttcttctcttcatgactgcccgtccaactccctctgccccctggcctgtgattgtgttcccatctgtaccttcttacacttacctccatctgccttatgtgtgcctttgaagttcctgcccttgcctcctctctcccgacaccctcaccagcctctgaatctctgaatggtcttagtcacacttgcttccagtcagccttacaccccagcattgtgttttacatacaggctgcactcactgaatgtttattgacttgaatgggatgtttcttcctaagacatcaattccatgtcttatgatttttcatgcttttcaaaatattttcacagagtctgtttcagatcattcttggtgctggtatcacacaagctgagctgccttcctggggttcaccctttgctctcctttgctcatctccgttgttctggtctcctccagaaatctgctgaggtgacatcgtctccagtgacctctgccaatttgttccaacatgggaatgacatgctgatttaaaacagttgaagcatactccagaatgactagaaatggtctcgtgtttgaagtttctgctcattggtggaagttaaaattccagtttctccagcaacatttggttaaatgtccctatccagcattggaactgctcactgatctctttttttgggggggttgaacccctgcccatcttctcagtatttcaagggcatagtcacttggctgtaataactgctcaaactatttactcaccagttttaagtatagatcagcctggtgtttatgtgataaaattctagaaacttcttcctttgcatctttctctacctgtgcccaccaagaaaaggagccgtacttcaccccatagccgtagatcaaatgaaaagaaataaatttctcacttgtctctaccctatgctaccttttcctttgttaaaaagggagataaaagagaaaagaaaacactggtctacataaatagcactaaatataaacagtggaaatgggcttctgggctttgaactctacagggaagttgttatggcaacctcaagttgaattcactgggggggaagtgtcagtattaatgagataagatcgaacttgtgactccaatggtaactgtattctccaaggtttttcttcttactgagacaagaagcaaagcctttattttatcagtgacatctagatttagaattgggagacaaattgtgtgggcattggggcctggagtttagtttccaggatgaggtttctatttctctgttgagaggaattagagccactcctaacacacctgctttagctattcttgttcaaagcctatagttgtaaatttagaggatgggtaacatagaccattaattccctaaagagacttgaagttcacttaaatttaaggattttttttttttttttttttttttttactggagtgttacacagatttttctatagggataaggtaataagatataattgatattgtaactgtccagtggaggttaagttcccaaaacagtgattgaccatgggtcaagattcccccaatgaagaagaaattctaaaatctgaagagagagagaaataaaaaaaaataataaaaaaaaaacccaggtaatggaaagccctggttgagggcgagaggaaagggttgcagagcacgctgagcaggtactgcctatggaagtactgactctgacttcagaggtggggagacagaggtaagagcatgaagtatgtaaatactcaaagtgtttatactgcattactttatcatggaagtaagtaatgtatgaaatttgcattatagaaattagactgagatgctaatcatttcttgttcctaaagctgaagacatctataaaataagtttctaattcggagaggtgagcaaggatccacaggttaagcagacttcaaaaatataccatctagtgccgggcacagtggcacacgcctctagtcccagctacttgggaggctgaggcaaaggatcacgtgagcccaggagatcgaggctgtagggtgctagttcagggctgttgtgcactatgattatgcctgcgaatagccactgcattctagtctgggcatcatagcaagatctcatcttaaaaaaaaaaaaggagtatgccctccatctagaaggggaacagtgagccccagggcacaaagagagggaacaaaaaagtaagggtgggcaaagcaaatgaaggaggataatagcaaccagaaaaacttcttcccaaatgttgtttatttgttgaaagagtaaactcattcataaactatggccatgtataaacaccactgtactaacccaaggagacataggagtgcctcagaacagcagttggttgactaatgccaaaaagggcctggagcctctcaaaaccccaccaccacaaacacatgaaagagctacttcttctgggcagacccttaaatggaaaagcctagaaaataccaacactgcaaactgaactactttgcaattctctccaaattctgtcttcaccatgctggaaaaatggaataaagaaccaaaatcaacgatagcagtgtagattgcatgtaataaagagctaaaaaatttatgtatttcatagcctacaaagccccttcataaataatctttgcaaagcaatcatgtgagctagacaggacagatagagtgactctcgttttacaaatggagaaagtgaggcttggagagccgaccagacctgctaaaactgtacagcttccaagggctaaacctggaacttgagcccaggctgaattctctgtattcagaccctctgctctttctatggcaaagtgcctcaagaaaccaggcaaatcgtacctataaaagaaatgtcaaatcacgcagaattcacataaaattacttgaaaaggctcctgcctttcatcccaggctgtccttcacgctgctggcatatcctgcaaatgtcatggcttcagtgcccagggttttgccagaaagaacatgctgccagcctgccgaatgaaggatgcgacttgagaagcagcagaatttggagaggaacaatggagttctccttctagggggtgggatcagtgaccatagttctcagggggcagtgatgaaacagggctttgtgtctattcaggaatagtatccagaagctcacttatttttgctttccaaataagtaaatatcagaaaggatagctgaggtcagtctagaaaattagaatttgcttgggggaaaaatatgttctggaaaagataaacagtagcttgcagtttcactgttggaacatttgttacaaggtcctggtattgatcttttatcacccaatttccactgggagccatgatgtattaccacactgggaagctctaatgcaagtgcgtgaatcaagggagattctagacaacatctgtagtgaggcagcatccatttgagggagggaagattgggaagggggtgttgctagctgcaaaattccaaggggagttttgcgttgtgctgtgtgcaaatgcatatccgtgctggggagtgttatgggtttatgaggagagtgattaaaattgtatcaaagaggcttatgaagcttatggttcaagttaactgtatgaagtaaacagcctttaacggcctcctgggagtgtgacagatagtctgtgggtgttacggcaacatggtactggtgaatgttctggccatcccaaactaatcaccatctgtgagcatgggtctctggggagcgtctggtggttggacaatcatggtagttagcatttttaatcagcttctgtgcggcacagatagaaaccttatgctcaagcctttctttttctgtctgtgtagaattacttatgatgatgatagcagagccgacaagggtttgggttgtgcctctgcaggatacattctgtggttctctgccctccctcttccccagcccccagcctgaccgtggaaattagcctggccactgcttatggtcactgcttttattacttctctttaccactagcaaaagggatgtcaggggaggggggatgtttctgggtttagtgggactgctgcctcgggtcaggatcttgagtttgagattcttctctctcctgctttcctctcctactgcttccttcatcaccaccacctctagctctgccccaacattcactcacccatcaggcaccaacttcttttttcttgttcttattatcgttgggaagcattacttgagggcatcgttggatgccctctaagggacccaggcaaaaggggaagtcaatggtaccatccctagaagtaggcaggcctcatggatgtttttgctgtgcaacagacttgagcagctgtgacagactgtaaggtctgcaaaactaaaagtatttgtgatacagccctttagagaaaaggttggctgactcctggcttagagtattccttattcttgagaaatatttgatctagcaaactgtactaagatgagacataaatatctaaatcagaatatacatttcattaggccagtatatgcacatttcatggtaggtaactaattcagtgggctgattaaaataatttattgtaacaaaagtatttggaactgcctgtaattaaaactaagatttattaaagaaacaaaagtcgccaggcctgcagacagctagatcctgtgcgtgagggttgtcttagtccattttatgttgctctaaaggaatacctgaggctgggtaatttttataaagaaaagaggtttatttgactcatggttctgcaggctttgcaagcatggtgccagcatctgctctgcttctggtgaggcctcaggaagcttttattcatggcagaaggtgaagagggagcaggcatgtcatatggtgagagacggagcaaaagaaagggcttgggggtggggttccaggctttaaataatcggctctcatgtgaactgatagaaggagagctgactcatcaccaagaggatggcaccaagccattcatgagggatccacccccatgaccccaacacctcccaccaggccccacctccaacactgaggaccacattttaccatgagatttggaggggacaaatatccaaaccatatcaaggatgaaaggagagggtgtcagttagcttttgttatataacaaacccccccaaaacttagcgactttaaacaactattttaagtagctcataattctgtgggtcaggcaggtgattgtacctctctgggccagctcagctgatctctgctggcttctgtcagtcatctgtggccagctggggttggctggtctagattgtttgacttacgtctggtgaataacaggctgattggtctggggatggtgctgggacttggctgggacagttcatctctgctccatgtggctcttacccttcagtaggctaacccaggcttcactgcatggcaatctcaggattccaaggagcagcaagagagcaggccccagtgaatatgcactttgcaagcttcagcttgtatcgcgttgctgatgagccactggccaatgcaagtcacaaaactggcccagagttaacgtgggaagtgaccccaaggatgtggatacagggaggcatgaccaaatcagaagccattacttcaacaatctctgcaaagaagagaggtttccttctcttcataatctctaccacctttcatggtgcctagaatttacattacagatttattcctttgggtcttaaagagtctgcagtcttcaagaggacccctgttatatgaaggtgtagttgttcaaccaaggcctacccagagcttagctgataactgagaacagggtcgataccagggtatcagacaccaagaaagaatatgaaagggaaggtgagaaggcactagaaaaaaatgaactattcctgcattcgcgtatccagctacccacaagaaacccctacgtggctgttcagggggcacagcaaatccatactgtctcagaccaaccccatcaccttgccttcttccttctctccaacatgatttttcattctcgcagcaaatacagtgcctcgtcttgaccagtgaagatggaaatgaggggaggtggaggtaaaggcctgcagaacaaaatggaagaaagggaatgacaggtaggaaagggtagaaaattattgctgagtctaagtattgagggttcaactcagtaattgattccatccaagtttaagacagtggacacattcctctgtttttttggttccttatcctttgcttccactcctgaaaggattataatcctcattcttgtagttgtggatggttatggccagagaaggccatagggacagtcatcaaggaaagcagaggcctctcactcaggagatgcctcagcattttactgtcttcaaagacaacagcccaagtgctggagcagccagaaaggaaccggcctgatttatttatttatttagagacttggtctcactctgtcacccaggctggagtgcagtagcatgaacacggctcacttgcagattcaatctcaagcaatcctcctgcctcagcctccctagtagctgggaccacaggcatggaccaccatgcccagctactttttaatttttttgtagaaacggtctcgctttgctgcccaggctggtctcaaactcctgggcacacgcgatcctcacacctgaccctcccggagtgatgggattataggcgtgaggcaccattcccagaccagcctgttttctaatgggtgtccacattaaatctgaactctgcctcaagttgtagctgctgctgagagaaccctggctctatgcttttctcacaaaagagctgttccagactgcccttagaatgttttctcccgtggcagaacagctgttttctgttcagctgtcccttacattgtagctctatgctggaactagctcgtgtttaatgctgtgttatgggtaaagccctcttgccttgtaggtgacactaataaaatcacagaagagatcaaacctagaatctctgccgatgcagacctcatagtcagacaaagagttggatgcttccattgctctcctagcttaggctggagctggaattctcacagcaaccagcagggagctggcaagtaatggctgctgtgtcctcctagaccagggccagcctttagtagcagctgagcgtgggagtggcaggcaagcttggcaccatgcagcagtgggcttccttgggtgctggaagtacagtcagggaacccttgttctgtccactctgcctacacaatggttgccttcagtctggagagtagtgaatggcaatgagtaatgagtaaagggggaccctcttcataatggcaggggctgggagccttctgggttgaatattttgtagcactcaaagagatggccaactaagaggtcgctctggtattgccttttctctgcctccacatcggcaggcttccagcaccccactattctggatctcaacattggacaagtgtactaatgttcaagcaggggcctgggtgagatggcctcatggtgccctgctggttgctgccttttgctgctcttttacaatccctgtactcaagggttgatttctgacgcctgggagggttggcactttgggaaagaccaatgagatttttacatttgagattttcagcatgtcaaacataggcaagacagaatatcggggagttattgggaatatgaatttgtttgtttgtttgtttgtttgtttgtttgtttgtttgtttgttttgagacagagtctcactctgtcgcccgggctggagtgcagtggcacaatctcagctcactgcaacctccgcctcccaggttcaagcgattctcctgcctcagcctcctgagaagctgagattacaggcatgtgccactatgcccagctaattctgtatttttagtagagaaggggtttcgccatgttggtcagcatgttcttgaactcctgacctcaggtgatccgcccacctcggcctcccaaagtgctgggattacaggcgtgagccactgtgcccagcctttttttgttttttaaataggcactaggagagcaatatctttacattttgttacctgtgaacactcagcacaggaccatataggtaatagtaatggtgattatggtgatggcagtaatgatgatgatgatttagtatgattcaccaacaggttataagacttcagaatgtcacgaactggtgaaaaaaaaatgtatatttttttgtaattgtaggaggcctgcatagagttgaattgctagctttttatattgccaagtaagaatttttttaaagtatgaataccataaactatcaccatctatttcataaaaaaaaaaaaaaaaagatgtaatgtactggttaagagttgtacactcaaagaaattctgatgatacctgggctagtaagctgtgtgaccttgggaaatttaagtaacttctctgcctcagttccctcattgtgaaatggggatgattataactgtaactaccttatgggattattggcagaattaagtgaattaatgaatgaaaggcactgagagcctggcacagagagcacttggtgcctcttatatttttattgttgtcactaataccaaagaacaagacatatataatattagaataagtaacaattctgcacatgaaaactgaaaattcactgcattgttgtgttgttttcttttttatttttatttatatttatttatatatttattttttgagacggagtctcactctgtcgcccaggctagagtgcagtggcgtgatctcggctcactgcaacctccgcctcccaggttcaagtgattctcctgcctcagcctcctgagtagctggaattacaggcacccgccaccccacccagctcagttttgtatttttagtagagacggggtttcaccaggttagccaggctggtctcaaactcctgacctcaggtgatccacccgcctcagcttcccaaagtgctgagattacaggcgtgagccactgcgcccagcctgttgtgttgttttcatcttacttggttataggccagtggtgatctgggagccactggtggaccacactggcttagttagtcttccttctttcctccaccaaaagacatgcagagcgttactgccttcccacccaataaagaggatggtaggtgagaaaataaagagctatactgtaagcagagcaactgggtttccaaggagggagtgtaaaacaaaggatctcagtgtgggagtgtctaaggttgaagctgtcccaaggcaataccttctacccctactctaaattaaaggagtcataactctttgtggttcctgtaaaagtagttaagaggccggcacggtggctcacccctgtaataccagcaatttgggaggccaaggtgggtggatcacttgaggtcaggagttcgaaaccagcctggccaacatggcgaaaccctgtctctactaaaaatataaaataattagccaggtaggcacaagaatcacttgaaccagggaggcagaggttgcagtgagccgagatggtgccactgcactccagtatgagtgacagagtgagactccatctcaaaaaattaaaaaataaaagtaattaagagtcaaagggcatcattacatagagacacaaaatgaaagtcagtattgtatgcgcctttgccctgttttagaccttcttaacatatgggagcccaagtagcccaaccatggtggaagagaagatttcatggcctttctcattggtcctcaccgtgaatatgcagagtaggcacacctctctgcagagaactcctctaagaaaccagattcaatgatctgatgatcccgcttctgctgatatgctagaagccaaggcttttttttttttttttttttttttttcagtagaagaatcaaaagtaggccaagcgcagtggctcacgcctgtaatcccaggactttgggaggctgaggcgggcggatcacctgaggtcgggagttcaagaccagcctgaccaacatggagaaacttcgtctctactaaaaatacaaaattagccgggcgagttggcgcatgcttgtaatcctagctacttgggaggctgaggcaggtgaatcgcttgaacccaggaggtggaggttgcggtgagctgagattgtgccattgcactccagcctgggcaacaagagtgaaactctgtctcaaagaaaaaagaaaaagaaaaatcaaaagtaataacaggaaggaatgtgttagcaactgtagagtattagatgtatggctgaccttccaaccagctagctctctggtccccagccccactccacaacacatcctcaggttcccagttcaaaactttaaggccgctgaaacccaggctccatgcacattcatcattttagccccactttcagacatttatatgttggtgctcatgccaagccaccttggaaaacaaggacaagtatatgttcccctccacctccttcccaccagtacccagcgtgaggtctgtacatagtagatcctccataaatctggtgtaaaacaaaataaaagcaggtgaccttctgtaaccaagatgtgtgtagctacatccatccactcccagtactacaacattggatttttgttgctgttaaatcaaaattttagtctttcagaattaattctctttgcttaaaattaattatgacaggttgtgttttttacacactgctgaaatgtgtaaagcagtttgggagaagagggcctcctttcctgagttgatttatgttatatatgcaaactctattaatgttaaaccatgcttttcaatgaaattaagactttccagcaagcagctctctccattttatttaaagatcctagtgactgatgcacattgtgcccctgttgctacgataggagcggaggatgttggatctgagagatctcatgcttaacccttaagtgagaagtagcgtgtggtgtgggaaggtaacacagctctctcctgtaagcagaaatcaagcggtggtctactgagagccattttattacttccagagaaccctgaaggtgaaatgaaggaggaaatgaaggcaggtgggaaattaaagaaagaggagcagaaatggaagtaagaaggacgtaaaaatttcagtatcttgagaaacctgactgccgaacaaaatgtttgggctgggaagatggagaatgcacggaggcctgcaagaacatgggacagccatgacatgtgggctttgttcttccaaagagataaatgaggccaggcatggtggctcacacctgtcatcccagcattttgggaggatcacttgaggccaggagtttgagactagcctgggaaatatagtgagaccccatttctacaaaaaattttaaaaactagccaggtgtgatggcgtgcacctatagtcccagctcctccagaggctgaggctggaggatcacttgagctcagggcatcaagtctgtaatgagtcatgattgcaccactgtacttcagcctgggtgacagagtgagaccctgtgtaagagagagagtccaggcgtggtggctcatgcctataatcccagcactttgagaggtcaaggcaggagaatcacctgaggtcaggagttcaagaccagcctggccaatatggtgaaaccccgtctctactaaaaatacaaaaattggtcgggtgtggtggcaggcggctgtctgccacctgctacttgggaggctgaggcaggagcatcgcttgaacccaggaggcagaggttgcagtgatccgagatggcactgctgcactctagcctgggcaacagagcaagactccgtctcaaaaaaagaaagagagagagagataaatgaaacatctgctccttaaagcagtaatagcatagtctttaatatcaggaggaagcgttatatgttttatttaaaggttgttgatttatgaactttgtacctgtctattaagagtctggttcttgcatggttaatgtgtgaagttttaaaatttgtgcttctcatgtttaaagcatgatacccagcaaggcttctgacaccagacctttcccatattccatttcatagagcatttcatagaaaatgtttcatagaacatgtcatagatatgttcttttcgtagaacagttatatattctttccttcatcaaacatggattgaacacctattgtgtgccaggtatagtgatgggttctggatgaacaaaacgggttttctttagttctttgtaagtctttgaccccatggaattaaccgcatagttaattccacaggcatccttggtaacatagccccctctggtaacgtagcagaccacagagtgacaggtggaggggaccgaatagtgagacagtcacctgggattctatgattccacgcccctgatgctttgggctgggggagttggctgctgtcatttgtgaggtagagtcgcaacctggtacagcactaagaatccatttccttcttctcagtgactcacttcccaccatctccaattgctctctggtcatagttactatgttgttgtttgccagcagaaacagccatgttgttgtttgccagtttggggctttctgtcaacctgaaagacttccttctctccagccagtttggtcttgcagattttgttgtgaggccaacaaccaggctgtgaactgcctaagcccagccagcccttctttgaaaagccctgtggaactaggtcatcaggttgttggatggttcttacacagactgtgctgtgctgcaacttttaatgtgcactgtctatggaataccaaacttgtttccaaactaaatagtttccaatgaggatttaatgggagtttttcatttgaaatggattgaaaacaagccatttcctactcccatttcaagcaaattttggtccaattattttcctttttttaacataaagttaaatggactattctgcccatccctgactgagctgaaccgtgatttctcttgattatgcttttacactgcgaatcgcgaggctccagagacataatgggcgtctgtgggagagtggcagcaatttttaaaatcctgccagtgcttgtcagcttccactctggtgtctgctgtgcgggaagaaagcaccccaccaaaagaaaaaaagtctgccaacaaaaccagcgctgcccgcctgttctgtgggggttggcacagggatgggctcctctctgcaaacctatgtagggcatattctcagccactgaggaagcccggtttccactcatccagccctactcctcccactgttttccagccattagctttttgtggtgttgaaggtttctttctcccttttttttccttgcctcaatttttcttggtttcacttagaccatagcctcagggaaaaggagctcttggcaccctgccttccacttggtcctttaccttcagcagcccagcaaaatggaaaataagtgtctcatagtccttcttgggtggtaggttatttgttgttgtgatattgttggtggaggtggtggtcattctcttggatttgcagaagtttacagaaaactcgggagaagaaaaggcttcttgctaccatcctctctctttgggaagggcagctacccccctagcagatatgtggggagcctactgggcaatgccttgtaatgggaacagcctctttgctctcttacccagcagtgccaagaatttcactaggcccactgaagaagaaacacccttcaccccagctaccattgtagctgccctaccattgtgtgcagcccgggggaagcacacagtcgtctctgggtttctggtgaaagtccattgtgcctgctcagggctccttggtgcaggagcagtcaagccttcctggaggttgaagatcacgtgctgtgtttggtggctccccacttgggtttccatcgattcatggtattggtttgggaggtgctcacatcctcctgcaagtaccctgtagtgaggcttactctgaggatgcagctacatctcaaaacatgactccacctcttcctgcaaaatcctgactggtacaactgccagcacatccctttgaccttgagaagggtaaagcacagaggtggtaggtgacttcattagcatgacagaacgtcagagttgattagcactcaggaaaggttgtctaatgccagcctctgcctttgtaaatgtcttcagcatcaccagggaggggttgatctggtctctgcctgaacttgtgctggaaaacagttctgagcaggcaccccatggaaacctctaattcatgcaaaagtccccccctatgaagtgaagtctgtttctgttgctttttcccactggtgctaccccttcctgagtccacgaaatctaaatccagtcccctttctacctcttatccctccaggcatttgaaagcaggtacttattcctagctaagctttccttctctaggcctgctttcaggtctttcagccatccctcctattgcttggtttcccagccctgcatccttctaattgccttcttctagacatgttctgatttgttgttctgtttgttctgagctctgaggtacccagaatgaggtgagagactgtcacagcccttgacagagacccatgccaccttttagtgaaattggctgtttcgatagccttaaaagggtcgttcatttatttcaagtttaatcgagtcattcttcacatacataactgctcaccttatctgctccacgtatatgtgtgatttgtcattactgaacctatgtgcaaaccacatttattcctaaagatcatcttatcaggataagaaggaacatattcatttctttagtctgcaaagatatgttggatctgtgttttatgatccaatatactgctatttccagcttcacatcatatgcaaattcagctcaaccactgtgtgccagacattgtgctgaacctggggatacagcaggaaatcagacagcacagttgcttccctcacaatttattgggagggacagacaattgactgtgcttttccaatccagggtgacagcacaaaagaggggaactgcagaagcgtagaggaaaggtgcttcacagactcaggctttctaggaaatgtgatattgtgagaagttggccaaggaaagagctagggattaaagtttgaggtaggcagaactacatatgcagtgtttgaaaggtgacaaaaagcacggtgtcttcaacagcttatcaccaggtaatgctcctgatcctcatcagtggctgatgtgaatgtggaacctaataggatgaaagaaattaccattagaggccttcatcatctgccttcgggcacatcaaacatttatgaactcacctaattgtatttttgtcacagccacgtttctctgccttgaccacttgaattgcatgtgaaatgtatttatgtctcactgaatacagacctgttctgtctatgtcattgctcaagtttaccaatctaaaaaaaaaagacttgttcttatgacttgttcttcataacccaggttggctttgagtgatcctaaaagcttccttccttcctgagagttcactagctctcttcctaataatctgttttattttccaagtcattggttaacgtagtaggttagtggcagagttgcacctagaccccaagtatctgaactcctagtctagacatctttcctttctattgctctgctcccccttggctcatctttccagagcagagacactacacaaggtttttttaagagcagctggtcagtccctgcatccaatgtaggaggcagcaagcaaggctagcagttacgccagggagaatgcaaagtggggtgtcctctttccaggcactggcgcaggccagctacatggcatttcatctccttagcaggcctctggggtaaactttatgtgttaaactttatggttaacagagccccctgctattcattgtctcctttatttatcaaccagccccatgaagtcagtggggaaatattcttgttcccatttagcagatggggctcaaagagtagaagagacgtgcccagaggcacacagttatactgagtagctgagccaggtgtcttaaatccaggttgtctgacttctggtgccccaagctgacttcagatttcttttcttcttatatcaatgatggcatcaactccctgacctcccccttctccagaatgttgcctgggtgattgggtaagaggatataaatagtaagtgaaaaaaatagattcagttccaagcactaaggggctgagacaactagacactgtggcagtgctacagacctttagatcatttttctgacactctctagctaaaaaggaacatggacaagtgacacccaaaagtccctaggcttaaaccaactgtcttgtggaaatataatataagtatgagctattctgagcaggatgacaggattggaattcagtaaagttttagatggactttgagatccaaataagggaggagtattataaagagctctataaaaatggtttaaggaagggtgtggtggctaatgcttgtaaccccagcactttgggaggctgaggtgggtggatcatttgaggtcaggagtttgagaccagcctgaccaagatggtgaaacctcgtctctactaaaaatacaaaaattagccaggcacctataatcccagctactcgggaggggtggtggcgggcacctgtaatcccagctactcgggaggctgaggcacgagaatcgcttgaacccgggaggcagaggttgtgctgagctgagatcgcaccactgcacttgagcctaggcgacagagtgagactccatcttgggaaaaaaaaaaaaaaaaggttaaaaatgccaagctagcagagagagggactcagacacacacacctaagttgttgctccagcctaagctggcccaccactacctgactgcagtttgttgcctgtcccgtcatgcttgccttcaaaatgcctttggattgttcacaagctcaggagccatgggcctcctcctgttgaggggtgtttattgtctaaatcccttacatgtgaattaaaaataggcaaaggtaaaaaggcaggagttttctaacaggtatgggagtgctgtagtaggccagtggcaaagactatcgccattttctttgcctgggacttgttgagtctttgaagtctacctgaattccagagtctagggcttcttgattccttagcaagagcaaagggatgtgtaccctctctttcaggctttggtgaattagaccttgagacttcataattaaaatggatttaatagaggcagggaagctgggatgtctgccccagtaagcaggcatcttctgtcagaaggagaatgtgtcctttgtatttaaacggtttctccaaaaggctctaaatgagatttgggacttaaacaagatttggtgtgatttgctaattacccaagttactattacctgattaacacaggaatcctcatagtctgttgcagtgcctttcttccgggtgccaggaggcttgacatctgtcacctgttcacttggaggcattttaagtaacccaaattatgtatgtcttttctgctttaggatttggtgcctgatttttacatttaaaagttaataactacctaaaggaggtttgctgccaaaatacaagagtgaaaactgacaaatctgtttgttgctgacagtgaggtggagatcttggtttattcattccaactagttaggccgagaaatgatacacaggacagtacagagctcttcctggtgaccatcacaggcatcaggaataaatcccctcaaatctcactttgccccaccaaccttaattgaggcctccgcttgagcagtgacagaactggaagggttggaaccagaaaagctaagtgtctttctcaaaatcacacaggcctgcagttaggatttgtctttcgttgttttttattttcaagataataaaaggtttccactttgaccaccaggagaccatgctgactttcatttcagagatggggcttcagtgtgataaagtgatctaggttagagtcttagcaggtttcccttgagatctgaatggctgcggggtgtgctgggggctctgtacagcagctgttaacagttttctccttcccatgaagacggcttatttacctgggtctcagttctgaagattgtttccaggtatgctgtgtactgaagggactgagcgtgatccaaggagcctgggacctatgtacttggtgaccagactctcctctccaaaagcagggacccaggggacctcatccagcatcctgagaagcctcgctttggacaggcctgaaatttcccttccttcatcctagctctttcatccaagacagtgattcgggaaacagtatttcaaaattgaaattcaggccttgaatttcaagtctagaagaactgtccaaatcatcggtaggaagagcttggaagaaagggaaagtcccactgtaatgctaaaagagagccacccagccagggatggtctgcatccagaccagagcacaggtcaaagggaaagccgagagcagttccctaagttctggcatggcttttggacgcaaagcagctgggctgcgggcatgctgtaaggacagaggaccctttagggttccatctcttcggagagaaagtccctgctgttccagttcactgagtgtttaagaggaaataacggcctgaggcataagccactcacccatataaagtgaatacttcctcaagggcacaaagagaccacttggtaaatgacttcacccacctgctttagatggtgctccagtgcactgagaatgttaacctcattcacccttctgtggatgagcagattattcctagaaaatggtccgttcatgtttgaccaggcatagccccactgtgaatgacaaagtcttttttgacctcccacgatctttctccctttctgtctcagccaagccttttcttctggaaggagctactctcttttggctagacgatcattcagaggagtcacctctgtccctccccctactgatacatctcagggtctcagagccgtttatgttcccatttttgcatcttgacatagggatgcaaagatgggaacatcaagcatcagttcttccgagccttcatagaaggagtggggggagtgggtagacatggagatgaaacaagactggccatggactgatcattgtgtaagtctggaaatggttgcacaggagttaatttaactactttgtttactttcatattggtttgaaatttcccataacaataagctaaaaacagatagtaagggatctcaagtgtcttgggcagtggttttcccattgccacaatatatgtggtgaatgggcattatctgcttggaaaattaacaaaattaaaatttacatatagatcagtgaaaacactgctacagagttaacttaaaattttagctgggtgtggtggctcatgcctgtaatcccagcactttgggaggctgaggaatgtggattacttgaggtcaggatttccagaccaagctggccaacatggtaaaaccccatctctactaaaagtacaaaaattagccagacacagtggctcacgcctgtaatcccagctacttgggaagttgaggcaggagaatcgcttgaacccgggaggtggaggttgcagtgagccgagattgcaccactgcactccagcctaggcaacagagtgagactctgtctcaaaacaaatcaaaaaatttaatataatatgtgttcattataaaaatcattcagggccaggcgtggtagctcatgcctgtaatcccagcactttgggaggccaagatgggcggatcacgaggtcaggagattgagaccatcctggctaacacagtgaaaccccgtctctactaaaaatacaaaaaaattagccgggcatggtggcgggcacctgtagtcccagctgctggggaggctgaggcaggagaatggcatgaacccgggaggtggagctttcagtgagctgagatcatgccactgcactccagcctgggcgacagagcgagactctgtctcaaaaaaaaagaaaaaaaaaaaatcattcaggtacagccagagagagccactgtagatagtttgaaatccaaagacgtcttatgtgggcattacccacagatgtgcatgcctgtgcagcttaattttagattttgttttcttttgctttgttgttttgtgtgtttgatttcttttcaaatcagatttatgtttcttaccagctcgttttaacaactttattcaaatataatctacatgccgtaatattcacccgtactaagtgtataattcagtgattttttagtaaatttatagcgttgtgtaactattgccacaattcaattttagaacattttcatcattccagtaaaatccctcatgcccatttgcagttagtccccattaccactcccaggtcaaggcagccacgaacctattttccatctctctagatgtgctttttctggacatttcatataatggaacaatacaatgttggtgggtttttgttttgggagactgagtcttgctcagtcgcccaggctggagtgcagtggcgcaatctcggctcactgcaacctccgcctcccggggtcaagcgattctcctgtttcagccttccaagtagctgggattacaggcgcccgccaccacacccagctaatttttgtgtttgtaatagagacagggtttcaccatgttggccaggatggtctcgatctctccacctcgtgatctgcctgcctcagcctcccaaagtgctgggattacaggcgtgagccaccgtgcccggccgtaatgtgtggtcttttgcatgtggcttctttcactcgtcctaatgttttgaggttcatctacattgtagcatttatccataatttgtttccgttaattgctgaatagtattccattgtatggatataccacgttttgtttatctgttcatcagcttatggacatttggattatttctacttttttggctattattaataatgctactgtgaacactcacatacagctgagtggacatgtgttttcatttctcctggtagatacctaggaatgaaactgctatgtcatgcaataagtttctgtttaactttcttaagatactgccacactgttttccaaatggcagcttcattttacatttccccagtaatttaggtgcttctgatctccacatcctcaccaacatttgctgttgtctgacctcctgaacgtgaagtggtatctcattatggttgtagtttgtatttctctaaggatgttttgaaatggggaactgtgcgtcttccaactttgttctttttcaagattgttttggctttgtttcctttgcatttccgtatacattttcatatcaccttgtcgatttctacccgcaccccatccctccccgaaagtctgctgaataagggtgttgagcatcttttcatttgtaattagccatattcttggatgaaatactattaaaatcttcttcccactttttaagtgggttgtttatcttctaatagacttgtaagaattctgtatatattctgtatataagtccattatcctgggtatatgatttgcaaatattttctcccagtcagtggcttgacttttcatatccgtaatgctgacttttgaagcacaaaaggttttaattttgttgaagtccagtttatcagttttttttttatggatcatacttttgttgttatatctaagaactctttgcctaacctaaggtcacagagactttcttctaagaagttttataattttaactcttacattcatctatgtggctgaggtacttttttgtgtatggtatgaaataagggtctagttctgtgttcctgcatgtggatatccagttaccccatcactgtttatcgaaaagactattctttccccttgaaatgcattgccacttttgtcaaaaatcatagacaataaatacacaggcttatttctggactttcatttctattcctttgatctatatgtctatccttatgtcagtaccaggctgtcttgattactatagctttgtaggatgttttgaaatagggaactgtgcgtctcccaattttgttctttttcaagattgttttggctttgtgtcctttgcatttccatatacattttaggatcatcttgtcaatttctaccccccccccaaaaaaaaaaaagtctgctgagattttcatagggattacatttaacccacaggtcaatttgggcagaattgcctttttaacaatattgagtcttctcacccttgaagacagaatatctcttcgtttatttagatctttaatttctctcaacaatgtattatagtttttggtgtgcaagtgttgcacttcttttgtgttattgtgaataaaatttttaaaatttctttttccaattgtttattgctagtatataaaaacattgattttcatattggtcttctatcgtatgacagcccaatttttttattagttttaatagctgttttgtaaattcctttatcagatttttccgtgtacaggatcatggcatcttggaatagagacagttttgcttctttcttgtccatatgggatgacttttctttttcttgcctgatacagaattttaggaattaaaactcatccaaagtcatgccaaagatcagtgattatacttatgatatcaatgaggagacaaaagaggcaacttttggaattttaaatgagccttacagaggcaaagggaagaatgggtgactgcattagcaaggaagtaaaaataccactctacagccagacatggtggctctcacctgtaatcccaaagctttggggcaccaaagcaggagaatcacttgaaaccaggagttcaaggttacagtgagctatgatcatgccattgcatttcagcctgggcaacagagtaagatcctatctcttaaaaaattttttaaaaagccacttcgcattgactcaggtttcacagtgctcctcttagtgggtggttatttcagcaacctgaccagaacagacaagataagccctgaaacaacacgaaggagccctgagtaggaaaaggtagacaccacacactctccaggctcatttatgtaacccactggaagatctctggtctatacagaacctcatcttcatgtctacctattgttttaaaaagcattggcacttggttttctagcttgttgatggttttgttttgtttttgcagctatactttaggaaaggtgttagagaagagacgaagtaggacttgaacataaaggatgccaaaaagtgaaaggacagtagctgatagtgagggggcatattggaaatgcatttaaatatcccatgtatatttcctggacacctacagggacaaatcttatgctcaagaatttaaaagcaccactggtaggtcagtggaaggcaactccccagacttgataaggtctgaggacattggctgagcaagccaagactccagtgacgccatccatttcttttgtggctgatgaatcagattcaagtacaatgctttataattatccctatgaaattctagcatgttagtgtcgacccattattctagtccttcggcacctctttggattctgattctggttttatgagttgaagattaataactaagctttgaaggatggggggattgccaaaaaaaataagctgaacagtgctttttttgtgataatcctgtgtcctcaaagaagttaagccccatttgctgcagaaagaactcattagctcctgtagcttctaaggaggatcctcatcaaagaatcttttttaaaataagtatgtaataataaaataaaacccaccatctagccaggcttcttgctattggagtgggaatttacagataaactagggaggaggctacactgatgcatgtggtaatgggttagagttaaaaatatcagtatgagctcatgtttagcttaacatagatacaaatagtcacatatagaaatctttacagatctgtgcatataaaagggttagtacccatatgtatttctgtgccctgacaactgagatggcctgaaagaaacggacaccccagtgtcaacaagcacaccttcatctagatcttggttcctattaccattctccaataaaaagaactaggactcctgagtgaaatggttgcttctggaactcaggcaggaatatacaagatgaacctggagtatgttatggtgccagaaagtaaggaagtcctaaaacaaaaaacaaaactcacactgataggggcacatcaaagaaacacagaggccaactgaaagagctaatggccactcctggataattagagcaaaacaataaggaagcatcggattataacccaaagtataaaataaatatccatgactccatactgatagaaataaataaatggaggagaaggaacaaacctcccacacagaagaattccaagtaatttacacagatacctcaccctcaagcaggggaagcataatgccccactccctcaatgtgagttccaggtagtggctccttcccaaagagtagtaggggagggggaggggagtccattgacagtggagagaccttcaacctggtgaccaaggacaatatcagtagtcacaaatcacattaatagaacagaccattgatacaatgtgaaaacaatggcatttcacctctgtagtcttcctcccaaaaacctctcaacccagtcttaatcatgagaaaagcatcagacaagtttcagtaggggggcattcctatagaatagctcaatattcctaaaaaatgtcaaggtcaccaaaaacaaggaaatttgaagaaactgccaaaagaaccctaggaaacatgacaactaaatgtaatgggccaccctagatgggatcctgggacagagcaaagatactaagtacaaattaaggaaatctaaataaactatggactgaagttagtagtgctatgttagtattggttcattacttctaacacacatgacatactaatgtaagatttagtaataggggacactggatatgaagtatatgggaatgctctttgctatcttctcaatttctctggaagtctaaaattgttcttaaaaagaaagcctatttaaagggaaaaccaccatcactaccaattttgataaacttgaagggttagcatcaattatctggaaaatttatttgtgagaaaaccttattcctttatgatcattgataagtgaagcattgctgaattatctctgcctctctgagcaagttaatactatatttttaagagaagaggagaagagaggggagggagtagggaaaagagtatgtgtatctttgtgtgtgtatgtgcgtgtgcatgtgcgtgtgtgtttaaacaagagaaaaagtgaattctaaattgttaaaaccttggagtggaacttaatctaatttatacgcagttccactagagatgtgcaaggatttttttgttgttgttaaagagaaaaactagtttcaagcattattaagcttttttccctcccagaagctaagaaaaccatctgtgagaacctgtttgcatgtttgttttctacaataaaatgcaaaatacttcttcctgttagcggattataccatatgtctctccctgtaacaaaatcagcatgtttattaatgaacccaatcagaggcaaagatttagaaagatttaaggaactgaattttccattcaatatttcagcaaaagaaacttctggttagacatcgttgttgtgcttggaaaatagaaggtttgtttttgctttgaactcaatttacttggcaggggacagagagcaggaagagaggcctttgaaaattttcgtaaaaaaggtctgcatttagaaatggcccttcctgcctaatgattcccctacggatttagacctacagtttatatgtgactaatatttaatttgatcagttacatttttccagacagactaattaaagtgcttgatggcccagatcccccaaatctgaagcagtaacaggcctgtgggcttcctggagtaacaggaagtgaatgaagtagtttcagccatattgtcaaagcaacccccatggtactcataatggaaacatgtgaattttccagcacaaacactttcctcacagccctgttgaccatctgaataatcaaatagattggtagcactaggtatagcatagtgtattagaaagaaatatgtccagccagacccagcactgcagttaaagtactggtgctgtcacgagccagcagaaggcctggagcaaatgacgtactctctctagaccccagcttactcctctgacaaatgaggatatcagctctgctgttctcttgtttctgacttgtagaagaatggacttgtcagcagagaccgtaagcagtggaaatcccaaaagccagacagaccctgtgcgtattttaggggatacattctgttctggtcattcagccttcacccaagccatctttttttctatttggtggcatagacacagcccagccaacctaattctcattttattgcattcattgttcatgtgccacagttttttagaaatcttacaagaaaatgaagcacctattaccaggacaccactgcaagggggaaaatgacacttgggcacctggaaggacaaagacaggcagtggaggcatcatggggttggattcgagtaaccctctgccttcttcctggggtctgttggcagtgtttttgtgctgtggtcatgatacacacaggtctcacaaggcaggcagccaagtgttgactctgtctttgtaggcaatacagaaaactgtctacttgttccagtgagctaaatcaagtgagaacaggaaagaggtttgtgcaactttggcaactatagcaggaaccactttaaatgggacagggcaagtaatgctaaatatttgcaaggtgatttttttttttttaagactttaaaggttgtattgggagaccttgagaaagaggcctttctttcttttttttttttttttttttttttgagacggagtcttgctctgtcgcccaggctggagtgcagtggtgcgatttcggctcactgcaacctccgcctcccgggttgaagcaattctcctgcctcaaccctcccaagtagctgggattacaggcacgcgccaccacacccaactcatttttttttgtatttttagtagagacggtgtttcaccacattggtcaggctggtctcaaactcctgacctcatgatccacccacctcggcctcccaaagtgctgagattacaggcatgagccactgcacctggccttttttttttttttttgagacggagtttcgctcttgtcgcccaggctggagtgcaatggcgcgatctccactcaatgcaacctccgcctcctgggttcaagtgattctcctgcctcagcctcccaagtagctgggattacaggcgtgtaccaccacgcctggctaatttttgtatttttagtacagatggggtttcaccatgttggccaggctggtctcgaactcctgacctcaggtgatctgcccacctcagcctcccaaagtgctgggattacaagcgtgagccactgtgcccggcctcttttttttcttttcttttctttcttttttttttttttttttttgaaacgaggtcatgcatgcaggctggtcacaaaccaaaaaggccttttgacaattcaactacctcaactctgggatgggcatttattaataacccccaacccacccaagtcctccaaataccctgccatccaggggaaaacacataaacatcaataaactgcatgtccccaagggatgctctttgccccaggatagtctggcctctcgggagatttctcttacctccagggctttgtttcaccagagaagccagcctggaggtagaaggggaagatacttagcagcaaaatctgctgccctgtgcagccaggccaggggggcagtcaggggctatacaggctgaaaagctgtccaggacccagagctatgtgactcataaaggcaggctgcccacccactgaaggtctccaagtggcagtccagatggacagtgatcagctgtcacattggacggttggcctcctgtgatgacaacactgtgccaaggaggcctgggttgaagctttgagcacatgttaattggcttagctctattccaccactgtagaattttttagttcaattcagcaaatattccctgggttcctgttctttgccaggtaatagagctggacactgtgaatgcagagatggataaaatatgtcctttagctgatggagagaaaaacatgagcaaataaatgtcatttactatgaaagatactagagtatctggaaagaacagtggagacagagaagggatggatggctgaaagtgtgtggttaaaacagtgcccacccatcttgcccagacacaaaccactcaaaaccaagaccctgttggaggaagcattcctgtgagtttattagagcaggatttcctgaattcttcctaggaatgttaaaagataaaatttgaaaaaaggattccaagagcaaataagtttgggaaatagtgagttaaagttagacaggttgctttcattggtagctcatgcttaagtgcagaacttctcaaagccttgagtatgctgagcacattgtgtgattaccccaggggaggagatggtattgagaattttgacttgggagcctttttccagagttacctccttggacctgggaccctcatattcttggaccctggcacagtgtcctgtctggagctgagagtttgcagagtggccttctagtcccagcactcccactgtgactgaaactgtttggctttgggaagtctaaccttctctgatgttgtttcctcattgtgttaggcaatttttgcatctctataaagaaatacttgaggctgggtaatttataaagaaaagaggtttcattggctcctggttctgcaagccataaaagcatggcactggtatctgcttggcttctggggaggcctcaggaagcttttttttttttttgagacagagtctcgtcgctctgtcgcccagctggagtgcagtagtgcgatctcggctcactgcaacctctgcctcccgggttcatgccattctcctgcctcagcctcctgagtagctgggactacaggtgcccaccaccatgcccggctaatttttttgtattttttaatagagacagggtttcaccttgttagccaggatggtcttgatctcctgaccttgtaatccgcctgccttggcctcccaaagtgctgggattacaggcatgagccaccacgcctggccaagaagcttctaatcatggcagaaggcaaagcgggggtaggcacatcagatggtgatagcaggagcaagggagagagagaggggcgatgccacacaccttcaaacaaccagagctcatgtgacctcactcactgttatgaggacagcaccaaaccatgagaggtctgccctcatgacacagatacctcccatcaggtcccacctccagcattggcaattacatttttaacctgagatttaggcagggacaaatacccaaactatatcactcatctagaaaagaagggaagagtgacatctgcctatcttgcagtattgttgtgaaataatagatgtgaaagcacttcatactcataaggactgggattgtcattgctgggttgtgacaatcgcagctgtgatcaagtcttcgaggctttagttacttgactgccttgaggttgtggcctcttgttatgcctggaattctcccttccttcacttctttacccaccccttgagatacttcttataaccatcccctaagttcaatgttggtagccctgagacttctgtccttggatcccttctcttgagaccatttatctcagagctccatgtgtcaacattacctgtcttctgataaccacccagttttctgtctctagcctttgcttctcccttaagttctggatccaaatgtccaacttctccccagataccttgatgtaattatctcaagctgcatactagtgcctcaaactgcttgcccttccccacacactgtgttccttcataactgggtgtcatcttaaaagtacttctggtaaactcctgctcatccttcagaacccaactttagtctagtctcctcttggctgacttcctcctgtgcgctcccagagaactttgtacctacacctaacatgccacttctcacactgccactgtggccattggtgtagttttcattaagtcaaggactgtgctttatttgcctttaaattctcatccttgagcagagtgcagggcgggcagtaagtctaattggatgcatatacctcattctagtcatgcccatgcagcagaggggagtttcatctttaatgccacatctggctttacactagaggcctgaacctgccggatgcacaattttgttcttttccctgctggctaggatttgcaggcacccagaagctgaagaccctcggggtctccagaggaggtcacatgtgcctctggccacagccacccctggactttcagctggccagtgctcccagctcccagcccttggctggcagaggtgagcaggagtcccacccactcctccccagcttagccgagtcatgttgatattctggcggcatagtcaggcttgttattgagcacatgctttgcagattagcctgtttgtatagccaatcgaacatgtgctccattaaaaattaaagcatcctgttttaaggatggagcaggagacatcagctgccactgtgtagcagacatgcaaagccccagagcccattaccataggttacagcaaatgttaatcagtgccagtgcagttaaataatgcagtttgtgcagatggcagctactacatctcctcacagatgtgtcctcaagtcccggaggctgctgtatcacaggagttgtcgggagcagtcagatctgatgctgactgtcaatatcaccttttgtgtttgtgtgcatcctccagccagctgagaggcaacgataggatgactccaggccctacttccagcagcccttccagagctggagcagggggtctgtgcagggctcacaggagagcagaaatatttcactaaatcgccaagaacactcagagtaaagctctgcagtctgctccatgaaactgtacccagctgcatcctgcaagaggcttcccagccaggtggagtggggatggcgttcccaccttcactcttcactgctttctgcttgctgatgggcaagaattccacaagtattcttcctggcttccataagcacagggacacctcactgtatcagaagttggagttctgacagcacctactgtgcacagggcctgattctgaatggcaaagtgctgttcccgaagcccaggcacttggctctctggtccaggtgtccctaccctccagcccctgaacagatactctgcgtaaaatttaggaacaaatcgccactcatgctgccagcagtaagcagcaactgttgtggcaagaaaagaccaaactgtttcaactgtcccagctcttctctctctctgtgtacttccttactagcagctgtgggggacccttccatgaaggggcacctagagcactgacatccacatgtgggcacctgggggcattccatctcagccactgtcaggagcaggcacagtgactggtccccatgaaggtggcctgttatcaagagaagatgaaataaagctcgaggtaaccaagtgtgggaaacttgtatggaagcaggggagattgctcttgatatagttaagtgttttacttaaaggtgtaagcctcagctttctgaaaaatatgctactgtagaacaactcatttctgaatagcatcaaatatgtgaggtgaaaatgtacttatgagaaaaatagttaaaagtttattcatcctatttcctttctaggttgtcagactatgtgctattcttcattcctagatgggaaacattgcatcttatgaatgtaacgtgttgctgtagacaaatattcttgtggagtgaagcccagggacaagggtcttttgctttccttgcaaaatgtagagacattattcctgtttcacctttgaaggccatgccatctgataggccatgccatctgatatggtttggctctcaccttgaatcgcaccttgaattgtaataatccccatacgttgtgggagggacctggtgggaggtaattgaatcacaggggtgggtctttcctgtgctgttctcgtgatagtgaataagtctcacgagatctgatggttttatagaagggagtctccctgcacatgctccctctttgcctgccgccatgtaagatgtgcctttgctcttccctcatcttctaccatgattgtgaggcctccccagccatgtggaactgtgagtccgttaaatctctttttctttataaattacccaatcttgagtgtatctttattagcagcgtgagaacagactaacacaccatctgatctgatggcttctacccttcctttctttctttttttttttttctgaggcggagtcttgctctgtcacccaggctggagtgcagtggtgtgacctcagctcactgcaacttctgcctcccgggttcaagcaattctcctgtctcagcctcccaagtagctgggactacaggcacacaccaccacacccagctaatttttgtatttttagtagatatggggtttcaccatatggtcagcctggtgtcaaactcctgacctcaagtgatccacctgccttggcctttcaaagtgctgggattacaggtgtgagccaccactcccagccagcttctactctttctttacttcccagtctcaacatcatttgtggaagattttagcaccgactcactcctttccttccattaaactcagcaatgacatgagcagctcatctgagccccaggcctctggattcctaacctccttacctccagtggtctttcctttatccacctctgccccccattcccattgttatgccctacgtcttgtcactacctataatgatgtcagtttcaaaattgtgatttccaaaccattagctgcaaagagttcaaggaactgagaggccaggatgctcaaaacccaccactggcttcacaccacacttagaacaaaggtctttcccctgctgtgagcctgcctactgctctgacttcgtctcccactactctgctccagtcacgctggcctttggtctggccttccaacaagctgagctaatttgcaccacagagattggttccattgcctgaatgctctatcccgttatatagatggtcgcttggcttgttctctcacttcattcaaatgtcatctccttggagagacttccctgactaccctattaaaacaacaacagtacatcccccaccccaaatcactctatctacttatccagctttgctcttcttcacagcactgagccaacatttagacagacacacccacacatccatatacatctatattcacttacttactgcctgtctgctccattgaagtgttggtgccacaaggacaggggttttgtctgtcatattcgctgctatatctgatgtgcctccaatggtcttccattggaaaatcaattgaatgaatgaaggaatatgtttgggctggaagcaaatgttggaaatggagttttaaaacaacagggttattttttaagctttctaataaactttctatcaaaagcatttttcaattattaacacttcataaatgaacaaatttcatcttctcaaagttacacttaggtgccaactagagaaagcagaagaattcattttcttaatattttgtgaaatccaggatagattattatttcaagctataaggcttccagcattagccttgaaacctcatctttattttgcttcactgctaggtgtctccttttttgtttttcctagaacttttgtttgacttctaattttgtcctctgattgaggactgaaacaacgtgtaataatctcacaccaggcaaatatagttgaaatttttagtggatttgattacattcttgaaagtggcaaaatcaagtaaaagcagatagatcagaagattgaaagctttggcttacaatcattctttttactttttaggatgtaaatcatcgtattggtcctttttactttagacaaatatgaccccataaagttttaaaagtttgtgtctgtgaaaaaaagcaagatgaattgtctctcacttccctggtttggaagagaagttccaaagcagggctgaactgtcatcatcatctaataattttcctttagttttcatttttcctttctaaatcttagcatgtgagatcacaggctccctctccaaactcatcagttgtctcttgttttaccagtaagaactgaacccctcatctcaaccagtctgtcaccaaggcacttgctccaaagactctgtaccagtcgagatgcttttagctgcaagtaatagaatgcctcatccaaagtagccatagggtagccatagggccaagcacagggactcacacttgtaatcccagcactttgggaggctgtggtgggattgcttgaggccaagagcttgaggccagtctgggcagcatagcaagatcctgtctctacaaaaattttttttaattagcctggcatagtggcacgcacctgtagtcccagctactcaggaagctgaggtggaaggattgcttgagcccaggagtttgaggctgcagtgaactataatccactgcattccagcctgagcaacagtgatgagatagtcagaggtaaccagatgtgtattaggctgactcctaggaagctttacgttaggttgataagatggctacaagcatggtatctccacaccatatacccaaggagggaaggaaaagggcagacctactccttaattgtgtctttctttttagcaggaaggaaaatcctttccgggggtcctgcagcagattgccccttacagataatagccagaactaggtcacgtgttgataaggtttagatacttgttcccttcaaatcttttgttgacattgcatctccagtgttcgaggtgggcgctgggaggtgtttgggtcacggggtggatccctcatgaacggcttggtgtcctccctgtggtaatgaatgagttctcactctactagttcacacaaaagctgcttgtttaaaaaagcctggcacttcttcccctctcaccacgtgccctgttgactacccttgccttctgcctcgagtaaaactccctgaagccctcaccagaagcagatgctggcaccataattcttgtacaagctgcagagccatgagccaaataaacctcttctctataaattatccaccctcaggtattcctttatagcagcacaaaatggacaaatacacatgggtgccacaaaccagtcactagcaaatatagattagaccacttggttatctcctggcctggacacatgtcactttcctacctgaacaaagttgatgttttctaataacagagaatgaaggatgacaagctgccagggtcgacaactaacaatgtctgctacagcagtacaacccgttactcctactgaaaaaactcactccaggtggaatagtagcttatgtcagggtctgtattgataggccagtagattataaagtatttggaagtgatcttagaatctctgctcatttatgtcaccactgtttcatttacatacctctaggatagcacttaccacgtggcatcatgattccatgtccacaggtctgactgttcctaccagattgtcaccaggaaccccttatttctttgtgtccagagtacccaggataatacttggaacttaatagaggtagaggctcagtcggtgtttgctgaacaaatgaatgaataaactaacaacaaataatgaataacatattcctgaagccatgcgttatgaagaacagttggaataactataggtgtttacctggggaatgaatgaatgaatggacaaatgaataagcaaatgacaactaagagatttttggagcggtgtccaatgaactgttgaaatgacgagaaatgttgacatggagaagagatttgaggaatacagtgactttttgcaacgcaggatttaaaagccttttaagtgaaagagagatgagacttactttgtgggatctttaagggtagagctaggaaaagtgggctgaaactacaaggagacagaattgtaaaactaaaatctaaaagtggagctatgtaaagatggaatagactgcctctggaaagaatgagctcactgtcaccaagcagagagtggctaggcatactctcaggcagtggtaggattttatcattgaagattggacttagataagaatgatacttattccctggtataactgggggtcctccctcgtagtgagggtattctctgaaagtatgaaaaattaaacttttaccacttaatgttaacatgaaggaggtatgtggtagccctttccaaagtaccaagagactttatgatgctatgagacatcttggagtaatcccatctgtctttattattcccaattacatgtgccatttccctgttgagctcatttctgatagaagaaatgttttttaaaagaaaacgatgttaatagatgtcactggttttgtctgtcttaacggattctgtttctcacttcaggacattatccagtttatactttattaaaattggcctcatgcacccttgaggtgagtgggtagagaatgaggagaagagcctcacttcccggagatggcggagagggattgggcccaccaggtattctttcaaatgggctgccttactgcccacctgcaggactgaaaatcagagaaaagcggtggaaattgagaaactgtaggacatcattcactctcgtaattacagtgaggaagtgtgctgcatatgtatgttccctcagtaaaacaggtgttctgcccttaaaatgctaattatagactattgcagatcaatgatcttcacttatttcatattgctgctccattttttccacatttaactaccctgtgatatagaaagcttgctcacccttgaaaaaatcaaaatgcatatggattttctgaaataagccccttttctggaagtattttgtggttagtttcaaaatgcaatatcctgagaaaggtttaagtcggctttttattttaatatataataaaaaagtaaaatcactaggcaatgagcaattttacttccattagcctaatgtctttgtggtttcatctgaggtcactagtagattatttttcttgcattatttcatcagctgtcagttctattacaatcatgtaattcattcagtgctgtgatttttcaaagacataactgtaagcttagaagacagttttttggaagtttatttagatgattgtagggtgtcagactgcctcaatcttctccatgctcagtgtctgaagggtcaccaacagattgtacatgaccttagatgctcgagtaattatcaccactatgtttttatacccagcacataaaaatatatctgcactttctttatcatcatcttttgaaagactgtggcctgcctatgggctgggcaattaggtttactacttagattacaggatacatgatacagctcttatttaacaccaacaataactctttttaaggtggtttcatttcaagcttagtctattaatatattcaccattgggctttgattacaataatgcagtttatttatgtttgcatatagtgggtatcagtcaagaaatcatttgaaaatcattcactgaacaccagctactcacagcttgttagtttctggtggttataaaggaattagaaattctctgctcttgaacatattattgtgatccatcaaagcctctagcaaagtagtcatttagtttggtttttgtgaggtttttttagtacgaggataatttttaaatattaaaaaaattaggccaggcacggtagctcacgcctgtaatcccagcactttgggaggccgaggcggatggatcacaaggtcaggagttcaagaccagcctggtcaatatggtgaaaccctgtctctactaaaaatacaaaaattagccgggggtggtggtgctcgcctgtagtcccagctactcaggaggctgaggcagaagaatcgcttgaacccgggagggagaggttgcagtgagccgaggtcgtgccagtgtactccagcctgggcgatagagtgagactctgtctcaaaaaataaataaataaataaaaattagaactctacatagtaatagtttacctttattatcttgtaattttaaaagtacaaaatgcacatttaagatacatgtgcataaaatgatatgtctgggatttgttttaaaattatctggaaaggtgggagtagtgggaatgggtagatgaaataagactggccatgagttgataattgttgaagctgagtgctggtaggtagcagtttattatacagttctctctacttttatggaaattgttcatttaaaaaaaggaatagaaggttactatgcacagggagcagtggctcaggcctgtaatttcatactttgggaggccaaggtgagaggattgcttgagcctaggaattcaagaccagcctgggcaacatagggaaaccctgtctctacaaaaaaatacaaaaattagcccagtgtggcagtgcatgcctgtactcccagctgctcaggaagctaaggcagcaggattgcctgagcacaggaggttgaggctgcagtgagccagggttgtaccactgtactccatcctgggtgatagagcgagacactgtcaatccatcaaacaatcaataactatgaattcagctttgcttttaaaaagaaaatatattttaatgatcattgaagcatttccatatacttgaaaaatattaataattgtatgagaatagcatataatttcctgagactatagacagagctttgtgctcatggactctgaaccctttgttgtaactattagaatacaatagacaagcaagttcaaggtagcttgatacatactgtacacaaacactgagcacattccaagggatgtgaaccttaactacagaagcgtgtatggagctgctttaatttactgtgactgtgttgcatagaaaaggaagacgaccgtgctgccacttaagtactgataacatttaacactgtgtgcataagattgaggcagcttggaaggtccagaatatgaagcaaagaatccgatccattcagaaaccaagaaacctccaaataatagcactttcactctaattcagcctctgccaaatttgcctttggccaattgtcaccagtgccaaattaccaacagacttccttttctggtcttagtcatgttgacctcttccttctgtctcctagtcaagcagaatttaaaacatttacattgtatttcaatttctatgaagatgggagaggaaaggtgtatttcttgtcttttgtccctggccagcttctactgggaacttatttccttgaaattcctgtcctgtaaaagcatgcagatgaaagtatctttaatgtataattacatttttatatgtgtataatcttagattacatgggaattgagtatctggaatggatcggccttaggaaaatgtttctttttaaaaactattaaatattggaacattatacaaaaaaatagcattgaaatatttaatctgtggttcaggtctgttgttcatttaaaggtttaactgtttcccactgtttaaatatctctatctgatctttcatgctaagttagcatgtccaaaatattgaaaaacagatgaatgatcaaggaacttaaggaatactcctccagtgaagccagaaggatattcttgaggagaaaaaaagaatgcatgaaacttatttaacaagaaagatttgagtcaggtaatctacataatatatccactggcattaaggctgtcatcttggtattgcatttctggtacgaatttcgcaatagctgtctttcactgtcggttctaataaagagtgttggtcagcttaaattccctgggagctcagagttatgttttgtgaactgcatgtgcctgaggcctctcatgcatgatttaaactgctttgtaaatgtcaataggtggaaaagcattggatcccttgtagatttctccaaatcctcaaagatgtgtatgccatgtataaaccatgctgcactctcaaggccattgccgttttttatacttgcctaactgggggtttaaggtattgctagaagcaaaatatcagtgtgttcatgtctcgatccaactggccaatgaaaccctttattaggaaaacctttgcaccagagaaatgtctccagtgacctgaaatgggcacacctcatgaatgttgaatgttcttcaaactctatttcttcattcttgacttttttcaaaacatacatttgacttgattgaatttactgatttcagagtactgcatccattccatggacagcagtatggggtcatcaaaaaaaatttccattgagagtgcccagacctgggtcctatcctggttctgccactctctggctctttgtccttgggcaagccacttaaccttttgggggccctgcttttctgatccattaaataaaggaggttgaattaaatgatctctagttatccctcacagctccagcatcagtgattccaagagatagtgacagaaaaccagtgtgtcacttttaaagccagggaacacatgtgactttttaattgggctcattccactctctgggcagtacacagtgccggcagaagccccaaaatggccagcagcaatggcgtagggaggcctgagtgttagcttgagggttcatcaactcattttcgttcaaagcacttcctggtgattgttttccatggacctgggaactgcactaagggcgctcctcccacagtgtgccctgaccccccaggtgtgttctttaggtaaagctgttttttaatgtctgaagaggccaaagcaaatgccagtgagggtatagctctctaggatctccagaatagaggcaccatatgagcaacaacactagactgggtttctcagagtctgtttctcacacactttagtacctctcagcttaacatggtacctggagatagaggtgcttaggaaatgtatgcttagcaaatgttgcagaaagagtttattcggagtcatagagccatcggagcagatggtcttttttgttttcttcttcatgttttgactcctacatagttcagaataagtcactttggtcttttctttgcacatgttcactttctaatatagtgtcttcttggggagactgttttatggggaatatgtgagttcatgtgttagctgtggagccagcctgcctgaatttgaatcctgacttttcctctaactgtgtgaccttgagcagtttccttaaccattctgtatctcaggttttaatctgtaaaataaggataacgggagtacctagctcttcagattgtgaggattgaatgggatatacacataaagctctcaatgcctggtgtgttaaagtgttcgcagttgttacttttttaaatgtttttactacttttgaaatttagtgttcaaggtgaactttttacagaagagccagggcaattggatgcactttgggggaaaaaaaaatcacttgcctcatccccatcttctccatcgcagtgaggactgttctcaagtgggcacacaggacacctgtctccttcatctgcaaggccccagtggctgtgctggggtttgaggtctctcgttcagaccaggtatgtgagggcttggttatcatgcactgctcctgaatccaccatctccatgtccacatccttggcagggagaccagagccaactgggaactctgccacctggagagacctttgaaacactgtcgccaccagtgttccatttgtgtgtttgcagaatgccaagtaagcacattctttttcaccctctgacatgacctcagggttactttctgtggctgttgacaaatttttagacatcccagttttatcagcggaaaccttgaagagtgacaaatggttcttggaagagttggtacatactataaaaatgtcagctggctcatttataacccagtgatgtccagtgtctgagccgtgctatcagcatggtctatagataactcaccctcacgatgctccgctctccccaagtactttgtgcagctgttctggttgaagacccagttgacatctataatagatatcaaatggagagcctcttattttatcactctctgtgtttcagcactggcggtccccatggactgtcagaaacaggcagccagcacgttatgggaaaggtgacttgctgagtccctgtgccctgaggacattattaagtgctagggaaccttgttagctcataaagttggttcaaaccaattattgttctgcgaccattaccattgccaagaatgtaactcttttaaattcttgcccataaagccgatctttccattacattatatcatagagcaagacttctgatctggccgcacttgtatcccaccggctgcaaagactaaacattgcatttgctgctcaatattggttacccttcagtgcttcatggaggcagcaagactgctatttatagatttactttctgtctccctagttcagcacagtcagttttgacacactgtcccagtaatctgatcagccatgctgcttttaaatgaaggtctaggccttggcctctgcagagagggtgacagctgtcagatacagatagtaggctacagatcctggctgctaaaaccctctcattcattcctgttacagatcattgaccacagcttgaagccatgctttacagttggccgattagttggcaagagatctacatactgtattagcaaggtcaaccactgagataaaggcaaaaacgtaaacccctgcactatttttaaaccagtagccatttgttaaagctggttattttggtacttgtctccgttcccctcttttttttttctcccaaaacaaaactcaagaaacttgttaaaactcttcggcagctaacgaagatgcctcagataatgagatggttcaaacctgagaaggaaagatgaggtctttctcagaaactcatttaggaacctcggataggaagccgtgttagctgtgcttataccttgttttaatcagaacgtgtctggaaatcttagtccagggagacctggatgaaagtgcagccagtttgagtgctctggccatgacagtaggttaggcaggtctggcctagaaagaggtaagttatgattcatacaagtttaaatcctcgctcactcctgaatgaggtggttgggcttggttgtcagctcagatgattggacccattttgtaggtgtttccttctccagagtccttccttcccccagcatcttgtctgtaggtattctaaagccaggcattattcaacacactatattggacttgtgtaaagagaacttgcaccctgggaaaccttgtgttaaagtgattaattgacttcttcatattcagtgaagatccttgctgtttcagaatcgacacaaacgaccaaaccttcaatctcatctttactcagaaaggggtccacctataagattttgaactctccttcaccatctgaccagcctcctctctgctttcacctctcctatgccttcactcccactgaacgttcctttaacttcatgacagccaccttcccctttacccttctctgtgtcctgctaagactatgtggacccagctggggttcccattctttttccaggttatactctctatggtctctattttgtgtcctcctccctctcttctgtgaccttactgcatcttcctgttgcattcccatctcccatctgatctcttgtctttcactctctacctcttgttgacttatgaccaagcacagtttccttagtgtacaggggcacccaaggcccttgacaatatgtctgtccaccatcttgtagtcttgcctcctgctttgtttcttctccacctctctaaggccccatgcacacatttgctgaacacaccctgccctgtcaagcttctttggctgcctttgctattcctccaccacgtaggtcctttagaatggcaagccttacaatgtatagtatatttagtatacatacccagtaaatatttgtaggacgagtgcatgaataaaagcacaatgtttgacattgttatcagcattgacccaaaccctttgagctagatgagcaataaagattagaagaaagaggttaggtataaccacaaacaaacttgagattgaaggctcgctagaagtagaactttgggtggatttctctctgtgacttgattttcttgcctataaagtgaggtaagtgatatctgctttataggttgttgggaggatcaaagaagaaaaaagggaagtaaagtgcctaacacagtgtctggcaaatggaaggaacttgatagatgttaattacctagctgtgccatataactcccaccccatcttcagtgttctgtgaaatgtattttcattttacccttggaaaggtacaggacaggatggaagaccagtttgatgggagagaaggctgggagttacataaacccccatggttttctgacttttcactagagtcaataaggagatgtttaaacagactttggcccacaaaaggtgactcactctcacattctcagcttcctgctcagggaatcagtgtggaaactgggcttccacttctcagcttcaaactggagctgggaaactttcgcctctgtggaggagccttggggaaatctcagcccagctgccatgaggtgtgcaaggggaggacgtgtcagccctggaaactccacaggcctctgttccagatgcacagggcagtcacgtctttgcaggggtgaagcaggaggacaccctccctcctgttctgttctagcagccatcatgaggtgggacttggagggaatctgatcctgttaggggaacgatccagtccggtgcagagcagctttggggtattaatgactgtgtgttccacagggggaacttgtccatttcatttatttgcaataaaatatatgagaggaacatctgcaggcagcttatatatttgtcaaatttagaagtaattcaggcatatgatggggagccatggcgattttatgaattttctattgttatgcattcgagttcccatggcatcgtttggcctagctatggcagcccagagaacagaggcggtgctagcagacccacgtgacacatgccgcgggcttgggcggatgcctggcatgtgaagtgatccagggtgctggcagatgcagacgaggtgggagggaggtggaggaggggcatactcatgttttaggaggggaaatacagggtcacctttgtggacggcaaatagccaggtcctgaaacttgcttctaatgaattccttacatgctgttgaaatggcaggaatcataatagcttatttcatgtgcctttgaagggttccagcaaatggagtctaagagaaggcagggatggggggtgggggtggggaggcaggaaaagggggggcgagagtgaaatattactacttaaaacatattcttagacataataaagcattaaagttaaaatattgttgagacagctttcattatgcatgttccaggcctcattatggaataagcagaagtgactgtgcagccgagacctaacaatatctgcactgaattcctattatgtaagaaaggctttctagtccctgccagtgtcgggatgtggtggttggttttcaataaaggtcagaatcggtgccacactgaatagagctaaaagtgtgtttcattcttttgtaggccacgggcactgttggggattgatctgaaaatctggtctgttgcgggcctttgctctcaagggagattaatattttagctattcctttttgttcagtgcttctaaatgtatttggaatgaaaagaaaggttaaagaggggctctgggacggctagcttcagagactagatcatttcatgaagggaaatcaattaaaaaaggttgactgtgaacatttatccatttagcttagccgctattgaattttcatgatggacttcgactcttcggagagaacggagttaatggcaattgttcctttctcctcaaaatttattatctggtttattcatggaaaacactccatcaaactagatagaggccttaggcctattgatagatttgcctgtgtggggttggaatggggaggtttgtcacagatgtccagcctttgaaggaaaattaaacaagtatctcattacagaatgcttcactggtccccggaggtggccacagacgcagtggatttaatgagctgggaacgtcaatgctgccaaagtttacctcgacctgtctttctgaagaactcctctatttaggcccactcaagcaaaggagaaaggcaccacgctgttttctccctttcaactccaaagaaggggataatgcactttttgtgccatgcatccagaggaattatgtgtgctaatttgattaggggagatttgattaactggaaaatgagggctttgctaagactttcacacgcttaatttatcccttgcaaagcagacgcaacattgtgtcatgaaactcagaaggcatatgggaacagtattcagtggttagacggcctttcagacccaacaatatcaaggattgccacggttcatattgggataatcattttagagcattcgctttgctgcagaatacaaattgggtttggcattgccagttaaacggttcaaaggataatgagattaatatagtaggaaacttagctgagcaaaaagcttttttttttttttaacaccattgcataactagttttaaggggaacttagttgaaaaatgcttggttttctccaaagaatgcattaattatgttttgtggttccatacactcctggtctttcttgctaaataaacatatcgtgcatcatccagatcttgctgaaatttgggggatatgcattgaagcagcccctgtttctccatgaaggtgtatgtctgtgagcctggctgtgcagttgggaggcctgggggagaggtcatgcttctaccatggcgttttccattttccttaaaatgtgcctcagcaacaggctgccaagatctaatcctgttcccctacccccatagcagttggggaattaccaacaaagtctttaccatctgacattccccaagggctgtgtaagggggcatcttacccctgctttcttgggagtatatatttttaaaaagttgaaaggagaccagcaatgccaatctctactaacatctgaaaaaaggtcttttttaaaaaaagcatttcacattcagaagacacctggaaggtccctgcagagagagctctgggctccatgtgccaacgatctttgaatagaatcccttggagtttctacccgtatgtcttttttctaaagatccccttgcccttgatgattgcaaacttccacatagcttcagaagccatcttcattgtgccaagtttatttacaagcagatttggccctctctgtactttggcctacatagtacaagcaacgtttgaactcctgttttgctcttagcaccagaagtttgggcttttccattaaaatcagtcaatcaggaaagagtgcatgcatgctgggttttaactttaacacaggctgggtttcaactttcatggtgaattaggactgtctcctgccattctcccttggcttgctgcactgtagaaaactgtgaaaggagccactaactagggcagaccactggcccaatttgaacaggactgctttgttttagctggacctagaggtttaaatcacaagacggctactggattcccttctccccgaccccctcatggccaccaccactagccctctgtaggaggagaacttcactgagcacctgattacctgttctcgctttaggattagatcaagataggacagagaggttgttcatttgtaggcttgttgccttactgtaggagtagttggattgagtcaagccatccttttccttgggaaacaggcccctgccgctttaagtggagttgctgggtaatcgttccgctcggttgcataaccagaaagggatgtgtcaggactgggacctgcagacagcgaaggctttattaaaacgctcgcagagacctagacagatgagtggtctccagttggagttctttccatcttccccatctgttcactgcagttttaattaaatctactgagattatttttggccttctccaggaacagaaagccagcctgtgccaatgtccactcgtttctgtgctttactgccagccactaatgagcaggcacatggggcacccctgcctgtgtgcacccccttcctttgccagccatcatgagttgctaatagggtaggaactaaaagtgccaagcccaggcctctccaccttctcccacctccacccccaccctcagccccaccttggtgctaaagaaagccagctaacgaatgattccacttgtggttagctagctaatgggaatgacaggcttcaaataaccttaaagcatgcagccccaatgcttgtctgtctgatcagggcccttctgctggcacctgacactttcaataccataatggcattcacatgcattctttttgaatgctgtcatatagcaagacctttcttctcttcgtttgctgggaggatgcctggcaaagctattaagtctgtgatgggaatgacagttaactgcgggcctgtcagtcccactttggaagtcagcacatccttatacccattaggagcatatcataggaacttcagaaataacctgctgcaagataccatcaggttgttgcgctgcctgcaaacataccacccaacgagctttgcacatcattctgccctgcctctcattaagggtctggtttgttgatatttggtagatatttgatttctgaatttcagattgggacatagtaattacttctggaaggtagcatggctgtccccaggtagttggcaggtggtggttcttcctatttatggtcagtgcttcatggatttgaggacttctgttagttgggtttccaagagaagttgtgtcttggaatccatttccctaattgaccccctaggtttccaaagcagactctaggcagatgtacattttttattgcacttgagtcccaaattctggcctaatcaccaacaccagtgcactgggcaggactgtgagtgagcctcagtttcccctcttgccccaagttcaaggcctacaagagacccatctgagtggcccaccctcctctgcgctccctaagaaggaaaggggtcaaagagagggatccgagtggtccagagcaactgctgcccctgctgagctgtgtttataacttctcattcctcccactgatagtctcacccctccacagtgatcccttgctctgttcttgaagactccattttcattgacccatatcagcacttgcattttggggttgatgttgtggaacctaaacaattagaaggttggacttagagcttttagagtcttgatttgtccatacatacagcttgactttctgctaagacacacgcttccactcctaaccagcaaccgagaatcaacatcttctgtgtaatttccaggaaatgcctttcaaactcactgccattaggtagctctccaaacttcacttagaggaacaatgttttagaaggattccaaaaataggaataagtgcagtcctttttctctagattggcattttctgaaatgtttcctggaatagtcttttcgtaatatattaatagacgccactaggataaaggattttgtttgaaaagtgttggattagatcaaattaagcaaagcagtggagagggcaatattatgctgtgtttaccaaacagctttgaccacagaacacctaggaacatttcatagatcccttggaacacagtttgggaaatgctactccagaggatctggagtaagacaaaccagcagagaaccagagttagcctttctggtattccagtttagaacagcaccatatgctctgcagatagaggctctaataaccctatgacaccaatgccaggacttttgaatgaatgagtagaaaaaaatattatttagtgtgctatgtgttgttttgcttatgtagatccttgggagaaataacactctgattgcagagttacgaataattgagccttttttgaagagttggttttccttttatcttgcaacccccatgaactgtgcaactgcttagcttcccatcatcaccgtggctgctggaagcctagagccagcttcctggcccatctgttataaataagtggttaagtgatgggcagacttcatttccatctccactgtgcatacccacatggtttatttttccttcttttctaccaataattttaaaaatcctcccccctccctgttatcttttaaaggtaccctaaatccttttggtcctttaaggtactttaaatcctttatccttttggtcctttaaggtaacttaaatccttcggtgtagggaatatgtaagtgatacataacattacctgttaccagtcttagctacttaattgataaattgacattggcttgtctgagattattgtcattttgggttgatcaacaaggttgatgagcagttgatgtatagccacagctacggcaacagtttcttagtttcagaacataccatgtgttttgtctggagactctctaatcactgaaacatgaaaacaatttactaagctatgtttttttccccaactgtggcaacatcataaagcatttttgttcatatgtgttttattgggtttttttttaatttttttctttattttttttttattttttgagatggagtcttgctctgtcgcccaggctggagtgcagtggcgtgatctcagctcactgcaagctccgcctcccaggttcacgccattctcctgcctcagcctcctgagtagctgggactacaggcgcccgccaccacgcccggctaattttttgtatttttagtagagacggggtttcaccatgctagctaggatggtctcagtctcctgaacttgtgatctgcccgcctcggcctctcaaagtgctgggattacaggcgtgagccaccgcacctggccttttgtccatatgtgttttgtcctcagtagattcctagtagaatatgaaaataatttgcagaagatatcctagaaagttagagctaaaagggaccttaaagatcatctagtctagagatggcaaataagtttcgattgtcctgctatctatggtttgttagttggctgcctggaggcttgtattgaagattctgggccatgaaggcatcaaaggctaaatcgattagtgatgtctgccatgagcatggcatgaaggcaaggaagtgtgcatgctgcacattttctgtccctagtttctcccttttgaccaatgaaatcacctgagacagaggtggcactagaaatcacgtctttattctaagtccaggactctttgtaaccccatcttgctgaagtaattatttttcttccaactataaacgttagtaaactagagcaccaaaacaatatgcttcttctagatttgccattgagttcactgtaaagtgaaatacaaaaccaagaatcagtccccctcttcattatttttcccaacttctgatatagttgaggaacgaggcctattctatactgggacctacccaaatttttcttgtttatacttagccatattatcatgatttggttttttttaattaagactgttttggtaagacatattctccagcaaattcattttccctgggtccttctttggttaagcatgttgctagctatagccaaaccaacaggtctaagatgcctaagttatattatcttttcttttcttctttcctttctttctttttttttctttctttttttttttttgagaaacagagtctccctcctttgcccaggttggagtggtgcagtggtgcgatcatggctcactgcagcctcaacctccccagggttcaggtgatcctcccacctcagcctctcgaatagttgggattacaggcacatgccaccacacctggctaatttttgtttttttagtagaaacagggtttcaccatgttggccaggctggtctcaaactcctgagctaaagcaatccacccatctcggcctccacaagtgttgaggttgcaggcatgagccatcatgcccagccttatattctcttttctaaaaaaaaaaaaaaaaaagatgaagggaggaacattttagaaaaatcaagttaggcagctttgctatctcagtatgcaatgctgagaagtgtcactttaacagacttaatcctttcaaataataattcaaatgaaattgagatgaacagtttggctcttaaggactttttttcttgagacaatgggattcttttttctaagcaattaatttgctaataaaaaaaatggtgctgccctgttccttatttgctttatttcatgagaaatcaggttggcaatcttgttcacatatttacccatggaacattccattccatctccttcaatgctgaagacatgggtttcaagcctaccctgcccagggataagacagagcaggtgcaattaataaaccatcttttcaagctttccttccagtggtttgtagactgctttctcctgacatgagtcaagctatttaatgtgatggaattcatcttgtaaggctctctccattcaggctaagtgattgaattcacaattcctctgatttagtgcctcgtttgtcactttcttgaggagaggtttttggacccatttagttgggagattggctggagcaggaagtcggggagaatctgcccctaagccaccatttccttccacttcaaacatgattcataatcagtctggaagaagcaggaagatagaggatgaccaactgctctgagaagcaggctgctgtgaagttgattacgtttgcaggacagcctctaagatgtcttcgaggccaggacacagaccctctagaagccagccattttagccacttggggctccacaacacagtgccttcgaacgtaaccagcactgactcggtggtgtgcactgggcctcaaagcacattcccgtctcttatcattcagtagcccagtgccaattagagtggacgtactagacggtttcactcttgcaaccctgaaacagtggagtttcagggctgaaagccagtctgacttcatcctgaccttcagctatgcacatgtgccctgcgctgtagcgtggctgcctgctgaatgggaatggggtaggtgtgcttgtcccagcatcattgacattccaggaggctgcttcctgccggtcctccccctcaccaggtaccatgtttcctattagttcttcaggaaggaaggcaggtcaaaagggtggatgaagtaggtcagaaagagggcagtctctagtaggaggggacacagacttatttactggtaggaattctctcctgtggaaaaacagttccgaattcagcctcaggatacaagccccacctctggaggtgctcaggccatgagggctgcagctgcaggtcttctgttcgtcaacctttttctcttgagctgaacacaccagactccctgcagaattgcttgggtgtgcagggagagtcaggttattttttaattgaaaaagacattttttcttgagaacatgggaacactacaaaccttcaaggcaaatggaagaacaaatagatgttccagtgtctaggcccagaacaggaagttttacgttgtgtttaacagatacgacaggatttgcagaggaactttaaaggagcccaggagtccgctgaaaatgtatttaaagttttgtttgtgtgcttgtgcatttgcctcagaagatggttcttggctttcatcagattttcaaatagaatctgtaaccaaaaaaatagttgaggctgggtgtggtggcccatacctgtaatcccagcactttgggaggccaagacaggaggatcacttgaggccaggagtttgaagctagcctggacaacccagtgagactcctttgcttcaaaaaaaattttaaaataaggccgggcgtagtggctcacgcttgtaataccagtactttgggaggccgaggcgggcagatcacctgaggtcgggagttcgagaccagcctgaccaacgtggtgaaacccccatctctactaaaaatacaaaaaaatttgccgggcatggtggctcatgcctgtaatcccagctactcgggaggctgaggcaggaaaattgcttgaaactgggaggcggaggttgtggtgagccgagattgcgccattgcattccagcctgggcaagaagagcgaaactccgtctcaataaataaataaataaataaattagccgggtgcgatggcatgtgcctatagtcccggctactcaggaggctgaggtgggaggatcgcttaagccagtgagttctaggctatgattgcaccactgcattccaacctgagcaacctccaacctgtttcaaagaaaaaaaaatgttgagattcattgggctcttaaccagagactaactatgcacacgccactttggaaatgtatgctgtttgttacccaccacagtactctcacccacctgaccccttctccctatccaaccttagccttaaccaagaacagacctggttcctagtaagccatgtttccattcaccaaggtttggggagccttccctgactataaaagagactctgctatcacttttatttcatcttaattcaggcatttttttaatgtggtgtagttgacttgtttctaaattcctttacattttgtattgttcacacagtaaaaatgtctattttaccattccccattctaatttttcatcatttagtcaaaggtggggccaaaattgagctttagtctatgtatagtaaggttttgtttcattttgttttgttttctttcaaccagaagaataaaatcagaattttagagcttgtcttacccaacccacttttttttttttttttttaaccagagatgttaagtcgtttttcaaggtcaaacatctagttggtagtagaggtaatgagttgttttattctttgctcttatcgaagaaaggaaattatagaattaatggaattttatgaagttgggggttttctttatcgttatcattaaaagaacgcagtgtggttttatgaaagcctcacacaggctgtcttctcagcccttttcagacccgcactctttcctccatccacatcctctcccttctccccagccccaacccttccttccacgtcaagctgagtatacaaagcatcccatatttcaggctgaggcctacggagtgggttcccactggaccctctagcagcctgcattctccgacttgaatggctgcatgtggagagtatgtatatttgttcagagctcttgctttaagttaccccttcccaccacgttgcccaaagaaataggaatgtgaggggaaaaggaaaggaaaaataccacaggtattttcccctctggggaagcttgggactcaccacttcacagaattcaaggtacagaagcatcttttcatttagcagaaggctgcaaagtgtgggtagaatgctgagttttgttaatgaattgctgttcatttccctcttcatcgttcttagtagcttttagaaaatgtgtctgcttttgacttgagccttctacaaggccagagatgtttctacagagagcccttttcttgcaaataagaactcctttcacttttgttcatattgtcccaccatgttgctgcctttaaaaaaaatgtgttgtatatataacctagattatgtccctataaagtgagtttgtaacgactccctcatgagcttagcaaaagtatgtctagacaattttttttggcttttccccccaaacttctttgggttaaaaatagggaaggacttgttttaatacagtgtagtactgtatctttaaccttttgtccaaacgcatattgcctgtttaagttttatttagagaaagtgtgtaacttataaaccagctcgctcagaccttggggccgcccctggctggtcttcctgctgcccgtggattagcctagtctccagaagtgttttacaggaagcttaggcggagggaagcacttaattattatccaaatttttccctttagttaagtcttacggtaagatatcccagagattatatttttagcaaccactttaaagagactggggagattaatttaaaattgataatcgcatggcagcaccacagcctaacaagctcaaggtctgccttgtggagctggctgctctctggggaccccagttcaattctctttgctgccagttgaaatcagaaatcacaaccgcagtgattagcagtgaattccctgatctccctgctcgaggcagagggagagggggcctgttttctaagtagccagtcgttaactctttcatgggaggggcggaggcagaggtagtgattcatgggtgtgaggtggggcctagtaatctacaccttcacagaaacttcccaggtaatgcttagagtccccagctctgggagcttctgtttttaggggagtggtggacagtgagtgaagaaagagccttttgggcccatccaaggctgccctccaggcaccatgaccgctgaaacccgcaccgcacggctcaggcctctgccgagcaactctgtccttctgggcgagcctttctttgtggaagaaagcaaaaaaaactgccttctgtccctcttccagcattcttcttttaaaaatggcctctggctaccaagtggacaattatggatagctctgtagagcagcggtaagcagtgttaattagctgcaggatatcagaaacaaaaatgaaaatattttccctgtgggccaaacaaaattaattttaaaaattaatgtaaaccactaatgctgcaagtgcctccattaaattacaggactgtgacatgtacaatgctatatttttgccgttgaatttgttatctaagaggtgttcattgtttgttacggtgtgaaaagctgttttcctccagataagcttgttcattaggaaactggatctctgccaccaccctgtttcttcgcactgaagtaatgccctgtagcataaatgtagacagccgcactgcatttaatatcagaaatgtaaatcaaaagcgtccagtctggttttaaatggcttcagtctttcccagggtgaaatctggggaaaaatttcttctctgtgcagcttctgacaccactgctttagcagacaggccctgaaagcaggctgataattattaaacaaagtatcttgtttcccactgaggtctccggatcgctctgtcattagactggatttatttctagggtttcattcacgctgtgacagcttgggatttataagttctgtgttttaatttcaggcagaaatgaaactggtcaattgcaatttgggagggggaagaacccttgataaaagggctgtgcatcctaatgcctaaatacagagccagaataaagaaggcatcttgggtggcatgctgcgacttcagccacagctgccagcgaacttgagccagccctgggggcagtacagagacaggccgagaacgccatgcttagtgcagccccagagcaccccttcacaccacaggcccctgttccagggaggcgagtgctggccttgctctgaagaaggaagggggagcaaccaggaggaatccctcgtcctgccagccacgaagggcgtgtgctggggcagtgactgaaaacttcagtgtttctctggctctgtcttcattccagaagctctggcacacaggtggaagcctggcctcacccagccaggagcatgtaggttctccttgaacctctgcaccctgcttttcaaggtgttgagtaagctcagtgtctgatttctttttttcaaagggaaaccaaaattattaactcctctgatatcctttctggctcctatttacttacttagcaagcatctaattcagcactatttcaaatctgaggggtgtgttggtaaccagttgggagctgagagaaaacctgattagcagtaagcttatttccatagaaacaggccaattaagatgctgtgtgaaaaagcagtggagagccctgaccagtcaacttttgggggtcctgcagggggcaaactgtccctgccctgctgtggaaacagctggactgacacacagagaggagactctagtcctctggggggtgctgtggctttctgcggggctgctggtgttttcttgcgctcagagcactttacaacacaggcctgaaacagagcagcatcaggagggtcgctagagctacactcccgcttctcttccagaatcccctatttgactgaccaggaaactgaggttctcattaatgacttttctgccaaaagaggcacaaacaaatgaactccttccgagagccctatcagatgttgcaacgtaagaggcttctagtcggtcatacagatcgcgtatattaacataggaactgatctgccatcaccaaggtgaccataggtcctggtttgcctcaaacagccccaatttatgcctgctgtacttgttaacagtggatatcttcactcttaaaagtatccgagtttgaattctacgggatgatcaccctcgctattacccacaatctagccagttggttcaaggcgaataacccctaatgggaccagtgaattagaatctcttgtttaaaagttgtggaaggctacatgtgggacaaaaccaatgaaataaagatttatttatttatttatttatttatgtatgtatatatgtatgttttgagacagtgtcttgctctgtcgcccagactggagtgcaacggcgcgatctcggctcactgcaacctctacctcccgggttcaagctattctcctgcctcagccccctaagtagctgggattacaagcatgcgccaccatgtctggctgatttttgtatttttagtacagacagagtttcaccttgttggccaggctggtctcgaacttctgacctcaagtgatcctcctgcctcagcctcccaaagtgctgggattacaggcatgagcgatcgcgcccagccgaaataaagttttaaaacactcgaaacaatgctacatggcatttgtatctatgtacaaatatagcaaaagtataaatgccataccgtgcatgataaatatcaaattggtgagtgtgtaccctgcgggaagatatctgaaatatatatttctccagctatatggtggctctacaggttttccttacatgtattcttatgttatcctatacttttcctgtagtccaaaaatatttcataatttaaaaagaagcaagcaggccttcagccaacagagaatggtttcattaaagtaggggagtgtatttgttggggtgcatgtaaggaagggaaggattctatttagggttaaacatctcaagaattgctccaggaaatgatgcgattgggagcatgactgaagcgttgcattgtactctgggatagcactggtagacaggcactccagaaagcacaggatgcctgcccattgcattgatgtttctcgagttctcagcactaaggcttgcatcctaaactctggtgtgggaaagctagctgcatatttacgttctgggtggatttgcctccggagaccctgctgttcaatcccattcagtttgcaggttaacatttactgttcctgtccttgaggtcagcacttgcccacagattttcctaatttctttattttactcttcctccaacaattgcaataacttggatactttctcttcactacttgcaggaaacaggaaggaggcacacagtgtgatacacagtcttgggttgatgtctgttttcaaacatgtttttggaatctccatttgagtagtttaggtctaattccagtcataccaactggcttataaaagccaccaggaatgggtaaaattgctccagaatgggaagggagcagcattccatatggcaagggatttttcttttttcttttttgagacagagtctcactctgttaccaggctggagtgcagtgatgccatcacggctcactgcagcatcaacccccctggacttgagcaaccctcccacctctgcctcctgagtagctggaacaagaggaacataccaccatgcgggctaattttttaactttttgtagagatagggtctcactctgctgctcaggctgttcctgaatccttgggctcaggagattctcccatcccagcctcccggagtattgggattacaggcatgagccaccacacctgcccaggaagggatttttcaagaggaaatgagacagaaagagtttggactgagtgcacatctttctctaccctcaatgatgtttgttagcactgcatcacctggcctagatggtccttggcaactaggtgactgatctgagtattttacattgcagcatctgtacacaggtgatctgtatacagcaagtgattcctgtaagctccttgacaataacagcaataataacctttactcagcacatgctgcatcccaggcactttggtgcagcactttacatgactttctgtcttccatcctcacagtcaccctttgaggtgggtattaggatgaaccatgtgaaactgccatttttgtaggtcaaaaacagtcaaatattggcaattgtatgtggtccaatctaataatctttttgtaatcaaaaacagtcaaatattagcagtcctatgtggttcaatctgatcatcttactgtatttgctttgcaaatagagaaattcagacattgaaacttgctcaaagtccacccatctaccaggtgccagaactggaatttgaacaaggtactcccctccacaccctcacactgaactgccgccgcacagtgctgtctccttgggtggaagaaaaaggcatatttttgtggcctaggtgttaaataggttcttcaacaacacctcggccaactttgagatcaaagatggttggtcagatgaatcaaatgtttcctggagtcttgggttacactcgtaatgctctgtttaaaaggaatgatatgtagtgagcacatcagaaatctggaagatggaaaatctctctttaggatctctgctcctctctcgagcaaagaaagaaatcggtgtggtgccagcagaggtgttctcagcaggacctggcccattaaatgaaagacttccatgctgagccaatcaagagagacctggacaaaaatcagactctttcctgccctggaaacccatgccttgaatctgtaattcatctgttaaatcaagtgtgcagccggtggtttagcacagagggggacgacggggaagagagaggggcaggagctgcagcacttgaatttccagcatcagagtccagttagggaaaagaaacagagctgtgatagcttcttggaccttatgtttccagcaaagagaaagcagcaggaaagatttttgaaaacagatgagctggtggaaggtattagaacaatggcggaagaggcagggaccccaggggctgaacaaaacacagttccgctgttgcctttcaacaagactgaataaagtttaggattttttttttatgggacttgtagccgtttttaaactttcatttttcataatgtcacagataatctttttatctattatccactggctcttttctgagaggcatttgcatcaaatagtgctgtacagatcatgactgtctctagtggggaaagcagcttgaaatgaaaggttattcactccctctgctttcgctggctttgttcttgattctcacacatttttttacatctgaattcgggtatttctggagtttttctttagaaacccttccattctgagatctaagcatattcagactccgatctatatatcaggggttacaaagcttatgcctactgaaagtgaagcatgtactttgaaacatttgttggataccccatggtttccaaaatcccttcagagcatttcctacagaggcagcaaccgtaaaaagcggccagtcacacagtgggggccctttccctagcactggcctcctggtggcagtggagcagtggccttccaagcatgcactgcgagacatgagtggggcaatccgctccttccaactgcagggagaacgggtctgcagaatgaattctctttctccactcctcccatgtggggaacaaacgagagccctcccagggggcgaagtggagctgcaggagagcatggtggaaaacccaggagccacctgggctaacagggaatcaaaaatgacctttttgtgcacaaaaccccctgggaaaaaaaatgacctagaaagaagtggggttatggccaggtgcggtggcttacgcctataatcctagcattttgggaggctgaggtgggcagatcacttgaggtcaggagtttgagaccagcctagccaacatggcgaaaccccatctctactaaatattcaaaaattagcgggatgcggtggcagacgcctgtaatcccagctactcagaaggctgaggcaggagaatagcttgaacctgggaggcggaggttgcagtgagccgagattatgccactgcactctagcctgggtgatagaatgaaactctgtctcaaaaaaagaaaagaaaagaaagaaagtcgtggggatatgactgatagtttctgttcagcttctattatagtttcttaactcatcaccccaagctccagggggactctgggggaaggttgagaccaggtttgttctcaggcctgcctgacagagcccctcaggaaagcatcatccactccagctttctcctctgctgttccccactcaaacactcctgccattccctctcagaaagcccagaaacctttcttcccctccccaggaggagggagagcagtctgcagaggcaaggcctgagtggccacaatgacttaggtattccagctgtgcccagaacttggtctcagacaagtgcacccaggttagtagtgacctcagagaacagtggccaggaacttgtttttgcatttgtgtgtgtgtgtgtgtgtgtgtgtgtgtatgtatgtatatatatatatatatgtataaaataagggggcactggcccccagagaagtactgacaacaacctctggttagagggcagttctttgcagcttttgatgacaacctgcgaggagagaatgttgctctcaattgttcaagaaactgaaagcttagagaggttgaagcgatttgccaagttcacgggctggtgacggagtgggcctcagaactcagatctttctgactcaaactgccttgttcttaccatcccctatctccctagaggttgttagaacttttgggggcatactgttcctttattttagaaactctttggatatagggtagtggttgaagcagctctgaggatctgttttgaagagaagggtagcattgttagactagtagggtaatttccttttcccaagctcgtccctccagacctttgagccggtcatcatagttttatattttatgaccgaaaagaaacttctgttaaatcgtaaatacactaaaagccctggtgcctaaacacatgaacgtattatctccttgagcctggaaatctcccagcaatgtggcaggaatgtagaaacagtctgagttgtcaacaaaacataacagatttcccagttgtaacaaacatacgtgtagttgtgaatggaaaactctcccaataagcaaaataatggcctttttcgtgttgttttcctcatttaccatagctgtcctttcagagtgccatcggtttcaaatgtttcattgtattgatatttataacacttctagtaagcagagtgcccactacattatttttatttaactctctccagagttaaaggaacttgtagttaaggtgtcatctttcagatttacaattttacctagattggcaacatgggtggcaaagtgcttggaactaagacagaaaagttggttccagtcctggcctgcctttgtgtgtgacttgagtaaggctcaggaagagaggctgctgatacccaccccacctgtccccaccccacctgcccccaccccagatgggtcccaaggcaaatgtgaaagattaggtgctcctgaatgtgacaccagacgtggtgtgacagagcccatttgtgggtgtctgtttcaaagcttttggttcataggccatgctgcccgctttgctggaggaaagttccaagacccacaccaggctactccttgacaggaagcttttgttcctagcaacgggtttacccagtctttgtttgtttgtttgtttgtttgtttgttttgagacagggtctcactctgtcccccaggctggagtgcagtggtgctatctcagctcaccgcaacctccacctccaggttcaagcggttcttctgcctcagccacccaggtagctgggattacaggcactggccatcacgcctgactaactttatatatttttagtagagacagggtttcaccatgttggctaggctggtctcaaactcctgacctcaagtgattctcccgcctcagcctccgaaagtgctggggttacaggcatgagccaccccgcctgccccgactctcttcttaatatgctccatgcgtttgtttatgctccccccacctgcaacatactttgtagtctacgcatgtgtcagggctatttgctggtctcttttctctcaccctgatctggctgtgagcagataatcccccattcctcaatttggctggtactgcagttggcacggctctccaaactctgcagccaccagacatgtagaaacaaacctctaggcttcccaggaggctcacggactgcctcatggctgagccttcaatagagatgatcatctatgaaaataataacaaaaaatgttgctggttataaatgcaatatatgctcaatagaaatagtagtctataaaattagaaagttatgctgttataaatagaatatatgctcattgtaaaaatgtagaaaatgtaatacatattaagaaaaaatattcatatttgccatcgatatatattttacatatttgtatgttttttcagtatgacacatcaaagaaagggcagaatcttctttcttctcttaactttttgtcgtgagcaatacagtgttaagttcagggaaggaattgagttcggagccaaactgcccaggtttgaattcagctctgccacttgctagttgtgtaatactgcttttttgtttggtttggtgtattttattttatttattttatttttttttgagatggagtcttgccctgttgacaggctggagtacagttgcacaatctcagctcactgcaacctccgcctctgggttcaaacagctctcctgcctcagcctcccgagtagctggattacaagtgtgtgccaccatacccagttaatttttgtatttttagtagatatgaggtatcaccatgttggccaagctggtctcgaactcctgacctcaaatgatcccacccgccctgtcctcccgaagtgctgggattacaggcatgagctaccacgtccactgcctgcctgtcttttactgaagttgtagatgtcctctttgcctattctctgaattctacccctaccctacccatggtgacccacagagtgctttgtatacaataggggtgtcattaatgtttgttgaacataaatgaattaaaatataacatcctaaaagtgatttcaaactttggaatttaggttttgttgtttttgttttttattagagacggtcttgctctgttgcccaggctgcagtgcggtgccaccatcttgactcactgcaacctcaaacttctgggcccaagtgatcctctcacctcagtctcctgagtagctgggactacgggcacaatccaccatgctagctactttttttttttttcttgtagagatggtgtttcactatgttgcacaggctggtcttgaactcctggcctcaagcgattctcctgcctctgcctcctaaagtgctgggattaacaggcatgaaccaccatgcctgacctgactttggacaagttatttggcatttataattccactttctcatctacaaaatagagacaataatagtacctacctcatggggctgttttgaggaattaacacaaataaagcacttagaataatgcttcgtgctgtgcagtaagcactcaataatctaagttggtaatattcctgtttttatatcgtgttttaataaatgagaacataacattttaaaatcaaggagctgtgatttcatgctctgcacactgcctcagtgacataaagactgggactgaagctggggcatcactccctttggtttcccctctcctaggcccttagtcacatacaccttggagaacaggcacaaccgagaggacctgcatttcagtgatgtccgaggccaagggacaaggccagattctagtcaggtgataatggaatgagagtgttcactgcacatgtcttaatgaatggagatgataaggggtcaccaagccctatatatttatagtgctttatttttcatccaaaaacacaaagtgctgtttagtccccacaacaatcaggaaagcgaggaactattcttcccactgaggggatgggaaagctgagtccccttggtgggaccgggctgcaggcgcagggacttgctcccctcaaactgttgtggtctcaccacagtcaggaccagtcacttgaacagctcccatttccccagaatgattctatagagaggcaggagaaccctggaccctgagcaggagacttcagtccaggggccagcagcgcaagcacagcgtcatagaacatcatagaacatagaacattattctgctcagggcaaaataatgtgggctgcacagtctggcccaggcagccctcagtgttgtgccctcaagtgttgagatgacaggaggatggggtcaggccagtgatcctcaaagtcagaagaagaatactatgcctcaatcctactcatttcctttccaaactctccctagagggcctctaactgtggctgaggggaggggcggcactttttgatacacggtgcaacttgcccactttgaccctgacctttgctctgtccccttcaggtgaccctggcaagtagctttttagagcagtggttctcaaacttgagtgtgtgcagaatcccctggggttggggggcagggctttgaaaatacagattgctgggccccacccctagagtttctgatacagtggctcagggatgggcccaataatttacatttctgacatctgggttcctggatgctgctagtggagagaaccggtgatttgatagcattggtgagctggctcaactctctgctcaggaaagtgacaggatgcctcaaatgctgagtgctgcgtattcaaattccaaacacaaggcaactaggatgggagcccttctagactctgtgtattcaaggaccagggagaggcttagcagctctcagctctcctggcacagagagagttctctgaagcttgctgtttttctctctcctactttgatagtttcctccatttgtatgggcggaggttgcaaaggccagaatagactcagcgagagtgggagatgggggtgagtgagtgtgttcacttttgatgaggagcagatgtgacaagcactaaaatggagtgggcaataagaattattactagctgaggccgggcacagtcgctcacacctgtaatcccagcactttggaaggccgaggcgggtggatcacctgaggtcaggagttcaagaccagcctgaccaacatggagaaaccctgcctctactaaaaatacaaaattagtcgggcgtggtggcacatgcctgtaatcgcagctacttgggaagctaaggcagaagaattgcttgaacctgggaggcggaggctgcagtgagccgagattgcaccattgcactccagcctgaacaagagtgaaactgtctcaagaaaaaaaaaaaagaattattaccagctgctttgtggtcaggatgtcccaagctggcactgcagcaaccgctgttagggggcttggtgccatttgcaaggatgtcatcctcagccactggtttctaggcagcccctccaggaattcctcttccatgcacctccttgggcagagcgttgaggtgtggtggctgaaattcaggaattattgtggaagcttgagtttgcatgcccactccgtttcctactaactagctcaggggcgggggagtttctgaactatgttggcatagttcagaaacttaatgtttaagtgtcttaatgtatacgatggagataatgctctctgatttactgacctctcgggttgtgggctagacaccagagtttcagagttctcggtgcactgctgtgtattcctgggaatgcccctgagggtggagctctctgtaaggaaggcagccccaagggcagggctggtctctttagaaagactaggaatgaggacacccggcgtccaggcctagcttttccacccactcaccttcacagctccttcatcctttctgcttcagttccctcctctgtaacatgaagttggagtagatacttcattcagagcatcttccggctgtaaatggcttgagcccattgtcaactggaagacagagtgtgacgtctaaaaacccaaacagcaaagagcatctcttccaaaccacccaatctggagaggtggggcagttttgtggttccggcaccgacaccgtccctttcacacggtactgagccgcgggctgcttcggggcggccctccccgccccgtgccttgccgggatggcagagcggatcagaagctgcgcgcgctctgcctgcgcgctttgcctgcgcgctttgccgccgcaacccgcgcagcagccaatccgctggtgcactgcaggtgacctcccccgggcccgggaataaattgtcaagtttccccaccgtgggtgtctttgctagccggcgagttgcagtcttctgagctaattaggagacggtcatgaggagcgaggcgggccggggcgctccgcgggccggggcggggctggggcgggcggcgcgcagctcctgggccgaggcatccgcgagccgcgggtagatcgctcgcgtctgatcgccgcccgggagctcccgcggagccggctgccaggactcgttccagctccagtgcggggctgcccgggcgtccagaggcggcggacggcgtgccggcaagtttccccggcacctgccagtgcccgcgaacccacctcggaagccagacccggggaggcagaggcagaggccggctggctccagccgtggtaccgcacggctgccaccctcggacttccgtcttgagtctcctgaggctgagaagcagcagatgccgaacctgccccctgacgtggacgtacacctcaagacctaaaatgcgccctgcctggagactttgaacttagtcttctggaaatgcggagaccgcttcgggtggttttgtttttgcatcctcttcggctaggtttggctttgggattctctggctacctggatacgcctttcctttgtgggcaagtctcccgcggatcgcagcaccagcagccaaccctggggcacaccagcctttaaaacccccgagcctggagacgcatggagctagagaagaggacccaactcctgaccacgtaaggactctgattccacctttcccgtgatggagagaaatataatttcatggcagaattttctttaagcacattgtctgataggattggcaattactaaccaggaaaatgagtagcaattaggagttcagtaataaatggaagtctattgtcctaattgagtggaattactgactggtaatggcaacactgaattcttcagtttaattaagagtttatataattatagtgcactttttatttcttgggggagccatggggtaggaattaaataaccagtgtgatggttaagaaacccatttaatgggtaagtaaccaatgagttgaaatgaatgtgagtgccttgctcaagcaatgcaaacttagatgaattcctgataaagagatgtaacagcttgggccaagcaagactttcagctgctaattcctgtctgataaaaatctgaacggcttagaaatgattgggtaatctctaaaactggcacactgaaactgttttagagataccagagctccctctctcctgccggggtattaaccccgatttgtgctctctgtcgctgtgttttccacattcttcaagagtgaaacgagtgggtcatttgagagtgcttttgcagcctggggtttctgtatggaaaatcttgtgattgagctgttgagctgtaaatgttgatagctgaaggggatagacaagcttcatcgaagttactcaaattcaaagcagagtgagtatgtaggtgtgcaatttgggaactaatctgtaattataaagatgttattttcctctttggtggtgtattgtttcctttactattatgttctcaagaaattgttccccttgtgggaagcagtgaaattggagagaaatccctgctcagaggataattacttatatttttggtgtaggtttctgggaatccttttaaccctacattgggatgcacatatttatttccataagaagctccagcaggtttggaaatcactaggttttgaatacactggtagataattagcacttcaagtaacaatatttatgccactctgtaccttgacttctttttcttgcttacacgaggtctagattttcaacaggatgatcagggactaccttctctagagagcttgcatattgcaagtgggttcagggagcaccattatagttgcatttcactccagaagagacagtgagtggcatggaaggggcattgcatcttgaatactgcatgcgttttaaagtttgcagagcttattcataaatccgcttggttaatgagaaaaaagcaggtatcgaaagacgtttgctgtatgtgtgcctcccagtctcagcccttccaggtgctttgcaggtccctaagtacagagtgtcactgtccagaattttaagggcttacctaccctggtttttcccctctcccctagtcctgttttgtcattgctaccatgaaaatctagcaaaagtgtagaaagttgtgtccttccagaaccacggtttctcagtgcaggtttactgtattgagcgcccactccttttctgtttgtattctgcccaaggcacagcagacattcactccttttatttcccatgaaattgtacaacaggcagaagcttgaagatacaacacggatggaaatttgagccttgtaacgttcaaaaatgacacaattgccaagtttcctaacttttcctaagagttgattaaagatcacaacttcatatcgctcctttttccctatgcatttgccgtccatcacacacctgactgtgagctgttgtaatagctagatgaggtttaaaaaaagagggagtaggggctcaaggattgctgtcctctcagaaatgttgcccaaggctaccctaaggctcagcctacccccagattctctttctgacaagtgggtgtttggtaggatggtgtgaaagtttccttctatgataacatctttaagatttgtttccaaattcccttttttttctttttgtaacctgctgagaatatgagtctgtaacctatgtatttatctgaagtcagcctgaacagatagaaaaactgagttacaaggtatgggactcccagtaaattaggaacagatgtgggtcaaaaacagatttccaaactctttatcaaatgatcccacttggaaacaagacatgaacaggcctaactactcttaaaatgcaaggtttgtctgagggcaaacatgctggaaaagatggtggccaccaccctgcctctacttttcttttcctttcatctttcttcccaccgtctttggttccctgcataggctgtgtagtgggtatcagtcagcacttgtctgctggttgcacaatgcagattactcacttctgcccaagtaactccctgaagccgtactgtaacaatagagcatataaaaaagaaactcaggttgatcttggcccctgtccaaggggattagctagggagcacctgaaaggcctgtgttgaacacactcacctgtaacccagttccatggcctggatctcaaggacagggtaatctcagtaccttttaatgacctagtaaatgtggtatctttctgtctttacactcgacctgatggctcatagagtctcctcattatggagctggaggagtactttgaggtcatctaggccctcactactcaaagtgtggaccatgggtcagcagcattggtatcaccaaggagcctgttagaaatgctgaacctcaggtccatccctggatttatagaatcagaatctgcgacaggttccccagatttctcatatgcattatgacaggtggggttgtcccatgatccaactctgagatggagtttagccagtggcgtatttattaaggagtgccctttggatcaatacctatgggaaggaggaggaaggaacaggaataggtaggtagagcaagaagtcaagcagcaatacaggcccagtgacagtcatcactcacaacacgggaagctacacagctaggtcagccttctaagttgtctgtggtgggcagggatggccaggcctttcaactcactgcagacagcactcccagcagtcagcagcaagtctgtcattagacagggatctgggtagctcatcacagtgtccaccacatgcactgaagttgggagaagctctattctgggtcactggttctcaaaatgtggctgcataccaacaggaccttcagcaccccggggactcattagagatgcacattcctgagccccacccacagctactgaatcagaaactagggtggggctcagcaacctgtgttttcacacgttctccaagtgagtgctgcatgcccaagtttcagaaccactgctccaaggcagccttttttctgtttgttttgttttctaattgttattgaaatgattcacagtccatcttaataataaaattcaccactttaaagtgtacaattcagtaattttgtggggtttttaggttttttgttttgttttgttttgttttgtttttgagacgaagtcttgctctgttgcccaggctggagtgcggtggtgccatcttggcttactgcaacctcttatctcctgggtcaagggattctctcgcctcagcctcccgagtagctgggactacaggcgcccgccaccactcctggctaatttttgtatttttagtagagacggggttttgccatgttggccagactggtctcaaactcctgacctgaagtgatctgcccacctcagcctcccaaagtgctgggattacaggcacgggccaccgcgcccggcccaattcagtaatttttagtatatttataacctgtttagtatatttgcaaccctcgcctttacttccagaacattttcattatccccaaaagagatcccacacccattagcaatcactctctgcaccccctcccaaagtctggcagccactcatctgctttctgtcactgtgaatttgcctgttcttgatactttatttaacttgagtaatgcagtatgtggcttttgtcttgtttcttaacgttttgagagtcagccaagctgtaacatgtatcagtactccatttccttcatgggacaaatcatattccattatttagacagtaccacattttgtttctttattcatccattgatggtcatgggttctttctactgtttggttattgtgaataatgctgctgtgaacattggtgtacaagtttctgtatggacatatttcttcaattctcttgggtcaatacctaggagttgctcagtcatatgttaactctatgtttcactttttgaggaactcccagactgttttccaaagtgactgtaccatttgacattcttacaagcagtttatgagagttccagtttctccgtattatctccaacacttgttaatatctgtcctttttattatagccattctagtgaatgtgaagtggtatctcagtgtagttttagtttgcatttccctaatgactaatgatgttgaacatagttttcatgttttcattggctatttgtacatctgctatggagaaatgtctattcagatccttcttagggcagctctttttgttccttaaggaatccctcagtatgtcagctttgtgtccagtcctgtgcaggtgttttaggatttatgaaacaaagcctacaacctgtggccattacccactggaaagttctaatcagatgtgaaactgtctaaaaaggggaaaggaggacaggagagcccactgtcgagggttagcatgaagagattcacattctattacaattcgtgcttcagaaagacacggtgtgacttgctaggatagagtggtgtgtgtcagggatgtggcggctgcagactgctggagaagactgggaatgttgagaggaagaggaacaagtagagaagcggggacaggaagttgtgggcagaccttctagtattcttttatgggttacacacacctgtaagaggggatctcaggagcccaagatttctttcaagatcatgaccttcaccagcctcagcaaggtgaagcagttcacctttttcttcatttgggcaaaaatgacctgcctccaccatttctcagagtgtttgtaaagactgattataatactctaaacaagtgcttgaagagtgtgatttattctacattacaggtgagaaaaaagtttgtaggtgtccttaaatagtctctgattccctattagcagatcctcatggtggcagtgccatgtccatcccaaccccccagggcaggtgcctctctcaagatacctgagactaccaggcacatcctcagggctcccaggcagcttctctttatggttgcaacacaccttgaaaatgacatattggggcaaaagaatttcaaaacagcaaaacctttgccatcatcctctcacatagctagggcctctgcacgtatgataacaagacagctaccttagacttatgtcatgccatctaacttacaaagtgctctctcaaccttgcaccagaggaaaccaaagctccaggaagtgacttggctaatgtcaccggttggactgtagcatgatcaggacctgacccctggtacattgacacctgacccagtgttttcatcgggcacttttaccttacaggttgctaaggattaatgatgggatgttttgattcttagtctataagtggatcctctcccaggaggctccaggtctccggatgccaggcactcatgttttatttggtgttgcagctgtgtttcattgtagtaacatattccaaatgctatgagatcaccctgagtctcattgaagaaaagtgtttcaaaagtatgcagagaggtcaaagtattaggaaagttctagaatgtacttaaattctcagtttcttccaggagcccctctgtaacaggctgggtcgtaattagagtatttggatcactgtttcttgaacacattcaacacaaaactgtggcaatgcagaattcaaagagtggatcaggacatttgtgtactaagtagccctgtacatactggataatgattttctttcgtctgttcgccctgagttctctagcgtataccctgtcttgggtaagaatatatcctgaaaagtcatgtgtcaggttgatgtcctttgagtcctattttaaattcacaagtggtatgtgctgagaaaaagcagatcctctgataaagcaaagaactgtgttgtgaaaaaagttattctatccctactcattcatttcttctgtaaatcaggattttaggtatttttttccttaaagctagttatatctacgtagaagatttctgcatacttctcttttttgtttgttttgtttttgaagaacaaagtatataaatgccctctagagtcatagacacagattgaaggtggcaaggtgagcaaaattggcattttgtcccattaccccattttccttttcttttcttttttttatcctaagcaggagagaagtgatctgcaagtttctcaggatgcttttgggtaagagtttcaccataaaaatgtcttcacccacactcctcccagtgtcagtgtgccaggtaccctgtcacctttggttgatgtcctgatggattaagctctggacagagccacacctttgaagaggcttcttggccagattaacacaccaaggaaagtgcttcagtctagaacatgccccgtcgctggggtctggcaccctggcctctgtgctgtgccctcctgcagcctgtgctgtgctctcctactccagtgcttagaaatgccaagtcaaggatgtgggggcaggtgcttgagagagggtcaaagtgctgtcattgtaagaaattattcatcaacctcagatagtatcttccagtaacaaaccatacaagaccctggccctcgaggaggagcctgcaaatgttagctcccctgccagccaaagaaaatcaggaaaagagcaacagggaaaatactttatttttaaggagatattttgccaataatttaaattgcagctttcttctcttaatgaagaaatatgcatttcgtgatacccagcctcccccagttcctctgaagcagagataataataactactatttattgaggactagcagccaggtgcttcagcactttagtattttctgccactcaaaaaatcaatgggattggcatataatgatgccaaagcttggcaaggtgattttgtctgggtttaaacccgggtccctctagcacagtgctttaaaacgtgcctggcccacaatacaaacacaccgtgacccggtgtaaggtgttttgtggaactcaccaaaccactcaataaatatcgactgcatgaaatgaatggctgaacttcttaggacaattttattctttttgatggtcatttcaggtgtcattcctctccacagaatggtagttatcacttacctttttatatccgcacagattaaaagctttggtgactgtcgcttggttccattttgtgctctcctccaggctggtgatgggctggggtgggccgagagcaaagtgtcagtgcccacagcatgcatgagctactgctttcaggcctggagatgcagaaggtgggccttacctagctgctcttttacttgctgtgattgtgtaaggcagaagttcacccttgctctgcagcaaccatcacagagagttgcaccagccagatttgcgttcagcatgcccaatgatcaacatgctgttgaaaatggaagtttgaaaggaattgaaagtagaaatattcaccttacaggacaggtaacacttgcccctaggccctactttaaggatttggctgttccccagtatagaattagagaacgtcagagcttgaagggaattagagagcatctagcccactccactatccctgctcacctctgcctctgctgacagagaagctatggacaagaaaggagaaccgaaccactcagaccaccacagtccttggtggcaggccttacactggaggccacagctctgccttctggtaccttccaccatgtggcatctagctgcaagggaggctgggaatttaggttctgtccttacagtggggaaagagacttaacccaggagtttccccaaatatgggaaatctgatataaatgggcttgcttaataattattgccattcttacaggctaaaataaaaatcagatttcttcactgtgggaatagattttcctgagatgttaagggagctcctgctttgtatgcccttaatcttttcttgtggtaatgttttagggcggttccattaagcacgcaaatggtcatgatatcttttaagggttcctcctgctctatgagtcttcattttcaacacgtgaagaattcagtataacattttccatttttcactaaggctaaacttatacacactgacatatccactttaaagcatcataaaacagcatttgcccttgctctgtgctcaatttttctttccttggaaatgctgagaagtcgttgcctgttcctggtttttgacgttggctaaccacctactgctaaatgagacgaattgaaataatggtctgaaaactgaatcgtatggcattcatgttcacaggctgaccaagccaggagggactggaattgatatcttccatggaaaagatgtctaacaacacaaccgtttgaatcaactcacgtttactaccaggtactcctggtactaaatactataagtagcagttcatttgtttttgtctttcttttttttttctttctttctttccttctttctcttttttttttttttttttttggtcttttctttctcttgtgtaaatataaagctcccactgaaatctacttaagtatcatatctggaacttttctagtaagtagtggaaaatcagtttgtctgaggtcatctttcccataaaaggtgttgaagtcaaaatacaacatagcgatgaatttctcaattaaacattgtattagcgaatcacagaattacaatttgaggaatacacacagaccagagtagtctttggtatgttcaaaggacaaagagaagattggggattttattagaaagagaaatgttatgtattgttttgaaagaaggctcattggcactacagaagcttttgggagctggcaaggtctgatgagtgaggcagcaggtaaaactctagacaagaagcaagacaactcacagcaggtcatttcagcagctctgtgtaaaacaaccttagggtcatagcaagccttttcagcagctgggcttgcagaaaattcacttcttggagctggtgctatatgtccagagtgccccagcacctcgactctgatttagttgaatatttcaagaatgactcaattcgtataatcaactttcacacacgctttttgggcgctggataagattatcagaggagataattacgctacctccagacctttaaaagtgagcctcgtctagatctgatagttatgaggaattctacttgaagcctatgagattaactagacgatttaggacttaggactgagtccctaacactctagtaatctatgattcttaaaagttaatatttgtatttatatttatatttgcagcccatcaataattacattaatgatgaacttggttcttagttttgaagcatcattcatgcatttggtcaatagcatttactgtgcaggcactttgttagcagccggggatacagtggtgaaaaaagtagacatgaagcttcatgaagcttatattatagtgcagcgcccataagcttttcaaaatcttcaattactgtaatagtgtttcttggggccagacgtggtggctcacgcctgtaatctcagcactttgggaggctgaggcaggcagatcgcctgaggtcggaagttcgagaccagcctcatcaaaagtggtgaaaccccatctctactgaaaattccaaaattcgccaggcgtggtgatgcacacttgtaatcccagatactagggagactgaggcaggagaatcgcttgtacctgggaggtggaggttgcagtgagtcgagattgtgccactgtactccagcctgggcgacaagcgagactctgtctcaagaaaaaaaaaaaaaaaaaagtctttcatggaggacttctcatacacgtgcgcacacacacaacacattgaacactttattgtttctgtagtgatggggagacagctaggtgtggagacctgtaataagtcctagtgatagcgagccccagttcccacctgggcagagttagatttatcctgtgtaactgaccaattcggagtgatttggagtgtttctcttcttgatgaggcccaggggccccactgcacttggcctacttctgaaaggagggaaatgctgctctcagtaatcctctgctggggggcgaaggtgggagtgattggattacagttcctttagtagctgcgtggagcttgccatgtgtcagaaaaccttagagtgtagtcatggaatcctcagtgctgacaggaatgcactctttttaaaataagtatgcctctctgtgttgggatatatgatcaattgaagcctctgggcagaatccattgatggaaagcctatatttaaaaacgaacctagtggaggtgtatgatacagaggatatggtacagagaagaagaaagcagtgaggtctcaggtgttggaaaagtcaagtctagacaagaagcaagacaactcacgatgcagacgagatgactggaagagtctggggaactttgggagattaaaggatagagatggtggatgctgggtgatttctacctgtgagcacgattaccagatgtccttgatagtgtgcaatgcccatgccatttccttcaggcgacgctgcagttcagcgtgcaagatactgccacacagttgagatgcagatgaatttggcacatgttcatgttgatgttgcccatgtgattaagcttatatgaagtggtacacacaaaaaaagaaccatttccttccacagatatttatatttagggaaaaatgagaatatttaaagaaaagctgttatgcattgtagaagtaaaattgtagaaggtcttctactatctgcatttacttaaagttaaaagttaatcacttccagcaaggaactgcacatgtggaatgttggtggtcaatgtgttatgttaagaaacttaaaaccctcatttctacaaatagtcatatgatacgactcttcctgaaaactagagttgggacactggtaccctaagcacagcacagagtaccaggatgcctatctgactggacctttgccagctctgggcatttgctcttttgttagtctttggcatttattttattttatttttagaggtagggtctcattctgttgcccaggatggacagcaatggcacagtcatagttcacggcagcctcaacctcccaggctcaagagatcctcctccctcagcctcccaagtagctgagactacaggcatacaccaccatacccagctaatttttaattttttttgtatagatggggtctcactatgttgcccagcctgtcctcaaactcctgggctcaagcaatcctcccaccctggactcccaaagtgctgggattacaggtgtgagtcactgcatccagcccaatctttgacggtttgacagacaaaaaactggcatcctgtggttttgtccgggaggtttttaaatgcctctgcccatagtgtagcagtgactatttgagactaaaatgctttttttaggggaacagtttatttgctattttcttattgggataactttttcagagcagcctccccccatagtaagaaaattaaaggtattcacgatgaaccaccctgatgaaaggaagaagtgcttagagcttccgtgtcccacattctgtgtgggattgggaacctctggcatgggtcccagtgatgatattggacaatcccctggtgtactgctcagtgggaaagtagatatggcagagaatgttacttgacttctaataatcattttccccatcttccttgttaatagaaccactgcatttttaatttggtgacttgcccgattaaatgcaataaagactacatgtcttagccaccattgcagcaaggtgctgtcatatcactaagttctggccaatggttatttttaaaatttaaatacattcatttatttattttaattgatgtataaaaatggcatatgtttattgtgtacaacatgatgttctaaaatgtgcatacattgtgggatgatgaaattgagctaattaacatacgtatgaccttacatacttgttttttgtgatgagaacacttaaaatccagtgatttctaagaatacaatgttattatctatagtcaccatgttgtacaatagatcttctaaacacattccttctgtctagctgaaattttacatcctttgaccaacacttcccaacccctccgcccagcccctggtaaccaccattcgactttttgcttctatagctcaacttttttagattctgcatataaatgagatcatgtagtatttatctttctgtgcctggcttatttcacttggtataatgttctccaagttcatccatgttgtcccagaggacaggattgtcttttttttttttttttttccgagacagagtctcactctgtctcccaggctggagtgcagtggtgtgatctcggcttactgcaaactctgcctcccaggttcgtgctattctcctgcctcagcctcccaagtagctgggactacaggcgcccaccaccacgccaagctaattttgttttttttgttttgttttttttttttgttgttttgtttttttagtagagacagggtttcaccatgttagccaggatggtctccatctcctgacctcatgatctgcccacctctgcctcccaaagtgctgggattacaggcgtgagccaccacgcccggccaggattgtcctcttttttaagactgaataggatccattgtgtatgtgtctttaccacattttctttatctattcatctgtcagcggacacttaggtgaattccatgtcttggctaatatgaataatgctacagtgaatatgagagtacaggtatctcttcaacatattgatcttatttcctttggatacataccctaaagtggaattgctgaatcatatggaagttctgttttttgttgttgttgttgttgttgttgttgttgttgttgttgttgttttgagacagaatctcactctgtcgcttacttaagttggagtgcagtggtgcgatcttggcatcttggctcactgcaatctccacctcctgggttaaagcgatgctcttgccttagcctctgagtagctaggattacaggcatgtgccactgtgcccaggtaatttttgtattttaagtagagacagggttttgccatgtaggctgggctggtctcgaactcctggcatcaagtgatccaactgccttgacctctcaaagttctgggattataagcatgagccaccacacccaacccatatttttaatgttttgaggaacctccctgttgttttccataatggctgtaccaagttaaattcccaccaacagcatgtaagctttctttttctccacattctcaccaaaacttagcgctcatctttttttttttttttttttttttttttttcctgacagagtctcattctgttgcccaggctagaaggcagtggtgtggtcatggctcactgcagcctcaacctcctgggctcaggctttccccccacttcagccacccaagtagctgggatgaccacaggtgcacgccactacacctggctaatttttaatttttatatagagaccaggtctcactatgttgcccaggttggtctctcatctttttgatagtggccgtcctaacaagtatgaggtgatattcattgtagttttaatttgaatttccctgattattagtgccgttgagcagtttttaaatatatctgttggccatttgtagttcttcttttgaaaaatgcctattcaggtcatttgtccattttttatttgcatgattttcttgctgtagagttgtttgaattcctaatctattttggatattaaccccttatcagatacatgatttgcaaatattttcagccatttcataagttctcttcactctgttgattgtttcctttgccatgccaaagattttttagtttgatgcaatcctatttgtctatttttgcctttaggatcatatacgaaacatctttgtgaatgtcatggggtatttcccctatgttttcttccaggagttttacagcttcaggtcttgtattacatgtaagtctttaatccattttgagttgattctttcacacggtgtgagataagggtctcatttcattcctctgcacgtaggtatgcagttttcccaatactatgtattgaggagactgtcccttccccattagccagtgggtattaacgaaagagtgaagtgttacttgtagagtgtacccttaaagagtcaagggcatgcccccttcacccttgctccttctgcggtctagaatgtggacataatggttggggctgcagttatcatcttgcaccatgatgtagctttgggaatgaaaggcagtaaggcagaaacagcaacatatctagagaaaccctatgtccctgacattatagagtgccatgccagccctaggctgcctaccgtggggctttgatgtgagaaagagaactcttacttgagccactgttattttaggttgcctgtcacttgcagtcaaacataatcctaactaatccagtggggaaatggctctaaaaggagctatcatccaccttcctaaatttctaacatttggaagccgcttcttatagcaagtctttttgttacaattacgcagtcacaatggataactatctgcactttactgtggactgtggaaaggtatgaagcacagaggaatgaaaatctcacactcactcactagaatgtacttatactcacatttaccaaaatgccacttacagccttgtgcataataaaataaagtaattactaattagtccgtcacgtgggcatccaaaccatacttgaatagtgacttcagtgatgtgctgagagtcgtactcattagagtagtcatagtttctacaaagggggccttagaaatgggcttacttgaagcatttctctaaatatacaaataataaattggaaaccttctggagtgtgtataatgtatacacaaatgtgtgcattggttgttatactcgaagtagcagaaaacatctgctcctgactttaacacgggaacaaatgaccccagattattagctgctaatagatttttgtagttttagggaaaggagaaaagtaccatagccttctttgttctataaagaatacgtattttatgtattctgtgtttgaaccatctcagcatcagaattgactgtttaatagttgcagttgtttaataatttttttttagttaatgcaaaatattggaagtcatctccaggcttctggcttacagagagtccctgtagagatagcagatcactgcatctgacatcgtcagctgtggttgctcaaacctctggtccaggaagaggcagagtcaaccttttttcccagcagaatgggattctagacatgcagatcagctctcctaaatagtcttagagtcagagtattttaccaccggatgtgaaccctggagatgatctagtattgtccttcaagttgaggaaactgaggtccagtaagtccaacaagacctacccaaggtcacagtggcctgggtggcacagggctggaacccagacctcattgttcttgtcatacagcatgaccttccatttcaaggagactaacaaataccaagtttggcaatgtatccaccctcacttttatttgagaggttacaaagcaaacaaaatgagatcatgtcataagcagttctgtcctaagtgggttaggatttatttcttcttttctacattttttttttaaatcagaaggtatatccccaagaacaggaactaaaggaacagattgcttagacccttgtgactctgccctggtggtggatcattaatggtgtagaaaatgagggcagtgctgggcaggcagtccagggtggggtgcatgcctctttaagagatttatgtggaggtctgagctagggagacagcgcggtggtacatcatcatgcaggcgacatcagagactttcttcttcgcttgggtgcattatcataaaaagtgatttagactggagctgattgatgcaaatggccctatgttctttcctatcattagcggcctctttcagtggccagaggcagtgattaaagctgtcatttggagctgctcattaaagacaagccccagaatagcaagaggaaaaaaggttggagaggcatatatatacatatatgtgtgtgtgtctgtgtgtgtgtgtgtgtgtgtgtgtgtattttttgccttaaaagtgcatcattcttttctagattgagccactgaaatcaaggctgtagagacatttccactgagaatatagaatgctgttttgcaagtaatattagattttcggagtgtcatagtagattctgatgacagcttgcctacatattatgaaaggagatgaggagggtattgtgttaggtgtgttttgttagggattgaccctggtgagaactcattaagtctccctcctcccaggctggggacttcagaggcaggccacaggagagcagaggggagggttgccgagagtggatggcctcagtaagtcccactgtgacagtgttgaccccagggatggacagaagaaggagagcagggaggaggctttttgctgagcccagatgatatagatgcctggatgtcactcagagagaggggttggtgagaggaggcccctaaataggaggggaatggaacaaagcaagatccatagatgcgagaagagaaattaatcagaacatgatccctggctccttggagtcttccagacagggcgacatgactagttaatcactcttgtggtcaaattgggcttcagtgtgcacctgcctaccttttcatcaacatgcattcacatccacttacgcactgatttttagtttagtgtcccagtagtacctaaaagtgacaaaaatcccaagctccaaatgaattacagcatgccccaaatgaaggctagggtagttagtgggtggcggctaaacagggagccagggctgtgaagccagggagggagccatctttgtttcttggaagaaaccagtttgaagtcagagatgagactggctggctaatcctgcacatcctcactggccagttgatgtcttactgcccaaatcccaccaaactttcatacaagctagtctacagctctcctcagaaattcctctgggaaaggaaaaaaataagaaattatcaatttaatttctcagtctaatgaactggtcttatacataaaaatttaaattacttttttttttatgaaagtggggaccaacatcatttatgcaaccaccactgtctccatgacaacgccttggatgtggcagctcatgtgacttcacagtcacaggcccttgaaatgaagcaaaggaaagttttagtttctcttctgtaatttattggactctagggatgctcacgatggtgctaagtggaggtgtgggggtttctttttgctgtggacagtaaatagtgagaaagtggtgaaattattccttcctgcggcagggattggaacttgctgcagagagtgcttccttgtcagcctcagagccagttgacagcttcagaggcgtggcttttgtcctcctctctgctgcacccccacccccacgctggccttcttagcctgggtctggcgcatcagggcctattagtactgatgctgggctgtgatgttcctctcctcggggagcacggcagcagaactgaacaaagtcactggtaatctgtgcttacagcctcccccctggggagaaagcctagccagctggcactctcacgctgagcacattcacttcccctggctggtcggcagcctggcaggggcccagaggctggccggctgcagggctaacctgcaccagcaccccaggcagcccagctcaggatcacacacgcattgttctctgccttccagactggacactggctgaactcacagcttggacggtgtggctcatctgcttaggccttcccagggtagctctctagaaataaaaattacgaacgctggatgaagaacaattggctggctacattgaggttaatacaggaccatttcccctgtcgtctttttcctttcccaggctctaggtcggtgacatcaggaagatttatcatgagttccgtcttctgtagttggaaaggagatggcacatctgccttgggtgatggggtggaagagtgggtggcagggatgagggtggagcaggaaacaccagtagtcctggatgtgtgtgtacttgttagaaatacctgcagggaaaaaagaagcggctggtctttggatccttgctcaggtggaccttccagcacacccattgccagatacaacttctgtcgaactaagacttccctcccatgtaccagaatcttgcataaagggagcagaggcttgagaggcccctctggggaagcaatgtctttagtcactgctctgctcacaaggtgcaggaaaagtctagatttttctcagttgactttcaggcttagaaaaaaaaaacctctagaagatttatggcttgttgttgttgttgttgttgttgttgttgttgttgttggaaaagcatttattctctttaggagccatcacacaccaacatgtatgtggcccttagttggcgtaggtagaggtcaactgtgctgctttcaccaggtatacaggtgtcctaataagagtttggggacagtgcaaaacggcagtgtgttctgttcaaattttttttttgtcttgctctgttgcccaggatagagtgctatggtgcgatcttggctcactgcaaccttcacctcccagaatcaagcgattctccacctcagcctcccgagtagctgagattacaggtgctggccaccttgccgagctcatttttatatttttcagagaggtagggttttgccatgttgcccaggctggtctcgaactccagacctcaagtgatctgcccaccctggcctcccaaattgctgggattacaggcgtgagccaccacatgcagcccagaaacttttcttttagcagagataaaggagggatttctccaaaaagacaacaaaaaaggtgcaaatgaattagcttctgtacatcttcttcagattttccctattctgttagtgagttcactgagaagtggagggaacaagaggaagaatcattgctaacatgaagccagtgctaggccttatgctaaaactcttacacaggggtcttatctccttctgacagtgcagttgggaagcatgctcaccagccccatgtggcaggtgaagcccctggctcagagcctctcagcagctaatagctaccacgtggaggctccaggatctaagcccaagtgccagcctaaagaccccacgctcttctccctggctgagtgctgaggtaccattcggctttaacagctgacggggctgatgcagctgcccggtgacaccatgtgccctgctgtgtactgcagttgccattttgcatttatagtgggattatctgatgctccaagctccacaagggcaaggtcttagtttttacatactgttgagtccccagtgcctgacactgtgctctgcacaccatatgtggtcaatacatacttggcaaatgaaaaagggaatgaacgagtggtcagggttaaaaatcaacgtatctttaaagtaagccaatgtgcttcccaaacccaaagaaattcttctcaaaatagagtgtcgaatagttttttttttttttttttgattggagaaacttgagcatgtttttaggccaagcagtaggaattattagagagggaatgatggcactattgatggaacacggtcccagaggagatctgaagtgacaagattaagagcagagaagaattttcattagcagaaacagggcacttcctccttagagaccagaggtgaagagagaaaaaaaggatccggtagtcatgggctatgtatcacttaggagtgctttcagctgcaagtaatagcttgactagcagtgcctgaaacaattaaggatttatttttttcatgtgatggtaagacagctacagctgggtgaccactgtgttgcttcagtggctcagtggggtaagggccattgtcttcaagactttcttggcctttccctcatgagatgcaccttctagcatcacatttgcattcaagtaaaagtccgtgctatccttgcagacacttacttcgcatgctgcctgctctgctgattgaggaaatggtcaagactaaatgaccactagtccctccttcaggtatgacagtggagtccaacggttagtgggatctgacctccagcgagcttatttctcctatgatgaatataagaagtttgtggccgggctcagtggctcatgcctgtaatcccagcactttgggaggccgaggtgggcggatcatgaggtcaggagatcaagaccatcctggctaacatggtgaaaccccgtttctaccaaaaatacaaaaaaattagctgggcgtggtggcgggcgcctgtagtcccagctactcaggaggctgaggcaggagaatggcatgaaccagggaggcagagcttgcagtgagctgagatcacaccactgcacaccaacctgggcgacagagcgagacactgtctcagagaaaaaaaaaagaagtttgtgagggattcctaagaaagtgaccgagggagaggaggaaggggagagttggaaaagttaaatgattcacttgtaagctactagaactttgttaagtttggggacatcatggttttgtgaaatctactttcgctgaaatttatgtccatttctttgcctccttctctctgcacaccgcctctactcagaaatttaaccatttacacacaacagaaagaattttcctcaagatcgctacttttgcccagtatttctgattgtctttctgcttcacatctccagaaaatgtattccctttaacaacttaacttggagaaggaggaaagaaacctaagcagatatgactccacctaagttttatgaggaaccttcgaaggaaactctgagaaaaatgagtctgtatctttttctccctcttagaccaggcttttgacatctaccagtgtgcacacttaccaattaacagttacgttcttattggttgagagaacaaggcattaacacgtctggtgactgctgcgctggtcccgtgagacctgtagagaggccaagtggttgccgtgggcttttgctacctctttgggcagtcactttgcctgtatgagacgaggaggccggaccctctcagctcctgacatcctctctaacctcctgtgatctggtcaccctgtgggaaagccaaggcagccctggcccctctccagcagtctctccctggagggctcggcctgttgggttttacttagctcgcagtttatgccttcattctcctctgaccctcattaaccaagaggaaaaactaattctagaaaggactccatttccccccatattgtatatttcatatccacagagcatgctgtgccctattgagaattaaactgcgatcactaacctcatctcatttgtgccaggggtcttgttcaaaagctgtttccccagcaaagcagtgccgtgggttaggaccccctcaccccacacacacatgcttggtggagtggttcccatctctttttaatgcctttggcaggggacagacagagagagagaaagagagagagagaaggaaacacagggagagagagagcaagagaaaaaaaagagaaacacaaaagaagaacaagagggaaagaaaagctctcgaacagcagccctgtgttttgttagaacattggcactgcatttatcaggattactggagggagagcagggtttgatcctcttctccactgggagagggaaaagctttattgtaccttttttaacatctcacagttagatcagaacaatacactgtgtatgtacatacacaccatacgtatgtgcctaaggatgatattctacttgggacacaccctgttttcaaagcatggctgaattttttataaaggccagatacagaaagccaccaggctctccctgggtctccctttccagcagaccttccccccctccccatccccttgccggacttggatcagcaggattcactcctgtcaaacaaattagagcatctatgaaatggggctatcgacatgtgtgacttgatctgttttaataggggcccggtgggagtttcctccctgccccactgagctttgtatccttcacggaaaggcagacggggcgcgggaggatgctgtggactttaaccctttgctgccagcaggttgcctgcctcctgcgtgcagccgcttcctttttgtgcctggccattgtctggggagtgcgtgcggcctgccatgctcttcatgcttgttatctcacaggagacaagctcaccccaggagaggaagagagagctgcgttctgaagcagatcttttgatttcctttcttccctctcctctctcaaataattagaagtgctggtcaaggtattaaaaaaaaaaaacagccaaaggggagaaaatatattgtatattttataaccctggcattttgtttttcaagaggtgttgtcgggctgccatttgacccttatgtaataattagcatttgagctgtggcagctagcaagtaggtaagggagaattgcctgtttggaggaaggatccgaccccttttaagtagaagagaagagggaatttgcctctgtcagcatttcagatgcacccccatgctatcactgtctccctggccctctgttcctgactcagttgctaatgacacaatctcccagcgcctgcctccgcccatggctcacccccacacccattcactgttcaggtacttgagtcccagccacagagctggaaggctggacagcagctaagacaagaggcagaggccttgtgcacagtcctgttgccgagaagcgcttagcaccctgccaccctccctgtaccgctctgtaggggtgcagattcccaccgagcccatggccttacctgcacctctcccttaacctgggagtgctgcgggcagaagtcaggacccgctttcttttcttgctcttctttactccttagcacatagcactggtacacctcaatttatagaacagacaccttcctgaaaaactgcatgtaaatgcaatttttgacaggtggaattttgtagctcatagatttacattgtttagagtcagtcgaaatgaagctgaaaacacaatcatattccctgtacttactggtgtaggaacctgagcacacagctcctttcgtaaagtgagaaattctccagcggagcgtgtagccgtaccctggtttacctgttcaaggagtcctatgctgaagaccacatcttatgggcatcggtgtgcagtaggcgctcagtcacaccacgctcatcactgagatgtggaaggaaaggggttggtcgggccctttgctctcctgtgctggtggccaagcccagggcttgggttgtaaaaccacaggcctgactgcttctccttgaattgtcctgaaccttgacccttagcgccctcaggtcgttgtgttgtttggattggtgatttcattaggatttctcacccttttcatttatttcatttaggcccgaggcagaacttctgggagctagctgatcatctgtcttttaattttcctttagggagaagaactccactgggctccatttctccctctcattgcttgctggcactggctccatggcctctttgttgtgtttttgttttgtgttttgttaccgtcccctctggcaccagatcaaggggcagggagggaaactgggacgttttggaggagggttgccaaagagttgttgcaggaaagaggcatggtcagaagaccagttcagcagctgagcagcgacaggagcacttccagttcctccagggcctgagctcagagcggggaggaccatgaggggccgcggtatggcggcggtggggtagggaaagagccaggagaatgaaggaagagcagcagcttatttaatttggaaaaacaagggaaaagctccagtccacatacatctcttctttcttccccttccctgatgctcatgaatagcacgtggaagggttgagtgtttctgccccacagtgtggcttctgccgggagtgggggcacacattccaggcttctgtgctgcctgggtagctccttctcctggcctttcaggtccaggattacagactcaaactgtattcactgtgggggcagggtggggggttctcccctttttttctcccatgtcctagtcatttggtcgctgcaaaatgattacaacatgcaggagatctcttgccacctgaaccatttttaaatcctctcctgagtactaagcccagttctttccaaattatttccagcaactttcgcctcatgtgtaggtttctctggattaatccccagtacaatcttttccatcctcaaaagtcacagacattttagtttttctgatttcatgtcccaccttaggtcagatctttgaggggtgggagggtaggaggtaaggaaccactcctcatgcaggatattagattgagaaacagaaacctacaaaaattcagctccacttatttttaaactgatgatcatgtctgaattagatcagagcaaaagcaaagattaaggaaaaaggcctagtacaaactatagcaaacacagtggaccagtgctgaactttgctagctgttctgggacgctacagctaggcaggcttacgttagtgcatagtcattctctttttttttttttttttttttttttttggagaaatggagtctctgtcgcccaagctggagtgcagtggtgcaatctcagctcactgcaacttccacctcctgggtttaagcagttctcctgcctcagcctcgcgagtaactgggactacaggtgtgcgtcacgacacccggctaattggtgtattttttagtagagaccctgttgggcacggtgctctcaaactcctgacttcaggtgatctgcccgcctcgtcctcccaaagtgctgggattacaggtgtgagccattgcgcctggctagcatagtcattcttaagggcatgttcagaccaagttcctctggctattcttggagcggagatgtcctggcaacttcatttctctgtcgtctcttacaaaaccccctttctccaagttctcttaaaaatgcatctttgacttatattctctcctgcctgaggggcctgccgttgtcctctgttcctggactttcacctcatcctgccgtctagacctggcatctgttttggtcagtgctctggatgttctttaagcagcacattcttgctgagcagaacacggtgttcagccaggttccatagctcccgtcatccccaccgttgctacccaggcccttggttgtcctgcactcccgctaacccccagactttcttagaatcaaaacttcctccagttggatcactgggcttctattccataactccttcatttcctcttgccaagaatgttctttagcaatccgaagttatatttgttattaaatataagacttaaaaaaggcttgtatttttcccctgaaatcagctttaatgaattatgacaaaacttaactcatattgctaaacattatatgtaatgggtgtgctctttcaacttagggaaaaatggatccagaactgttggcagcctttacacgtctttcatcggcctttttctttgtggaccaaaagaaagggccaaacttagccaaaaccattggccgctgatactcttgtgaagactgtgttttattaccactgcaagagttgggggttggccaaaatgatacccagacatttcagatcttaatcacaggtgctgaaaacagagatgtgtttgattctagaccattacaagtgggagttaattaccacatttcaatgaactctccgtgtgccctcctgccatagcaattagcaagagagtggccgcttgtgtgcttgatggtgttttatgaccatggattatataggaattaggaatggcttcgggaagcatttggtcctcacagttatccaataccagcatggcccaaccccagatatgtcaaagccacaactgttgcgtttggcaggcattctacaaaatgtacttggtcaatactaaatagtttcatttagcagaccagtttattcaagtgcctgacaggagtttcctggattctcacctctcctgagaggccttcaagagcatcgctgaaggtttatctacagctagggtaggttatgagtaatgtcttttatgaaactttgcaaaccaactgtcgttctgttcaattcccagaggcagatttttagggttgctgtgtccaatacagtagccactagccacctgtggctatttcagcttaatttagttaccatcaaataaaatttaaacatcagttcctcagtgacacactagccagtttcaagagtacagtggtcactcttgtcacagtggttattgtatcagacgatacagaacatgttaatcatcatagaaagttctggacagtggtgctctagagtctcaacatgtcacgtgttcaggggatcactggatctaaagccattccttatgggaaatgttggctttcttgaaaatacaccagagaccagagaaggtcaccatgtggagaagaggcagccttcactctgccaagaatgctggccaggcttctctgttttatatctcatcacaatgagggccattctggccctccaaaatatggataccaacctttacgcactgtcagaaatgggccacaattcaaagtgttctctgctgtttctgatgaactgccgttctccagctcttccctgaaatggcaaggaaaagtgatgttccctcaagatctgccaagggagatactccctctctctggtaatcgtcgctgtctccttccatcaggttagactaccagggaagtacctacctgaatagcattagcgtatcttcctcactagaattatctttgatagatcatactttaatgtttataccttgggcttattgataattttaaaaaatcaatatgaagataaacttgcatgtgctgtgaaagtcattcattactaaagatgtagaccattcaggtaaagcactgcataatactcaggatgtgctggtctctctggaagaaccgtgggacctccttccaatggagaatgcaaatgatgtgacccactgttttacattttgccccatctgcccagaactccagagttcaactcagcactcatttatattgacttgattagccatggtggttagaaattggctttctctcccttaaccaggtgtttgattttctgttttagttttaataaccttattgtgtatatcttttaatttaattctccttaaattgttttctgaaagaggcgaagtataaacaaatgaatacaaattttattttcaggtccccacatttgatattttctgttttgaggtagtctctatgcaagccccaaccccaggccctggcataaatgacaggagggcccagggacctcctggcagtctcatttttctttcataccctcctgagtatctagcacactgctaaacatatgctgcttagagtgatgtaaggtagagaaacactgtgccccgcgtgggaaggcattacagaataaacttaggaaagagggtcacctctcagatttagtcagatgacaaaggcagcactggcttccctggggtgtagagataggaaagaatttgaataattatcatcattatcatcaccacattcattaaaccccatctgcacatggcactgtgtaagtccccataggtttttttctctgccagtgagagagaattttgtccagcagggaggcgaatcctgagctctccccagctcaccagtttcctcctcgggctgttccactccacagccagcagcctggctcatcactgaggttgagtccattgcctcctatgttcttgggagatctctgtggtccttggcttataatcatctttcacgttctaggactctggactttccctttacagcactcaccacagtagcaattaagaacattgatgcataatgaattagagattctcttgtagtacattttatccaactagggggtcatctctgttctctgcacccccatatctctagaaccccccattatgtgtggtatgtagccaagtgcttgatgcatattcttagcagtaaatagcaggaatgaatgaatgagtgtgtatccaatttgactttagagttatttcccgacttacagccgttgaagttgctgtttcctccacgtgttcaacctttgggattcacacaatacttgacagtcacagctctgccatgggggacatcattacacaaagcactcctcaccagtagtcagatggcacttgatagctacaggcatgtgaatattcttttactgtcaacttttgttgtgatttcacctaaaatgtgataagctccttgaggataaaggctaagtcttacttcttcgtatttctggtaaccgcttgtaccaaacacctgccaagcattgttgattgcacctatgaggaggtgagaaagtgccaggccgtcatgcccctctatacaaacatgtaacagtagactctggttcatcaggagtaaatgacatgatatgtgatagaccacgtacattcgtggctatagataggtgagtaactgtaaccatatccaattgtgagcaaaagtgttttaattggtggttttaaactaatataaaattggctaaatcatcatttttcagctttcgaatcatctgaagacctttttttattttttaatatttagtcttgttttatttatttatttttgagatggaatcttgctctgtcacctaggctggagtgcagtgatgcaatctcagctcactgcaaccttcacctcccaggttcaagcgattctcttgtctcagcctcctgagtagctgggactataggcacacactaccacacccagctaatttttgtatttttagtagagatggggtttcaccatattggtcaggctggtctcgaactcctgacatcaggtgatccacctgcctcggcctcccaaagtgctgggattacaggcgtgagccaccatgcctgctctgaagatcttttttaaagaactgatagatgtccaggtatggtggctcacacctgtgatcccagcaactcgggaggccaaggtgggaggattgcttgagcctaaaagtttgcatccagcctgggcaacatagcaagaccttgtttctaaaaaaaaaaaaaaaaaaaaaaaaaattatgtaaaaacttttttttttcttttaagtactggtaggactggatcctaccacaggaaaaaaataataatctctagggctaggtaccagacaatgaaatatattttttaaataactcactttttaaaaaatttccacttttattttagatttaggggctacatgtgcaggtttgttacatgggtatattttgtgatgctgaggtttggagtatgaatgatctcatcagccaggtactgagcgcagtacccaatagtttttcaacccttcccctcatccttccctctcgcctctcatagaccccaatgtctattgttgccatttttatgtccatgtctacccagtggttagcccccacttacaaatgacagcattcagtatttggttttctcttcctgcgttaattcacttaagataatggcctccagctgcactcgtgttgctgcaaaggacgtgattttgttgctttttctggctgcatagtattccatcgtgtatatgtattacactgtctttatccagtccaccgttgatgggcacctaggttgattctgtgtcttcactcttgtgaatagtgctgtgatgaacagctgagtgcaggtgtcctttatggtagaccatttattttcttttggatatatacccagtaatgggatttctgggtcaaatggtaattctgttttaagttctttgaaaaacctgcaaactgctttccataggcactgaactaatttaccttcccaccagcagtgtataagcattcccttttctctacagccttgccagcatctgttgtttttacttttaataatagccattctgactggtgtgagatgatagcgtattgtgattttgatttgaatttctctgttgactagtgatgttgagcattttttcatgtgttgtatgtcttcttttgaaaagtgtctgtgtgttttacccatttttaatggggttatttgttttgtgcttgttcagttgtttgagttccttatagattctggatattagacctttatcagatgcataatttgcaaatgttttctcccattctgtggattgcctcttttctctgttgatagcttcttttgctgtggagctcagatgtttttaatgtgcaaacatagttgagaactactaacccagtcttcgggtattaatcagcaccagctcattattccatctctgccaacactcaatcacaatttgctctagtttggtaactgccctcgttcagatggagcagagttggaattttacagtgtagggctggcgccagttcctgtcattctccatccaattccgagccaagtgtccagccttagcagggatcccacatgcaatggaaaaagggatgctttgttctcagaatggcttattcatttactagatgtgcatttagcatctgttatgtacacggtggaggaaaagacagttaatttctgtgctgtgcagtcaaggttgggataaacgtggtcaggatgtcatgggagcttcaaagaaaggaaacaggcccctgtgtagagtcatcaaaagagactttctgaaggtgatattaaaaccaagccctgaaagttgcatggaagcttgccgggatactctttccccgtctttcacctggctgatggaagagcatgggcacaggtatggaggtgtgcacgaaggtggctcattgatctataagtagaaatttctataaatagaaattgtggttgaagcacagggcacaagtgtggcaaagcaatgccttggaagccatgcgggcaatgttgagagacagcccaaagaggtaagcagaggccagatcaaaaaaacatgtttatttgccatggtgggacagatttaccatgaagctcttgaagcttaagctgcagggcccctggggaggggccacatgttgggctttgttccttttttaatttgcaaaactatatatatatatacatatatatatagtatatatatatatgtatatatatatatatgtatatgtatatataaattatataagcttcaggctctacaaaaacctggatctgaagcttaaggacctttactttttcctgaaggtaataggagttaatgaagaagggaagagatgtgagttttagctaggattataatttatcattgaaactgagatactttgagagtaaaagaccatgctattaatagtatacctacatccctccccctcccccccaaaaaatccagtaatcagaactttccttggcaaaaagcagtgtatgaagactttgattttagcccacttggttggtaatcttaagatgcagttacaggaggttgagactggagcagggagaccagttaggatgctgttacattcaaaggagatgatcagggccagaattaagacagcattaaagaaactgaagacaagcagttgggatcctcaggatgggaaagcacgggtaaacgggcaggagacctctgggcgccatttctgaaccgggcagctgggtagatagatggcggtgtcttcccttggcctgatggaacagggagggggtggcagacattggggggaagtggggattccagctgaatgtaaggatgtcgggaagtgcctgtggaagagccaagagaggacgagtttagtaagtactgaggttctggtggcaggttcatatccatcgcggggcagtcgggtttgctgtactgccacagatgccaaccgtctgcagatgccacttggagatggaaaccacctaatgcaagaagaggtcaggtagcagcatggatggctcagtgcaaaccaacccttctatttaaaacacagctaggccaggcatggtggctcacgcctgtaagcctagcattttgggaaaccaaggtgggaggatcacctgagctcaagagtttgagaccagcttggccaacagggtgaaacctcgtctctactaaaaatacaaaaaattagccaggcgtggtggcaggcatctgtaatctcagctactcaggaggctaaggcatgagaatctgctgaaccggggaggccaaggctgccgtgagctgagatcgtgccactgcactccagcctgggcgacaaagcgagactccatctcaaaaaaagggaagaaaaaaaaaaagcccacagctaaaagccagcccttctgtggtcatagcagccaacatacatggtagggcctgaatccatccccttgccacctcccttagcagcctgaatagaggcaggcgcgtctcagatcatggcagctggtgactgacggagcccctgattctctgagctgaccatataagctgaccctggatttacttaaagttaattttcatcatcatcagcctcgctgtctcaccagccccacctaattctaaatttacctaaggttctttttttttttcttttttaaaagctttaggtctatattttggacagaagatggtcttttagctcctgatctcatacttaaataaaaatgctctcatattctccttgatatatttgcctattggatttgtttaatgaaatatggatttataccataaatattggagtcgtgtagtccatatttcaattaatggatcatttatatgtcatgctaactttgtaattactgaaatgtaggaatagagtggattgaaatgaatttctgttcatctttccattcctgcccccatccaggcatgtctgagcagcttggatcgcaaaagggcaagatttacacatggggtttgcagaggaaaggggtagggggctcggaaaggcggcctcctctgcgtgtgccaggagagctctatattgcagtgtgctttctgggttcacctaggcagcgttacacagctgtcctcagaggagcggaaagctgggctctggctggagggcccggtcatcaatatgctgacaggccttcatcatcattttcatctcggttgtaaagcacagcctattttccctctttgccaaatctctgctccaaatgtacataactatagatttctgactgagccctgctgccaggaatcaaccagaaagcttcaccagacctctaagacagaggacaagtaaattgtgttctcggctcccgtgaacggggcctgtcactttaactggtttcttctcaggcagtgggtacagcccaggacacccttagtgaacttgccactgcccctggttttctttctctctctttcctgctcttcctctcctgcctgctgtttgctgaccagaaaaatctggctggagaggcccatgcagtgagtgaacatcacatacataattctatcagaatatatccaagggtggggaatcattgttctcggaactagctgagctgaagcccgagcagaaatactaaagtcagtcgtgcctttgagctgcctctaacagcgccctttagagacccatttcatacaaaatttgaagcctgtgtttattgcccattaaagcaacctttattttatggcaaatgttgcagtaattgccttttacgaagagcactttgtaacacacatgcacagttgaaagaaaaccactctggtattgtctatcgggacttaatggcgcaattaattttactccatctgttcctgagactttaaaggaaaatggattttttttttgagcgtactttaatgaagaagataaagcggcccggctggtgtcccacaggctcggcgcagtaagttcagattattgctcagtctgtcagaatgggctgcttccctcagcagcagccacagccagcaacccgctctggcccctcgccgcgccattcctgatgacaaactgccagccagctcccacaaaagcacgattaaaatgtcagcacaggatgacgaaggggccaagagggtcctcagagacaaactgtgttcagtgtgagttaatactttacagcagggctggggcccggcttgctgcgggctggccgggctgctggctcgccttgaagagaacaccagggcaggggctggcgactggcggcggggaagcatgtgcacatgcgtgtctgcactgctgtgtgcgtgtcgggcatgctgctctgtgcgggaagaggctcgtttcagaggaagcgtccaatgggccgttcaggttagggagttccgagactctccatgatttctgaaccgtgggggacggggtggtcgcaacctagaatgtgggctggagagcgctgtcccagtggtggccccgaggccacaggttctgtcccagatgttctcagcaccattttagcgacaagggcagctatgaaaatggcccagctgcagaaagtcattcctcacgaagaaatgggtgtgcagagaatacagtcagcaccatttatagccccatgtccccaaccttagcctttgcacggttggctgggccacagcaaggggctcagcagcaaaatatccttgaatcaatactgctgcttgacagcatctccagccccgcgcccgtgtgtgctaacttgctagggggcagggcgcactctgccgctttggcttagttctcccatgtcccttgattcagtggtgtgaccagaggggagactgcctgtggtgaaaaggacaaggagatttgcatctctggcctcctgtggagacccgatctgccgtcctggtgggcagcaggtgtgagcgcctgccattgtccctaatggttattacaagtgataagcaggacaaatgtgaagtcatctctcctgctggcaggtcagagggggctggatttagagcccctaggagactaggaaattagatggtcagtacccaccgtggaggttgtagcaactccaggctccagagatcctggacaggggtgattccagatgtagactcatacttgaaaggcatcaagagcatccattgttaggacggaggtacagcagtaattagtgcagagtgctaatagaggaacagaaggtaggaaggaggccccagcgaaaggcagccgggggattcggtttcctctaggtccagaaccgtgggctgagatttcacaaaggagaagtgagggaagccctgctggtttctcattaagccccttggcctttgctcattcttcgtgggctccaatggagggtggaccctgtggcttcttcactttgctctctgacctcttcagccccttctctgctctcttctctgcttgtcctaggactgctgtctgcaggcacagatgccccccgttgagccacgcaggtttctgtgaatctgaggttctaactccctgctgccactctctggctcccacgtcttccctgcctgacactcccctcccttccatccatcaccctcctctctcctaagagtgctctctgaatcttattgcctttttatgtctctcttgggttcttcctcctgccctctccctgagcatggttttccttttttggagcatcccacagctcatgccattaatggagtcataatagccacggttggcttttcccgagcaaacagacttctgtgggctgcagaggacacagacccccactggtggctcgaaacacccctcctgcaggcagttcacaggctggacctttaaggttcccaccagccaggccacacattggttcctccatatttgtacaaaaagatgtgagccaggagcagtaggcaaagccctctaccttggggggaaaaaaaaaagttggtctggaggataatggaaattcgcatggggcgagggctctgagagcagcatccatgccccatggggtagagggcaagacagtgactgtccgggggccttttcagggtcgcttggtgaaacacaccctatatgaatgtgttgggagaacctaaagcagaagggagagacatagagcaaaatcagagcgagggtccccccacctcttcactctggctctgggaagagactgctggaggattctccacagcacagctcactcacccatccatttgctcaccaagtacttactaagcttctctccaggtagctaaagacacagaacatgggccaggtgcagtggctcacgcctgtaagcccagcactttgggaagccgaggtaggtggtgaagtcaggagttcgagaccagcctggccaacatggtgaaacctgtctctactaaaaatacaaaaattatccgggtgtggtggtggtcatctgtaatcccagctgctcgggaggctgaggcaggagaatcacttgaaccctggaggcggaggttgcagtgagctgagatcccaccactgcactctagcctgggccacagagcaagactccgtctcaaaaaaaaaaaaaaaaaaaggacagaacacatggaatgcctgatccttgattgggccgtaggtctagattttttaaaagcttgtatataggatatttgaggggacagctggggaaatttgaatgtgaaccgtctattaaataatgcctcaattgaaatttctgggtgtggtaatgttcttactctaggaaataatacactttcctaaattttaagatggtttaggaaaaagaaatacacaaagaaacacacattcacagataaatgtggagaaatgttcatcattgtcggatgctggtgaagggtgatggctgtgtcaggattattctaggtactagatccatatcatcagcattgattctgggtactagatgtatatcatcagtgctgattctaggtactagatccatatcatcagtgctgattctaggtactagatccatatcatcagtgctgattctaggtacgagaaacatcagtgaacaaaaccagcaaaaggtccctgcccttgtggtgctcaccttctagtggtgagaagagacaaggagaattaatgagtaaaatgggatctgttggaagggggttgggagtgctggagtgggaaggcgccatttgaaataggaggacaggaggcatctccctgtgaaaggggcgtgtgagccaagacttaaagggaacaggaggctgtgcgctgcagagcactccaggcagagggagaagccagcacaaagaacctgggtatagtgtgcctggggcttttatccagaatgtcgagtgtcctgtgaattccactttccagcgatccacctttcatcccccatttgctgttcggcgggcctagccttggaaatgaccttgcatgcttgaggacaccctttggatttaagctgcacgggctggacctgtggcagccctctagagtgcatgcattcagagctgttggcctggctccgtcacctttgtgattcggtacatcattctctccacacacaagatctttcctgccccagtgtcaagggcgataaccacgatgaggagaaagcacgaggctaggaataagaccatgtgcatatggacccacatcctccatcccatctgattcagcggggtgacctcagccaaccacttggcttttcttagcctcagcgttcctcctctgtaaaatgggagtaggtgcaacttcctcccagaaaggttaagaagatgagatgaaagtgagcaaaggcagattgtgagctgcacattgcggaaactgttagctctctagacattcttggtctctgagcagcttagtgttgggggctggggttagcagacatggtccttggttgctggtctcctgctgagtaaccggagccttgaagtgagtcacagagccttataccccttcaccatctgtaaagagggagtcaccacttagtgacgtctgctgtgtcatccacctctgagagtgggattccaagaaccagagtaccgagtgccttatgaattccactctgcgaaaaaattaatagtaccttggggtctttcatgccacgttagaggttggcttctgctgcaggctagccaggcattgctcgacagggcatcttgtttgagctcctcttcatgtctgaaccacaaaggcacaagccctttcaaggacatgacattcagatgtgcctctcctgtgtgtcctctcaactttgtgacttacccccttggctgccagtgaggccttctgaacattgtgaaggcagagagggctttatagcaatcaggctactctttggaaattgtgctgccttttagtggagataggttagctcctgcaaatcctcgaggccatggtgagcagccagcccctccccacagcccgtcccaggccttgaagggcttcatctgaggacccgaaggcctgggttcctaagctctccctgagcaccatttgggcaagtcatacacagagagggagaggaaacgagttttaggagttcttagctgggttgttcccatctctaggtggcctggcagtgggaaggagagaggtgagaagagcattgtttatcaggtactgtcagaggactattcctggaaaacactgctgaatcttctagaaggggtgatttgtgttctttccatattggcaggttttcatttccctgcttaacatgactaaggactgcaggacctgtgcatgctgttaggtaactctggccccaagatggaccctaggagagactttgacacacaattgatgatgtgccaggtggatagaagtggaagtgcagagcacccaggcactttcagccaattagtctggaaatgacatccaagaggcagagaggtactggctgtgctgcctccattcgtgtgtttgcctctggagcaaaatcaggctgggctgctctctgtagggatcatgccaaggatttggcagctctctggaagaaggagtgatttggccaagtagatgtgggcctcttatgtctccggcaggtcttcagactcaaattcttaagagaccaaatgacatcttgcctaggctatcaggcagcaccattgcagagaggcatggatgaagctgtgtcacgaggagtggcccgggcaaggtgtgagatggtggcttcacttcctttcacaaactctaaggcagcatgttctccaggtgtggtccctcaccagcagcatcgccacctgggaactaaatcagaaactctgggagtggggcccagagagctgtgttgcagccagtcctctaggtgatgttggtgtgctttcagaaccactactctaagcaataccttcatattgaccactattaagacagatcacttccactgacagagtagttgcttatggcagccatggcaaggtggaaaccgtaggtatcaggagacctgcgttcaagtccccctcttatggatacattttgtgggaccttagaaaaaacacggaacttttttgagccagtttattaatttataaagtgggaataatcatacatcatctccgtggattttgtgaggattaagttaaattgatggcctacaaaaatacatttttttttttttttgagacagagtctcactctgtctcccaggctggagtgcagttgtgtgatcatagcttactgcagcctcaaactcctgggctcaagggatcctcccacctcagcctccccaagatctgagactacaggcatgcactaccatgcccaagtaattttttttttaagagatgggggtcttgctatgttgcccaggctagtcttgaactcgtggcctcaagtgatcctcccaccttagccttccaaagtgctgggattataggcgtgagccaccacacctgtccagaaagtgctttttaacttccagtattttgcatgtaagatggcattgttatgtttatcgaacacctgccagtttccaggcaaacgtgatccttatgtgttatgtcaggtaggttgtctttttatccccaattttacacaagataaaactgaggctcaggctttaaacttggtagagcaggacatttagcctggttcagcctgattccatgttggccttggagtttcactgggagtccatgttcttaaccattatgctttttaaaagttctcatcctggcttaaccatcatctgtgacactttcaaaaatactgagattgaggccactggtttgatgtggggctcggccactgagtttctttaaaaccttcctggatgtttggaatatgtagatagggttgaaaccatagtacgttgcgtatataccaccacccttccatctcagaacagatgctgcaaatccagagttacataaattcaaagtaagggacacagagctttagcaaaccatgggcagtcaataagtgcttattagatttgtgaattaagaagttttaaaatagcattcactgcaattttaataaatcagataacaggtgttcattttgggcaagtcgaagagtccaggaaactggaggaatataatgttacccacaatttgagaacccctttttgtgaggcctcaggaggtaggaagaggtaggcgttgttcttcccacattagagcaagaaaagcagccccaggaaggctcagcgatttccctaagtaggggtattttgggggttggtttttatagatggtgggcaaggggataatagtgtaaattttgtactttgagcttttgggtaaataggcagattctgaaaccattgtgttgtatctactgattactataaaggcacagatccaggctctttgttaactccctggcagactgagtgcttccaagtgcaatttccctcccctcctttctttagaaattacctcgagctgcaaagtgagttgggctcaggttggcatgcaggcattttccattccaagggacaggaagtggctgtgaatcttgtaacctgtattccttctttgagagtctatagagttggaaataaagacacagaagtctcctgagtgccctggcagtgcttccctggatgaagggtttggggagaacttctagagagccagactttcattaccgaaactccccatctttctccccaaacccaaagtagcagtgagacctgctgatcaccttcatgtaaaagaatagtaataatccccccgaatcctgtccaaaccacagaaccctgcaggttttggacgagtcccgccataaaaccactttcccatgacttcccgaacagtaaaccccagcttgggtaccagggaatggcgctttcagtttttaatggactgcagctgaagcaagttcaaaagtgcgaggattgtaaacttgagagcaactctgcagatgccgcacaccgtggcagaatgattcagggggccaaactttgcctcatcaagtcagagaattttctgcaaatgaacttttcaagaattatgccgtcgttggcattacagtattacacacatgcctgttcccgatcactcactggaacttattttgtagttaacctccataaaggactgtgcgagcgagcacaggcctgtcacacacacattatttagaagcccttattattattttattgccagtccttgacagctgaggaaaagccaagcgctttaatctttttttccctttagtttacagtgtaagagctgcatgtaagatggatttgattaatatgtaacagagatgcaattctctgtaaaatgtgctgtactttagcaccctggaaaacaaactgcatcacaatggcttaaatctcggtccattgtattatatagacatcataaataatagagagcaggcagatattgctgcaggcttcatctgcataacacatctgagctctctataatgtgttcaacttgtcacttttagtacagaagagaggtaataaagctaacagctgactaacacacatcagccctacttctacttccaggggggtgaatgctcattaagccatcttagccctgacttttaaaatccataactcttacaaatgtaaaaaagttgccgcaaaagattaagcgcataatatatgtcaaagtataatgttttatgcatctcccccaactaccactccccgctgccgccgccaccaccacaccaaaagtctggtttcttttatagccttctcactagacgaaagaaaataaaaaatctggttctcagataaaaccaaatgaaatattattttcccagcatcactaagggactaggtaattgcttttgagtttgaagcacatgagctgaccccaagaaggttgaagattgaaacctttccccctctcctctaagaccagctcaaaggaaacagggagcttgggcccaggagtttgagaccagcctgggcaacataggaacaccctatctttacccaccaataaataagccaggcaggtgtgtggtgcgtgcctgtggtctcagctactgggggggtggtgaggcaggaggattgcttaacctgggaggttgaggctgcagtgagctatgattacaccaccgcactccagcctgggtgatagagcgagaccctgtctcaaaaaaaaaaaaaaaaaaaatagggaatcagtcatccccactgggaccttgcagacaggccactagatcagtcttagctgccttaagcacgcccttacatttacttgcctcagtttccctattggaaaccagaagggagtaaacccctccattttctttctgaggggactataaggccgagttcagcactgcttgtcatttacttgcctcagtttccctatcagaagtcagaagagaggaaacccctccattccctctctgagaggactacaaggctgagttcagcactgcttgtgcaatcacagttgacagaggtttcagagtctctgttgtgctcttctgattagcagtcttgtgttttagaggaaaatttgaaaacattacggtatgtcattttctgtaatgatggctgagcctttttagggattaaggctgtcaggcagaaaagagaaaaggatgtttatactcttaactcagagcagatttaatcctatgggatgcattttggtgggctaggggagcattgtggtctctttctcggggaggctgtgatgtatacagtacacggatgtgcatgtctcatgacattcatctctttcgaaaatatactttagaacatttctcttggagctcctaagaaaaataaatggttggtggtggcccggatggtaggaagacaggttaggatgaaacaggaaatttttcttagtagttataaatctctcaaggggaaaagttagagccccaacacttgactcatttagaacaagttgaaccaacctctgaaaaataaactcacagggggaaaaaaaaaaaaaaaaaaaaaccataaaaaatcctgcatgaggtcaggggactggcatgctaggctaatagaaactggaagtcagcgcagacatcccaggatgcactagaataacatactgtttacttctgtgattagctcagaactaatggtgtgtgtgtgtgtgtgtgtgtaagtgtgtaagagaccaactgagacacaggggctttcattgataccagtggtgcttgtgggcggggattgaaagacggcttggttcccttggctaggagtgtgggcctagaacagtaacacacttttccactggtcacaatgacagtttgtttttggagaaagccatcattaaactgtgatgtgggccgtagcactgctacctcagaattctgttgctgtccaccaggcaggccctgaaagctcagctttccgttgctagagcccacgccgtcatcccttcttgcccatattcctgcagcagcttccagtctcatctcccagcctcccgggcttctgatctcccccgttccacatggcagccagtgtggccacatcatttctcacctcccaggcctgccattcaaagtcatccacagttgcttctttttctctctcattggtctaatccctcacccagcttccagccacactagtccacccggctccagccatgctggtccattagatgtttctagttatgctcagtactttcccatctgcattcaagctgttcctctggctcagaacactctttatctttgtaaattgaagtcctattcccatctttgaagagtcaccatgaaccctacccttcaggaagactcactagacccctacttgaaataggtctttcgccaggcgcggtggctcatgcctgtaatcccagcactttgggaggccaaggcaggcggatcacaaggtcaggagatcaagaccatcctggctaacacggtgaaaccccatctctactaaaaatacaaaaaaaaaatagccgggcatggcggtcagcacctgtagtcccagctactcgggagactgaggcaggagaatggcgtgaacccgggaggcagagcttgcagtgagcggagatcgcaccactgcactccagcctgggcaacagagcgagactccatctcaaaaaaaagaaaaaagaaataggtctttcataaatctgtgagctcaccagttaactaagttaactaaggtaatcaggttccttagttcagaacacactgtcatcctggatccatgggaggccgcccttagttttccccactatcctggcctgctccccaattctcagacacccagcctcatgtgcctgatatgtaaccttgtcaagtagatagtgttcttctgtgtgggtgttttgtttacataagtgatgatatgctataaatcttagttctgtttcttgtcactccacataacatttttagaatctggccttgctggtggttgcacatgtgtttgttgcttctcaataataccgaatattctatagtgcacattcccctagtatcagatagctaaggttgccctcaacttctcccatgaaattagcaccacaatcaagcacacactgtcaccataaccatccttgtaatgtgtctatttatggaattctgcaatctacctgcggtgcatgtaagttctaatttccagatgtccttgcccacacttgctgttattcacctttctagcttttgccatcttgatagtataaagtattataaggagttgaccatttttctgagtttctgatttcttgttgatttgcatttttggtataatttaactatgggtcattggctattattttggacactcaagtatcttcttcaaatctgttgcccattagctaactgtagtgaccttgatgttaagagatctttacttttgctatagtgaaacaaatacatattttggcctcacttaatgttctgggagtatctggtttaataagtctttttctatccttcgtgcacagatatcatttcacgtgttcttttattagcttcatagttttatttttcacttttaggtctttgtttcaccccataatactttgtaccatttcctagagtttgccttgaatttatttccaattgtgtcctcaaccaggtgtaaagtcttagaagaactatgttgcattctccatccaagcctcagctttgccgagccttaacctgactgacctacttccctgtgtccatactgatgacattccttccctacattctcagtggaagacatatcactcctcttgtctcaggtcaactttttgtgcatctgagtatctccttccattccatcctcctcagtgacttctcttctgtcttctaagctctctcgctgtcagcacataaacatgcgtgtcaactccccttctcgtgcatcttcctctggctccttgtctcttgaccccattcacttgtcattccttcacagcaactggctttgcctctgcccgttgatggcactgacccatcctcatagaagcttcagtcatttccacttgccaggtgaaggagtccctgcattcatcaggcccaccctgaagggcatgtgaaatgttacgaccacccttcttgatttttgattttttaaatgtttttggttttgtgatattcccgtctcctcatcttcattttgtctctctaacaattctcagatcattttcagtgattcctcagcctccacagattccaagattatgtccactctgatggctctcgccacttttgcatgacaatgatactggactatgtctccatcccaggtcttgcccttagcttcggacccatattttccatagccaacaagatggccaggtgtcttgtggacacggaacattaaaaatgtgcctaatctaggccaggcgtggtggctcacgcccgtaatcccagcactctgggaggccgaggtgggcagatcatgaagtcaagagatcgagaccatcctggccaacagggtgaaaccccgtctctactaaaaatacaaaaattagctgggcatggtggtgcgtgcctgtaatcccagctacccaggaggctgcaggaggagaatcgcttgaacctaggaggctgaggttgcagtgagctgggattacgccactgcactccagtctggcaacagagcgagactccgtctaaaaaaaataaaataaagtaaaagtgtgacaaacctaagttatctttcctcaacctctgtgtcctctgctgattttctgatttttaagtggatcctaagacaggtctctgggaatttttctagactgccttttaaatcaaagaaacaaactttattatcatgtactaattgaatgtatcatctctgatctctctctttccccaaccctgtccaaacctgttcctgtattcccatacccacaattcagccagttaccaaagccccacatcagcaagtctccccagactcttcctttgctgagtgctatgtattttacctctcaaaagactggctcagtccatccctccctttccaccaagacagcctctgctatgacgtcctggctcgccccacctaccatatctgtgctgcagtagacctggggtacggcctgagaatttgctttcctgaccagttccttggtgatgctgaggctgctggtctagacgacactttgggaactactgcttccgttgatttttcccatccatcaattggctcattcaacaagtagttattgagtaccagtgtcaagttctggaattcaacaatgaagaaaacaaggtcatctattgaaaaggttgtggagggaacaaacaaagaataaattcatctataatgtgatgtgtaagtgatacatgctaacaatggttagcatttataaatggttgaagggacggaggagtggtgatggagagggagtcgtcagggaagacttgctatttaggaaaattttgagcagatacctagagggaagagcattccaaacagagggaactgcacgttcttgtgctttaaccatcctaaaacacagtcccgactctatcacttccctcgcggggtcaacagcagccacgtttgactgccattctgcgctctccacgaactgtctcccacacccttttccacacatcgtctcgcacccagactgacctgacttctcccaggtctctctgctgacatttcacttgcctcccctggggcacttatttgtgctattcacccccacccctcctaccttccagcaaatgcccttcttgtgtgtttgcctcatgccagatcctgtaattcattcaacgtttgcttccatttccacctcctccatgaagccttccagaatcatcccctttgaaagtgccctcttcctcctcattccagaaacatttatccccagaagtgctgcataacccttgtggcatctcacccttgtatattcctcacctggcccaactctgtagtccagcaaatgcgtagtagaccttgggtgaaggatggcccagaagtgtttctcctgctccttgacctctccaagaggcgggcctctggtatttcctaaacgctggtggctttactgttgaatcagagcaaaaggagaaaggaaaggccatggcctaaaatggagtattggaatgatctctgggtttctctgtttatcccagctttctttctgtgctattaccaagataattgagttggaaatactagtagcatttccttcatcttccttcaggctcacaagcgttcttcacccaaagggagggagattaattgacttcttttatcttccattcaaatgaggctttcatgtgaatcgctcccaccctcccgccccctcagccctcccaacctcccctcattcattaggagctggacatgaaaaggagagcatctaaaactctgcagagtccctggatctccccagacccctctcttccctcattccccgccaaacatttctgacctggcatcacaacagttcacgtgagaagtgtcacggtggggcagagcagatccaaccggaagctgcaccagccactgaactctctccacaccaccagatggtctggtgctgcagcagcctttcagaattaataactctccctccagaggggcagcttcattcaggaaccgtttcacattttccagctaagtgtggttttttcccatagagttttctggccgctctgttctgggcagaccatggggcctgctcacgaaggcaagagatgtatcttgccttccctccacctttctttgcctttggcttctgacagcgcagcttttaatctggaaattatggtaacttgtatgtgcattttgagagtatatcattgctgcatttaattaacggttattagtgttagcgtactgtgctgtattctatgtcacaaatcatcaagtctcccagagcagttacagcaattaagaactccatcacaccttctgtatagtcatttggtacttttccaggtcttttcaaaactggaaattactaatcaaatcatttctgctgtgtgcctcagtatcgtttattccattcctaatgatgtgcgacttttttttctttggccgttaacagaggcatccgtgcgtctaacccatttcacaccaccgtcatgctttagcgaggcgataatgaacttgcagaaggaaatgcaggctttggttctcttttcagagcagtgtctttcctctcctgctgttgggtgattgaattttgaaactgtaaaatgcatcgacagacctacaaacctgacttgccagagccacagccatcacagttgagcttcaattcagagctcagtgcgactcctgcctgatcaatttgtcatccctctaaatggaaactaattacttcccagggaaagattgcaggcaaatatcagcctttgcatcagcagccctctgcagtgaggttaaggcagagtccatggggtttcaccagaggggccatttccctctctgcctccgtcatgtcaggaagaatttttattatttagagcagcagtgagcttgccgtcacatccactaaggtcagccgtcaagcgtgcatctcacttaataggtcacctggacggtcccaagtcaaatgtcagaggccattcaactgccaggttgcaacaaaaacaccctggcaggcttttgatggtgtttagatggggatgagccagcccgctggaggggagcccaccgcctctggccccccaaggggattctctttttctttatgcccaagaacactgccctggaagcatccccggaatgactgaatcattgccatttgtgcggcatcgaacagactgtgccgctgacagctgtaggcaagattgactccgatgcagtgccaggagatctaggccatgcaaggcggctgctcaaggcccgctctagtgcgagggccctggctcagggcagcagggctggcccagaagctggggccaggaccgggccagccagctcagaggctgttgaacaatctgatcagaggagggccttgccagttccctacctttgcccattttggatgctgttctgctctggccttgctgctcatcattccaggctggctgagcagtttcaaactcagggctgatcctgccacctctgtgtctgggctgagctgcaaggtctttagcccagcattgctcagtcttggacattctcccagcagaagtcagacaagacccaggagagaagtttgttttgttcagcagctgattggatccgctcactgttgacttgtgttccatgttggagaatgcgttctggtccccctgagctgatataaaggagcccaaactcaaatctgtgcccattccacgtttcccctctactccaggatggagagtttttcctctcattcttatccacacagcgaaaaacactagacacagtgagaaacgctggacggctctgggggccgtgggagctgggatgagcactgaacttctctaggcctcagcccacttcgctctgcaagccctgaatgtgcctggacaagatgaccggtaaaggccattccagctctctgtgctttgtagcctgagtccctgtgaggagtggtttgctttgaaacacaatataatccagaaaaaacagctatcttaacttggccagctctgcttttaagcaagaaataaagtgatggtttcttgaaaatgatgctggcctttataatgccttctcccttaatctccccacaaactgagacaaggcatcctgggtcacaccctggctcgtctcctgtgtgatgtgttttctgggacttgcactttggtaaccagaggagactgccaactgggtatcatacctgtctctcaacccctcttctgcccaccaccctctctcagcctccctattccctgaagctagcatgccagggaggcaggtggcatacgtggtacaaggactgcatgcgcacattttggaatgaaacagtggcctttctttggaactcagaccatccagtgtgctctggctaaagacaggattgtagatctaagaagtccattgtactgattagtttcatctcagtttaagccactgacctaccaagagtatccattcaggaaatgtcaccccatggcctgatgtagtggtaggagactggaaatagctgagtgatgacggcatgtacactcagcattgcttagccttgggcaggtaccgaacctttctttgcctcggtttctcatttataacatgggaataatgatagtacttacctcttcagggttctggtgagggttccatgaactaaaacacatgaagagtctagaattgttcctgtgctgtcctaggcccaggatgaatgtgagctgctgtggttacagctagtgtcatagtactccgcccccctccaccaccagactaccacagtttcctgcattctgtgatgccgtcagctcactgagtcaccttcaccaacacctttcacgcctctggacttcagctttctcatctgcagcacgagggagaggaatgggctgaggcttgccatggtgctttcagggacaggcgtgggagcatctgtggtgagtttgcagttctgtgttgtatatgtctgcaccaatgagagtttcatgatcttgaatttatacattcatatcatgaagcacaacctagtagcatgtttagatgtagaaacacgatataaaaacaaaacagaatttgttttggtttttggttttttgttttgtttcgttttgttttttgagacagtctcactttgtcacccaggctggagtgcagtggcgtaatcttggctcactgcgacctccgcctccccctttcaagcaattctcctgtctcagcctcccaagtagctgggattgcaggcatgcactaccacgctcagctaatttttttttaaatttttggtagagacagggcttcaccatgttggccaagctggtctcgaactccttacctcaaatgatctgcctgccttggcctcctaaaatgctgagattacagatatgagccaccgcgcccagccctggaaggaacctttgttaagagttcatagtaacagggtgctaaaatgagtttattaaaataatcccagtagatgaaagattaggagatctcttttgaggaaattagagagtttagatctgttttgaaattagggaatgccttttcctattgacctaagtctctgattatatatgtcaacctcagcttacggaaagaagctgacatgtcaaaataagaagaataggctggatatggtggctcatgcctgtaatcccagcactttggaggctgaggcaggtggattgctttagctcagaagtttgagacctttagattagaagtttgagacctttagattagaagtttgagaccagcctgggcaacatcacgaaaccccatggagcatgtctgtggtctcagctacttgggtgtttgaggtggaaggattactggaccgcaggaggtggaggtggcaatgagccaagatcatgcccctgcactctggcctggcagagtgagaccctgtctcaaaaaaaataaaaaagtaagatgaataaacaatggttaatagaaacataagtggtgggacatgggggtcaggatttaatctcagagtgtcccagtggtgatttattttatttatttatttatttatttatttatttatttatttattttttgagacggagtctcgcactgtcacccgggctggagtgcagtagtgcgatcttggcttgctgcagcctctgcctcctgggttcaaacgattttcttgcctcagcctcccaagcagccaggattacaggtgcccaccaccatgcccagctaattttttgtatttttagtagagatgggccttcaccatgttggccaggctggtcttgaattctggacctcgtgattcacccgcctcggtgtccaaagtgctgggattataggcgtgagccaccgcacccggccccagtggtgattttgtaggtcagcagagatgatctgtgtgccacatttccttgtagcttaacaatgggcctcaatcatgtggtgcttgggttcttagaatgtggacagccaagacattccagccacaagtaacagaacaaaatggcttcaaccatggcaggggggcgggtgtgagtagtgtttctaaatgggactggttaagtattttggggcacggattggcttctctgccattctcttagctttctcctcatgatttcaagatggccgccatagttatcagacactatttcctcaggaagccacactcacagacaggaaggaaaggtgttcttcctcacgtacctctttttatcaggaggaaattcttttctagagaccccatagcaaacttcccctcaggtttcactggccagaactgggttacataccgtctcctaaaacagtcaccgtccaagaataatgggattgccaagggtggcctgagcctcctgtaacaggggaagaccacctgcccacagcatggcgccatgcagtacctgaacaaaacctgggttcagtgaacttgagggctcttgcctgggcaaccaacagggtctgtctgggaccttaaagtcactgattctgacttagcacttaggaatcaggcatgtggtttaatctctctgaatgtcaaagaatgtgagctggtcaagagcagatctagaactagaatctcttttctcttactgtgactctcatccccactcagctttcttcctggaattatttttactttcaaatgtgtgaagtcagacatacaacaattgtgcatttcacttgaaactagtatctcgttgattgctaccaagaatgttgtttaaaattgagaagtacatacatttacctctacatatctccagtgaacttctgtgaccattaactgtcaattttatcagattcattttacacgcaaagcaaacacatctacacccttgtctcaagaagtttccaggctagatgaaaaaactgttcctgtacccatgacagttagacataaattaatagtgccaactaattgattgatgaccagagttcaaatcaggggaagaaaggatcacgttgagggcatggctgaggcccaagagaatgatttcaatggacagagaggaaggaggaggaagtccgaatgggatgaagataatgttgatagtaatgatcaacattacagttatgagcacttgctgatatgagtaatgatcaactacagttattgagcacttgctgtttgagataaagttctaagcactttacatgtcttaacttatttcatcctcacaaaagctattatgagatgggattattgtcttctcattatttccgctatatagataaggatcatgacatacaaagaagttaaataaggtacccagtgccctagagttagtaaatggtaaagctggacccaggtaatgtggcttcatagcctgccccctctctggtgctcagcctcatttactgtagcaaactcacgaaactgggaaacccagggttttgtgaggcgacttctgtacaggtgttccttaacttacattggggttacatcccgataaacccttcatacgtggaaaatattttaagtcaaaaatgcatttaatacacttaacctactgagcattgtagcttagcccagccccccttaaacacgctcaaaacacttacattagcctaccatcgggcagaatcaactaacataagcctgtttcataataaagtgttgaggatctcatgtaatttattgaatactgtactgaaagtgaaaaacaagatggttgtatgggtacctgaagtgcagtttctactgagtgcatattgctttcataccagcataaagtcgaaaaatcgtaagctgagccatcggaagttagggaccatctgtatgttgatttagctgaagggaggatttataggcaaaatagtgagataaaaggtagggaaagttttcactgaattcagaagtatttggaactggggctggtcatctggatcccagaaaacactggcaaacacacgcacagaaatgcacagaaaaagaataccccaacattgaacaccaaaggccctcagactttggcgcctccattttgaaggtgagggatgtttctatgtgtctgtaagcagtgaagacatcaccggattatgatcacatcatacattgcacacgccgtcacggttgcacgttgctctaatcccatgtatattactgtgtctatttggaaagctgcaagagccatttatttatgagtgactaagtggtagttgactgccttcaactcctcatgttttacaaagtaggaatccacagagaatagcagtaaccaatacaccaaaccaccttcattttgagatgaatactgagaagtctttcattactctgcagtataaagtgtttactaaacagaattaagccacagcataataccctgccttccttcttctctatttgattcgtcctacttaacaccagcaaaagtacttctgccattttttttttagggttagacaatttatgccatttaaagtgtaaaaatggaatttacttggcagttagagggaaaagaattgacattatctagacacaaggagttcatgggtataaagtctcagatcatcatttctgctaaagatcaagtacctaagtaaatgtaaaagactacactgagagagacatccccagttggaaaatgtgccaagtcatagaaaattgtggtagccctgaattttcaagaatggttttggccagatgtggtggcgtgcgcctgtagtctcagctactcgagaggctgaggcaggaggatcatttgaacccaggagtttgagttcagcctgggcaacatagcaagaccctgtgtcttacttttttaaaaaaagaatggttttattggtgtattttgattattgtaaactaattgtagactctaatttactcttggatattgagatctgttttgactcttggcaatggtggtgttttttggtgattggttgatgttttatctggcctgatatccagattcttttttgtaatgtacatactctttcctgatatcgtttatatgacaatcctcccctccccttatttaaatagaggtttaaaagtttaacaagcccaggtgtggtggctcatgcctataatcccagcactttgggaggtcaagagaggaggatcacttgagcccaggaattcaagaccagcctgggcaacataggaagactctatctctacaaaaaaataaaaaatcaaccaggcatggtggtacacacctgcagtcctacctactcaggaggctgagacaggaggattgctttcgaggctgcatgagctatgatcatgccactgcactccagcttgggcaatagagtgagaccttgtctcaaaaaaaaattaataaccctatctctcatacttttatattttctctttggaaacctaaccctcaatatatttcaaatgccttgtaaatggcttttgaagaatgcttcacactggatacctgggttctaatcctaattctaatacttaactgtgaacacggatgaagtatgtcagtctctgtgatccttacgccctagacttcccttccccaagtggtttgccaccattaccaattaaaatcctatacctctctgagatccagttcaaatgctacttcttgaagctctttttgatactgctttctcactttcctcaagaggccattatgtcctgtccttttgaagggcatgtttctcaaaagccaaggttgtacctttagtttcttgagagccaaggttgcatctttagtatcttcagtcatctttgcaccccagaatgtttagcacagagcttgcccatgatggctactcaaatgctgaaaggatgaatgactaaataaatcttgagatcagttgtatttttttctttaaaataactggctacagtcactggctctcaaccctggtgttgggctcatggggacattgtaatcagttgtaagcgggttgaagtgatttgttatgaatgattgttaggttttggaagtttgcaaactatgtactgtttgtataaattagaatgtttcccttcagtaatattctttaatgataatatcatcatcctgcagtgttaatacttcagtgtgacactctcccttgcattgtgatttgtcttaaatggaagaaaaaaggatggacttagagtcaggacccaggaaattgtatgttaatccacagcctatcttttctgtgccaaagcccataataagccagaaatcactgctaatggttatggaactatggaaatatgatagtcctctactactgtacgagatgtgggggccttgtcaaaatgaacattatctgtcaatttagagaaaagaataaccattactctaaaccaggggtcagcaaacttttacagtaaaggtctagatagtaaatatttgagggcttttgagggccatacagtctctgtagcaactacccaacttcgctattgtaatgcaaaaaagctattgtaatacataaatggatggacatcactatgttccaataaaactttatttacaaaaataagacggaggtcacattgggcttaatgagctgctctaagccatagagtacatgggaatgtaaaccatactgcttattttttttaattgtattaatggcatttattctacttcctttgtaatagctaaggagttcctgcaaagaaagaaaaattaggggttagtaaatttgttacttatttgcaagaatattcagtatatatttcagggttaatattctctagactttctcagcataagaaatgagatgaaattctgttgatgttgtaaataccactattgaggctaattcgtgaaagaaaggtgactacggtatttgatgaagtaccttgtcttccaagaagtttgcttttgtggtattatctgtggcacgttattttctgtcttggtactttctctcagtgggatatttaggctctactttcctgcttggcacttttgttaataatgactttaaaaatcctcacttctctttttaaattgctgcatggagtaatagcctctctccttgacagtcaaaaggccaagaagtgcaactatgtgaaataaacttttaaaacaaggccccaagtgcactgcaagttgacttgaaataattagtccctggagtttggacacccacaaagtatctttcggaactcggattcagaaatgtctcagtgacagcctgtggcgggaagccatcacagcagcagggcccattgctcttgggacatcccacactgtagagttactttggcagtgcctggaagcagcggcccctgcccacatggcttttccactgtctcacagccaagaaccatgacaggcccctcagaacttgggccctctccagtccttgagccagtgttcaccctcacaggaagagtgtttccctgttttatcagcaagtaacagaaaacccagatgactgcagcttacaaagtaaagacatttctctcccattacaagaagcgtggagaaagcatgttgtagaggctcagtgttgtcacagaggacctaggacccttccaccttcctatgctgccatctcagtgttgggggatgacttccctcatggatgcaagaaggttactgaaacgccaagtataatgtcactacctcatgtggcaccgtgctttacggtaagggggtgagcataaacagaggggattccaagtgctgttctgtttgagcaggggacatttttcccagaagcccctggtggttttcttcttgggacctgcttgcttgaacagcatcacctgcctctggcataggggaaagagattgccgttattggcttagaccaatcactaccttccctggcactggacacatgccacatcagggttctactggaagacaagagaaagggatggctactgggggagcagccaacccaggtctgccacacccagctgaaccccctagacagtggtcagagcaccttttgctttgaccgaggaatcccaagccttgccaagaatctatggccagtcctctgggattattgccagcagttttttctgtttgttgatcatctgcagacacctgattccctgtcagtgctttttctgtttgacaggacttcttgatgcccaccaggatcgagcttgccgagtcttttggatgttgtgtgttatccacccagccaagtctttttggggaatatttatggaaatatttatatataaataaataatatttatatttccagaggtgctctgtacctctgtctatcccttttgggggataggtaagccactttggggccctcaatcccttaacaaaaataatttcatttttcttagtaaaatcatataatgtctgcatttttcctttgcagtacagaaatacatgattggtattttttaatagattacttttctggaacagatattattttgaaaatttaaaataaatttgaagagttctcttctaccagtcttaatttcatggaatagtttaaatattatttaattccatggtctaaactattggctcttattgtctttttttttaatattatgtatataaaattaggaactcatttaagaacagcaagaattgatttaatctgtgagatgccaaatggagctaatcctgaaatactttctatctgtagagattgatagtttacaaagcactttcatacatattatttcagtactttccataactattatctgcatttgacggatgaagaaataagggtataagagctgaggtgacttggccaggatcctaccagccttcacagagttggcactggagcctgggccttcacagcctgcctctgagacactgtcctgtttctagcacttaagttccagtgtctatggcagcatgcaataggattacaggaggacatcgtagccacagataacccggccatgttacctgttcatttcaacctctgcgactaggcccagatttctcaggacatttccttccccatgagctgaattttaacatgcaaatgtcactcacatcctacaagctaaggtgtatgggtttatgctgggactaggtcatatctgtattttaaaaatcccagaacaaccccagcagtggttttagagatgaggaagagaggagacagaacaagttctgctggttaccctgctcttggacttctcaggtgcttcattaatatcatctctgatggcattttgatgccatttttctgatggcattttgcagcttgcctcaagtgtcccttctggttttctaatgtaggacaaagcccaaggatgagtggctgcggttgccagtcagcattctctgcagatgtctttggtgtgtgtagctggggttaacccgccgtcttaatgtctgcctactcggttttgcatgcaaggatacattatacaagaaaattccatcgagatcatgtacaagtaaaatcagcttattttttccgaagaggcaggggagctacttcttagcagagtgagctgtagagtctctctggaatgcaaaacacagacctttgtattagaagtgaaatatttagatagggatcattatggagctctttttatagcaaggcaggcctgaaaaacagagagagagctgggaaaggaagcacaaaggaggtaataatatctgattagctaagcagctggataactgaaggagaatttgttaaaaacctatcaagacatcaaagctagatgtgagttgctctgttagcccaggccacttgtggagccatctctggaatattactgagcatctaatttgctgctattttttcccctagcgtcactccttcactaagggatctgagctgtaacctgacctgtagctgtcatcagggctttttttccatccctgtcatggcatgggatcccagtatggagaagcttagttggtattcaagtcatccgcatcgtacttgaccacgtgtgaacaagtaacctcatgtttctggggacaggcagggagaaacttgagaacttgatccccttgggggcccttggaggattgcttccaccaagccctgggttttgcaagtgactcgtttcccaatctatggcacatccaagcctctttggttttctttttccctgttcacacggatatatttgaggcaccatactctatctgcccaagaaaggaagaggggcaaggaaaaccgtgtaagtcatgcttgtttaaatattttggcttctgccaaagcagatatgagaacaattggactataatgagagttttccattggcctcaactatcctggacagttgaacgccaagcctagtttgataggtacctactatggacctggtggagctccttcttaaaattagacagtgtgtactggccagaatgtctcagcttgcagcctgaggatgattatgctgatcctggaggccctggggaactgtctagggcactaggggtgcctgtgctaacagcaaaagaccactcccccccaacaccacacttgcacatgcctcatgcacagaggaagtaggtgccaggtcttttcagagaagagcttcaaagccctgctgccacctacgagagcctttgatccatctctcggctgaatccagcccctcacggggctgatccgctttgaaaccagagccagcagcccctctacaactccctctgagttacctcacacagacaagagcacaggcttctggggggcttctttttatcttccctaaattgcgagaggtacttctttcagcgttgtcctataggattcttaagaactgccggggagatgtcttagggccaacacaaagaattgcaaacaacagcccagtgtcttggaaactttctctacagtttagtacggataaaccacatgcagatagaaaataggaagaaaaggaaattcatggtaagcctgcgtattttcttatttcgggtgcgaggggagtggagaaatccgtcatggataaaatccaactttaatgacagtctgaagccctgaagcacagacatattgcagagctaatgtattattttgtttttgtttattctgcagaaatggggaaatttcattttttagtagaattacaagctccccttttactattcacaagccctaacatgcatggcatcctgagccagagagccttccgtgattttaataccagcttctttgtgaatctaaactggttttccagtccactccctggcgggccacgggggttgttggagtggtgttacacatacttagctttctttgggtgcttgaccaccgcctgttctcaggggggacaaggagccttgctgtgggcattaccagtgggaggtaggcatggacagtgaggttcggcacctgacctctgaattcccgcggcccttgcaggatatcacgcccacgactggcggtcctcagcctgaactgcgcgttggaatcacctgggaagctttaaacatactaaacctgggccctgctaaatgacacccgtattctgatataatgggtctgggtgtggcctggatattaagatttctgactttcccctcccacctaggtgattccatgtgcggtccgggctgagagccactgtcccgcagcctcatcatacagcttgcctaggttccacggctgtgtcacttcctggccatgtgaccccgggcatgttaactgagctcagcttccttgtttgtaacataggggaatcactgcaagattcattacacctatctcctagagattattgcaggggttcaagttatggacattactgggaggataccatggaccagacactgttgtgggacctggaactgttatggctgggaaaaaaagagatcagagtccctgcctttgtggcgcttctttattttctagtcatggatatggtggataaacaaacaaacttgcatatacatagtgtaatgtcaaatcgtgggcagtactgtgaagggaaaatatggccaaggggaagggtggcaagtggcaggagagagtgcatgcacataaagggcacatgcagtcccgggctgtcagaaatgcaggcaactggctgggcatggtggctcatgcctgtaatctcagcacttttgggaggccaaggcaggtggatcatttgaggtctggagttcaagaccagcctggccaacatggtgaaaccccatctctactaaaaatacaaaaattagccaggcatggtgatgcatgcctgtagtcccagctactctggaggctgaggcaggagaatcacttgaaaccaggaggcagaggttgcagtgagccaagactgcaccactgtactccagcctgagcaagagagtgagactctgtctcaaaaaaaaaaagaaaagaaaaaaaggaaagaaagaaagaaatgcaggcaactgtgcatggcatccttggcagggtctacagtgttgcagttcctaccacttcaccctgggtcaatgagatctcagtgtgatgtctttctctaaacagattatagacactccctcaagacagacctcagactctgtgcaagcccagggcccggtcgccatctgtgtgatgaatccaggcacctagctccgtgcacagcttctcaaagtgagcgtagatttggagagaagaagggataatcagatgtttcatttacccaggtacaacagatacgtattgaaggcctgcagatggcaagacctggttcaagcacaatggggcagaatatgaggaaggcccaccccttcctttgtctcttcccccacagccactacagttccttccaccagtgtcaaccaccaccgtggcagagcatttcccgtgagacaggccgcaggctacatacattatgtgcatcctgtcgtcatgtcctcaccaggggaagtagctgttggtttattcaaccccattttacatgggaaggctctggggctttgtcatgctatcgtttgttcatgtcaccccaggccacacagcagctaagttggaaagtgtttgctgttagcctgcattgttgtccttccatgagggacctaacgtgcatactaaaggcctactatgtgccagagcctggcatttcaccattaagtcactgaatccccataacactgtgcagatggaaccttctcagctttcctgaccatcccttatcttgggctagccctcatgacacatgtcacaccctgcaattaccttctttattcatttgttgacttttatttgtctttctcccctactagaacatcagcacagacagtggactgttatcattcactccagagccggcatttgaatggagattagctggcattctagatgccgcctaattacctgacaggagaaagaagaccaggacagaagcagctgaaattccaggcagaacataggttgtttcagaagaaacacaaactctccctggcggcgtctgaggccatcttcttcaggaaggtgtttcttggatgcacttcaaagcgtagggggcttcacaggtagaattaggttgcaggaatgaggggaaggtagtcccctggaaaatgtgaaaatgagggttgagatgcaggcaggaaaattcaggaggactgttgagtgaatagtcgctccctgtggcaggtgaccagggtgggaggagggtggcagtgtgaggacatcctgaaacacacacgctttggactcagatcttgctgttgtagctccgctacctgatcagtctgtgaccttgggcaacttccttagctttatctgtgaaatgggaataatagtgtcttcccttcagtgagaaccaaatgagacagtactttctgtacatcgaatgctggtgtagagcagttagaacaaatctgtagatctgtagatcgatgctggtgtagagcagttagaacaaatctgtagatctgtagatcgatgctggtgtagagcagttagaacaaatgagtctggggaggtggacccaggctgtgttgcacgagcagggcctctgcacaggcccagcactgacctcaggtttaaccttttacttgaggtacgggaatggctttttggatactgttgtttgaagaaaaaaaaaaggtcatgaataaaacttagaatactaacaaccacccagaaagccagtcccatctctgcccagtaacgccttcctttcctgcaggaaggttggaaccttccacagttccaccaggtattggcctggtggaccagattgaaagggtgagcagacaatgggggggcagacacctgaagccagagatgtgggccaggtgggggctgtcggcccttcccacaggcccaggcagctgcgctgacacagctgtccctttgaaagttggccccgagtgggaagctctgcattattctcccagcccactgcagaatgccttctgcccattgcacagtggcagcgtgctttgggcagcttgatgctggggctgcatggagggcctcagaaaagtaggtagactcgtaagacgggctttatcctggaacaggcaccaccaccctgccctttccagagccaagctatggacatgggtcctggagaggcagaaatgtcttaagggaaggaaagggaaatcctaattactacctgggaaacagtcctcatttccaaacccagcaggtgacctgcaggataatgtgtgggcagtgattcattagaagctgtaatccccagtgttcaagcgagagttgtaactgtatctagggcctgagagagagaaacgggcttcatgaattactcctctggcaccgttgcctacatacctaggcctgtagcaatttatcccaaatgaggaaataataatgtcattttcctccagcctttccctgggaggaagttctctaatagagggtaggcaggtgttaagaagaaatctttctgggccacacctcattacaagattgggataagtgagctctttttcagcttctgcctctcctgtccttgccttgtcagcagcagggttgggagttaggcacagggcatggtgggaaagaagtcttgctgggttctcagtcattgcagttggttgttttaggtaaagtaaattgatgttgtgtttcttttccctaaatattgactgttgaacctagttgtggaagaaaagatacctgtattttgctcttattacttgctattcactgctactcttcatctggaggtcactagcaatttttaaacacttatccccattttacagatagaagatagtaagttctatggaggaatgaaaggcctttttacagagtaactgaggttccatatgttgaactagaataaagtttaagctcctgaccaggtgcgatggctcacgcctgtaatcccagcactttgggaggccgaggcaggcggatcacttgaggccaggagtttgagaccagcctggccaacatgatgaaaccccgtctctactaaaaatacaaaaattagccaggcatggtggtacacacctgtaatcccagctacttggaaggctgaggcaggagaattgcttgaattctgccaggaggcagagattgcagcaagctgagatcatgcaactacactccagcctgggcaacagcgggactctgtcttttaaaaaagaaaagaaaagaataaagtgagctcctatagcaagtggagccccacaggaagaaaggcttcaatggaacggacgttgacttctcgtccatccgacagtcttatggatcttgctggttggccctgactccccttacagtgtcttagggaccccgttcttttcatctcgtggctttgccatctcgtaagcctcttactttctatatccacccaatcatggggaggaagactcagaattgacacttagcacctctgccattgccaagaactagtcatgtgaccttaactactagtgaaaggcaggggtggcccggaaatggagtccttcaccagacagttgcttacctgagacaacatgcatgtacctgtgaaatgcgtatactgtagaaggatcatgagtttggcacataattagtggataataatcactaccacgtctcagaatgagtgtcagataattagtggaccataatcactaccacatctcagaatgagtgtatttgctaatagaaatgtggttttggcttaagtcacattgtcagtggtgaatgcagcctaaaattgaactcaaatacccaggccatagttgttttctgactccaccaaggcagaaatgaaattgttgagtttgagagtaagtagatggggccagccaaagcaagatggacagaatgacattcctttactgtccttattgacaatttatggttcatgcaatagaaaagaatcttaaaagtctctctttaatatacaagaagagaaagacccctggaaacttgtcttttcatcattcgaaacctaccttatcccttcagtcaaatgcagtggtacctgtaaagctcacacacagttttgcatcaaatgattatgtggtcagccatgtaataagtggattcaaagaaacgtatatttaaggtggccacttgcccctggggtaaatggcagctgttggactctgtgggattttgtgttgttgttgaacttgtaaagtgatgaaacctcataatttctctcctcttttagttccctctctgtctgagcagctgtactgaagtttgtcaaacatgcccattagctttcacatgtaaagatggcctttttatattcaaattttagtaatatattatttaatcattaggcagtttactaagggtatatttgtggccattgttctttctgaatgcctaatcactaaaggaaaacattttggaaacaagcactttcttccagaaactgtggtttccaggagagagagtcactgggaagattgggaagccatcagtggcatggcacagagacaccatggatgctgctgctagaccagccctgacccagtagtaaggcctagccaaggacacattgaactccttgaaattgctgatatttggtcaggcacggtgccccgcgcctgtaatcccaacaccttgggaggccgagctgggaggtttgcttgaggacaggaggtcaaggccagcctgggcaacatagcaagatccccgtctctaccaaaaatataaaaaattagccaggcgtagtgatgcacacctgtagtcctagctactcaggaggctgaggcagaaggatcgcttgagcccaagaattgaaggttgtgttgagctctgattgcaccactgcactccagcctgagcgacagagagagaccctgtctcaaaagaaagagaaaaaaaaatgcttatattcaacaatttttgtccttccaaacaacaatttcatcatattcaaactaatacaaaactggcttcccaaggaggtgtttgtttataaggctacagggcaccattttcctaccacttctaacattgtcttataggaggttctctgaaatgagaaatgcagatcttttttttcttcttctcctaagacagggtctcgttctgttgcccaggttggagtgcagtggtgtgatcatggctcactatagcctcaacctcctgggcgtaagtgatcctcccgcctcagtctcctgagtagccgagactacaggcacacatcaccatgaccagctgtttatttatttatctatttatctatttatttatttatttatttatttatttttgtagaggtagaatctcactgtgttgatcagccttgtctgaagtcctgggctcaagtgatcttcccgcctcggcctcccaaagtattgggattacaggcatgagccaccacacccaggcagaaacacaaatctttagtgaggtagcattccatttagctacagaagcactcagcatgcagttgacctttaaacaactcgggtttgaaatgcatggattttagatgtggggctttttaaaccaaacttggatcaaaaatatggtattcacaggatacaaaaaccacatatacagagggctgaatttttgtatgcatgtattctgccgggccaactgtgggacttgagtatgcacagattttactatactcaagtgtcctggaaccaattcttcacatataccaagggacaactgtaatgtgaacacaaacccataaacagtgcaacattaccagctttcccaggatgcatgtggctgacagaggagtcagcatcaagaagggctccactggcggctgggggcctctgagctggagcttactgacaagtggaagatgcccagatgataaggtgccgtgacagattgtggtggtagcattgtgagctggttgacaacacagaactctggaatcagatggcctggattcaaatcctggactcaccccttattggctgtgtgagctaaggcaagttacttgccctctctgtgccccaatttcttcatctgcaaaatgggaataatgataatggcattatggtttactgaaaggattaaaagagttaatatgtttaagtacttggaacagcatccagcacgacactaagtgatatggaggtatttgctatttttatacagagcttagtggcatgaagaagttagacaagcaatgaggaattcaaggtggtgtcctggagtagaagagaaatcggttctggaagggagacttagattacaggacagacagagatttgggtgttgtttccacgactggaagaaggcgacagttggcaaatacccacctatgtagtgatgtccagcagaaactgtcctgagacccatctaactttgtcattccactatctctctgtctctgtgctttctcctgcccttcttcctgtctcaaaacctctagtccttttaattataggaaatgttcacgttttcccaccacatttttttttatatatgtctgggtgtaggaaatttctgtgcacccccaaggacacctgcagctcctctctctttgagtttggtgtatgccgggagggtagtcagaaaacagccatagccccctcctttgcaactgtttctgctatagtctttttgatggtgcaaggtgtaccctagggctgattgtgttcctgggagctggaagctgttactgcagggttaaatcagcaacaggagagcatcactcccagcaacctcagaaagaatagagaatgatgttgttgaagggagcagggagctgtgttcctagtgccgtcttcttaaaaaaaaaaaaaaaaaaagtttccttcccccctcttctctctgcctttccacaacacaccttgtactaaatacatttttcagacctgactttgtgcaaacacagtgttgttcggcaagcattaaaaggcaatttagtactcaaaggattaaaagctcatgttaaattgaagactacacttggcataaacattaaaaattgacagaacaccccgcacattaactgcaccagggcttcgtaattagcatttaaaagtaaaacatcatttccttactgtttcctacttactcatttataatgcatttattataatacagatgtgagcaagaggctttctcccatcatcagcagatgaaaaatatacctgtgctgagaaagaaactgggatttattaatccagcccaaaaagcaaaaccaataaagaaatctctcactgggctgatttgagagattcaaactaccccttggaagattgacacaaggcccccaaagaaatcgccttcacacttcttttccttttcttagcctttcactaacaaatactgggaagaaaatccaagtaagcttcagccaggcacacacttgcgtttaaaactgatcaactggcaggttaccaaaggaatgtggaaaagagcttgttggcccattgctgatgcttcttcaaaactttggtaagactgggatccaattttctaactcagggaaattctgctgacttaacacagatggctgaatttgtaaatgaggacacctgttcatgacacctttgggctcctgcttaaaatcagggtttagtttttagcattaccaaatttgtaaaatctgaatgcagtccaaatctgattttatgttcttcctccagagttaatcctaaatgtgccaccattgcggtctttggacctaattctcggccccttcttagtatggtaggtagtaattcccaaactctagcatgcatcacgatcactgggggtctccctaaaatgcacattctgcctgagcaggtccagggtggagcatgagattctgcatttcttttttcacctaggctggatggagtgcagtggcacaatctcagctcactgcagcctccacctcctgcgtccaagtggttgtcctgcctcagcctcccacgtaggtgggactttaggtgtgtgccaccacgcccaactaatttttgtacttttagtagagatgggtttcaccatgttggctaggctggtcttgaactccggacctcagatgatctgcctgcgtcagcctcccaaagtgctgggattacaggcatgagccaccgcgcccagccagattctgcatttctaaaaagctcccaggcagtgccagtgctgctggccccaggaccacatctttgagtggcaacgttgcacagaagactctcatcagttatcagtcagtggattcagctcatcaaatgtgaaagacccccaaattgccagctccctgtggtaaacccatggcaatgactaagacaaccaaacacagtgcttgccctgaatgaacttattctagaaatatctgagaccttgttatctttctcaggcctctcctactggacctcgtttgtcatgtgtgattgcgaacacctttccctgatgttatctagagatcctgacaggcatgttctgctaaaacagacctcccaggctgtccccaagtggcctcaaattccccagctggggcaccttaagtttatcacgttaggcagttaacaggacaaatataatttctgggccacaaggccagtctgggtgaacgcatgacataagggtgttaaaagtggaggggaattccgaaaatagactttactcttgtcagaatggtgccaggggctggcccagcctgtggaatgcctcagcgctagagggcttgggcagtaaggcacgcttccctggggagggtggtggtggctggggagaggagagccaggttcccaagaaagtaatttggcacctgctctatggcaatcccttacaggcgaagagagaaaaaggaggctttgggacagataggggaattttctgatacaagcagtccccttgtattttcttttcattgtcgtaatgatttgtaaaattccagaaatgtattcgtgcccctacatgacttgaaaatgccgctgtctcactaagagccatgggctaaaacacacccgaacagcggtcagaagtgaggctcgctgtctctgaggtgaggacaacagcctggattcccgagtcaggctcacatctaagcctggcagggcctggagggcggcaacgtgtggtttgcaggttcgttcattaccccagtgttttttatgggaagatgcttgggtgtgtttgtgggaacagaaccctgattttaattacatcccttctggttattcagattatagacttctaaggatcttgtttctctggctttcttctgccctacagagggacacaagggttcagcagagaaagtgcctgtgctctgtgttgacacatagaagcagagaattttagagcagaaagggacttcagtgcatttagtccagcaccctcgaattataggtgagggaactgaggctcagagagattgaaatgacctgcctaaggtcacacaagtaggattaaaacccaggtctcgtaaacctctctattttgtacatcatgctgtctgcacataattatttcttttcagatatttaataaaagtcacaatcagagttagtccatttcttgtctctcctttgagagttgaagtcatcgtgtgaatagccataattactgcattttctgtgcgtttcttatttgattcttctttggcacaagggctctgaggatgcttcagcattgtaccaggcagaaaaacgaacacaattagcagattcaaacagatgcacatcgcatctcacacaggttaatagggaatgtgcctttctaaagcgaaggagccagggttaaacagggcatggaagaattcaaagggtaaaatgaatatgattcacatacttgtagagtggccaaggagggccttattttttactcttcaacaaaacagaggtttggcgctaaaaccacaaagtaacgttcactgtaggcgcacctcaggcacaccccgtccctgctacgctacacgctgcctggtctctgtagactgttactgtctgaggacctcctctcacaaacacttatttaacaatggcactttggctttttaatattttatttgatttctgttttatggtatttttaattgaaccctgttttaattgccttttctgcacaccaagagcctaggtggggaaggaaggcttacaaatgaaatgattattgttattacttcctttctttctgcagcgtcttagtcaaattataaattgattccatccacatattagccccgatcctcatatgcatgtgtcagaaaacagaaagtgttgaataaggaggctgaaaattttcatctagctgagaataagatttgtcagcattattacagagtgaggaaaggaaattggggctaagttcttgccgtcgagttgagcagagtacttggttccgggtgacacagcccacaggtgggcaaggtttcataaactgagagctagaagtggcctagaaaagacatttagtcgctccctcgtgtccagtcatagcccagggcagacatagtttatcctgcacagccttggctgacacctccataaataaggggaccttcctttacagcttttcagagtctcaagggcagctacacagttgcccttaggataaaagaataaacaaccctcatccccttaaacttctgcccctctttacccagtgcccccgcatcctgttttttggaatttgacctatttatgcccaggcactgactgcagggttgacagtagccaccctgaaggggccttggtagggagtaacaaaacaggcggggtgcggtggctcacgcatgtagtcccagcattttgggaggccgaggcgggcggatcacttgaggtcaggagttcaagaccagcctggccaacatggtgaaatcccatctctaataaaaatacaaaaattagctaggtgtggtggcgcacgcctgtgatcccagctactcgggaggctgaggcaggataattgcttgaacctggtggggggatggggacacggaggtagcagtgagccaggattgcaccactgcactccagcctgggtgacagagcgagactccgtctcaaaaaacaaacaaacaaaaacaaacaacaaaaacccagatctggcacacacagaaatggcttctggccttattacacccgctgcctccccagctgggtattcagtgggcagccactcatagccttcataaaatgacttagatttgatgcttgaaatgaaagcttgtcaatcctgggtaaccgcttgaagaaaggaacattatcccttaaaaggatagccctagcccctagaatatctttctcaccttgggacttgctaaaatagaattccttatttcaaaggcagtaaaatgttttgagttcctactatgtgtagtatgctaggctaggcactacaggccaagcaaggcaaataaaactagcctctttccctattcccctgcatttcagaaaagacaacacatttcaaggctctgctttgcaagagaccaggcaccacagtttcctcctatcagcctgggcatggcaagtaataaccccccctatgaatgaagaggttgctgtgttcaaagaggttaataaagtgtccaagaccgtacagtgtcagtgaggcagggaagaaatctgaaagctggtccctggctaacctgtctctttgcgttgtcaacctggaaggaagtgtcagatggtttggcgcagagctctgtccttgggcctggcctgtttgcaacctttgcttaggtgaaaagtgagagtggaagacactagattggaagaagacaatcaggataccaaaaaatatcccagcagactgaggaccagaacgaaagccgtggcagtgagagtggaagggaggaaatgagcaagaggcacagggaagacagagcagcctgaggattcggtgaactgggtttggagttagggagggtgatggcctaggtaagaccactgacaatcaggaggaaatcccaatgaggtcatctgtagattgttgatttttaaagtgccaatggacaatcagtgccacactccaccaaatgagttggagatacagaagtgtaaggcaggaggagctggagtcttgggagccccctacttggaaattacagcggaagctggggaactggtgagagagagtcccccacttcctcctttctagacattgaagggatacctgaagaatctcaatattaaaggataagagaatccaaagaaggcaatattacttgagaaacaagagaataataatagtattttgtcacggaagcccagtaacaaagggagagacagtctgccacttctgcagaaagagacagaaagggccactgtgtttgttaattaggaggtcctcggccagagacctgctaagctcataaacgttaaaggccagagttactctctttgggtggaacagctccagggcagctgaatagataatagtcactgcttcctcgaaagggtaggacacatgatttctttttctttttttttctttttttgagacggaatctcactctgtcaccaggctggagtgtaatggcgcaatctcagctcgctgcaacctccacctcccaggttcaagcagttctcctgcctcagcctcccaagtagctggaactacaggtgcccgccaccacacccagctcaattttgtatttttagtagagacggggtttcaccatgttggccaggatggtctcaatctcctgacctcgtgatctgcctgcctcggcctcccaaagtgctgggattagaggtgtgagccaccatgtccggccaggacacgtgattttaaaagcaggggaagctcccatgctagtcaaaacaaccctactacagcattcatagaagaataagatagaaaatgagatgggagcttagctggtgacacagcagggcacttgcttgcttgggtcagcccagcctagaaagtcagaggtgacggcactaatcagacttcagggaaactggctggctggtaacacaaatcttctgtttacagtgaggagtataaccagcaacccaacgcgagtgacctacatgcagtagttggcccatatgccccccagggacaatccctaaggaatccaaattataatcagaaagtcacttgctgaccagggattataggaataagggacctgggcagaactgcccactctctcctgttttagtattggtgaaactctagtactgtgcagggacttttggtactcacttgtaacacttgattgtctttttttttcttttctttttttttttaagacagggtctctctttgtctcccaggctggagtgcagtggcaccatctcagctcactgcaaccttcacctccagggatcaagcgattctcatgcctcagcctcccaagtagctgggactacaggtgtgcaccaccacgcccagctgatttttattttattttattttttagtagagatagggtttcaccatgttgtccaggctggtcttgaactccaggcctcaggtaatccacctgccttggcctctcaaggtgctgggattacagatgagagccaccatgcctggccggattgtactcttttgatcctacctgtttcccagtgctggattgtgagctctctgagagcagagcctgggtcttactcatctttatatcctggtgccaagtattctgtgttggtcacagaatcatctacttctatttggaatcatctactatttctagaagaccttagtagagataatggtattagtaagtgcttctgtgtttggggtgcctactctatgcctgcaggcacattagataaagatatctttagagctaatagatgccatgaggcgtatcctacagataggatcctgagcttcagagatgacagatctcatgtaatcaagccggctttatgaggtaggaggggatctgaacctggtctgcctcactccagagcacatgctcttcccactgggccgcattacctggagtcactaaggcctgtttcacaggccccttgactgggcagctcccggctctgctccgtggatgtgctgtgtgctaaaggggcggtgggggaggggggccctgagaaaggaatgttcaggcattggttaaaataggtgtcctagcctcttgtcatgccttcatattcacaaatgttcatttctttctttctcttttttaaaaaaattcttcctagggatgatgactgacagattaatatatgtctaactacatgtctcagaaatcaaaaggaaggtgctgtcagaatcacttgtcagaaaatgagattaggcgcacttgtcatttgctgaggattgcagtctttcagagataaggtttcatttaatgagggtaaaaagcctccttttaaaaaaagaagagggagcgagggagtgagggtggggtaggcgaggagtgatgattcttttttctggtgtcagccaagtgttttatcacctaacgcgatcccgcggcacctggtagccactgataatggcaacctggccttctccacctcctctgccgctgcaccacttcaaaagcagctgcttgttacctgcttttacctctccttgaagctgaagctccttctcctgtgggaagagggagctaagcatgtactctagatttaaaagcaggctcaagaaagcatgcagtagaaaggaaacgtacagtcacatttcccaacaaactggaaagaatccacaatggatttcagtgagatatggagcctgtctgagtagtgaagggtaactaatgaggaacagagctagatcccattgcaaccaattgtgttttgttatggaaaatatttatcaagttcttttgcatttgttgattctcttacaagtgacatagtaagagctcctggcatgtgacttgatgcacctcctgcaccctgcgattcaggctggcaatttctatccctttattaagcttctctctacctcaggtgtggcctgtgctccagaagtatttcaaattaatcctcccccccctcaactccctacctccaatcgtagaaaactgcctctgaaatgaacaactttattgtggagaatgccggtgataaagcagaaaatccgtatttcagaaatgtttggtgaccaggcgcagtggctcacgcctgtaatcccagcaccttgggaggccaaggtgggtggatggcttgagatcaggagtttgagaccagcctggccaacatggtgaaaccccgtttctgctaaaattataaaaattagccaggtgtggtggtgcatgcctgtaatcccagctactcaggaggctgaggcaggagaattgcttgatgagcccaggaggtggaggttgcagtgagccaagatcgtgccactgcactccagcctgggcgacagagcaagactctgtctaaaagaaagaaaaagaaacgtttgttccagttctctactccaaaacttactggtgtaaagcagtacccttttcttctgttcctggatttggtgggtcagaaattcagacagggccaagcagagaagcagtttgtctctgctccaccatgactggtggtgacatgaatggctggggactggaatcccctggaaaagtcttcactcatgcatgaggcacttggcagggacaaaagcacctctgcaagccttgtccatgtagcatgggcttctcacagaacggcgtctgggttgtgggaggagttgccggaggggttgctaccagaaagcaagtatcccaagagcttgaggcagaagcagcgagacttctgacctggccttggaaagtcacatggagccacttctgccattgagctgaagcactgacaagcccaccaggctgaaggaaagaagatggggaccgctccatggggcagtgtcaaaggatgtgcagctgtgctttaaaatgatcatcatgctgtaaaggtttctttctacctgtgtttcttcacatctcacgaacgaaatggcctaggaatgtaaagtaaatgacatttggatggttactgacttggtataaaaggttattcctcttcattaaaaagaagaagaagaagaataagatataggccagatgtggtggctcatgcctatgatcccaacactttgggaggccaagatgggaggatcacttgaggccaggagttcgagaccagcctgggcaacatggaaaaccccatgtctaccaaaaattagcctggtggggtggtgcgtacctgtagccccaactactgaggaggctgaggtgggaagatggcttgagcccttgaggtcgaggctgcagtgagtcatgatggcatcactgcactccagtctgggcgacagagccagaccctgtctcaaaaaataaagagagagagagagagagaaaagatgtagacagagagagtgagcccaaccacattaatggcccagggagtctgaggggtggagtgtcctgttcctgctctctgttgctaatggtttaaaacagactcagacttcacttaaatgggcacctttctggccgggtgcgctggcttatgcctgtaataccagcactttgggaagccaaggcaggtggatcacttgaggtcaggagtttgagaccagcctgggcaacatggtgaaaccccatctctactaaaaatacaaaaattagccaggcgtggtggcatgcacccataatcctagctactcaggaggctgaggcagaagaatcacttgaacccaggaggtggaggttgcagtgagctgagattatgccattgcactccagcctgggcgacaagagtgagattccatctcaaaaaaaaaagttcacctttctgtttctttccagtccttctctgttacactcttcaaaaatcgtctgtacatacttgcctctatgttcttacaactttgtttagaacttaacatttaatatgtaacctagcttcaaccccattttctaacaattctcctgctattcaccagagacctcctaaatcagcgatccacctgtcttttctcagtccttctcctccagcacctctaacacatctgccatttttgagttctcctcctcctggaaatcccttcttgtcattcaactctgtctgtgactccttccccagcgcagtaaacgtggacactgtccaggtgtagtccttggttgtgttttcttttcacgccacgacattccctcatctctttgcagaagacatttgcaacttatctgcaaatccgagctctctttctgatgttccactcccaaatttctgaccgtggctaggctttcctcacggtcttctaaattcatctcgtcccaagcaaagtctctatattcccctgaaagcctccacatgcttctgtgttcctgatgttaaccagttccccagcctttacatcttagcatcgccctttgtgttgcatcactgccacacactcgtgcgttccttgaggttctgcctcctaagtgtgttttctcaccttagctttgccccgtgtctcctgccattttcctcgagtcacttttccttttttctttttgtagaggcagggtcttgctttgtctcccaggctggtctcgaacttctggcttcaagtgatcctcctgcctcggcctcccaaggttctgggattataggcatgagccactgcagcccacctcgggtgacttttcttaatgcttccctggatacctatcaggttctaccttataaaatttttataattttagtaggttctggccaggcgcggtggctgacgcctataatcccagcactttgggaggccgaggcgggtggatcacaaggtcaggagatcgagaccgtcctggctaacaccatgaaaccccgtctctactaaaaatacaaaaaattagccaggcgtggtggcgggccctgtagtcccagctacttgggaggctgaggcaggagaatggcgtgaacccgggaggcggagcttgcagtgagccgagatggtgccactgcactccagcctgggcgacagagcgagattctgcctcaaaaaaaattaataaataataataataataattttagtaggttctaccttccccacgtgtagttgtcctctctccctcctaaattataagtttcctaagggcagataacatgttttgttcttcttttttttgtacatagttcatacttagtaaaagtatccatactgaatgaatggctcttacttatactgtaaagaaataaggcatacagcggaagtgtgtatgcttaatacacatacaatacacaaactgttggatttaaggaaagattttgatgacatgaagaggctaacactgccgaacgtacttccaaatattgccttgcccctcaactctccttggagtggtactggggggagcaagacacataagcaacaataataacaagaatcataatagatatatttattgagcacttactttgcagttgatgctcttctagctaaggtaatcttcacaaccctggtcttttcaagacacactttgagagacaggtacagtatgttttccattctagagataaagaaactgacagaaaaatcaaatactactttttttattagttgggtgaatgcttagtaccaccaaacaaacctctttttgcaatccgtgctaaagcaagtaagtgccttaggctcaccaccaaagcaggccttcctttttcccttagtctaaattttattgtgggttgaccacgaagctcagagcaacttccaaggggcccctagctgagcttagtcatcaccagtcctgaaggcaacagaaggcagaagagaggcccaagtgtgtgcaggactttttaaattcaaagctgtggtttttcgaagcacagggaccctgtccactggcaaacctggcccaatcagagtcttatatgctaatactcggattggcaaccatgaggaaagctgggagagtttcctttccctcacacaaaccctaaatgagtagatgaataaatagaccctgcatggtatatgtaatcatataccaagcataatgagagacaaaggaaatgtggcaaaatgttatcaatggaggaagtcaagcaaagagtttttgggtgttattctcaccatctatcattattttttcctgttagaaatttttcaaaatacacacttaggcaaaactttaaaagacatctaaaacaaacaaaaatgagtaactgtaaaggtaggagtcaacaataaatacacgggaaaggaatctgaagccaggaacgttgtggcccatccaagggggaagtgcccagagagaagggaagaggtagaactggagacagctggtgcttcttagggagatgctcagcctgcccaagaggctaatttaaaactaaatcttatccctggatcccacagcccttaatgtgacccaaactttccattaccaaattctggggttttaaatcctgatattgtgtgcttgaatctggaatctgtctcatccattaaagatctgacctattgaggccacatgtgtctatgcaataagttcttttcaagccaaactttcatgttaaaaaaaaaaaaaaatcctgagaggaaatacatgtggtccctgtccgcttctagcccacttcaggctatttattgttttatttgattgttgagaagtcagaaatgactaaattggttctcaatgtggcctgcacatttccttggctaggaatggtctgattaaggcaaagcccaacttagaatttagcagtgttctgatctgtgtgggtttgggggaaggcatgtgtattttgttctttcgttctgaagtccttcccttgtggatttcagactaaagtgggtgtgatgacacatttacccttttggttttgtttttaaaacacaaagctgacaaatgtgtttaatggccccgtagtaccaactgacagcggcacggagcccaggaggctcacttgtaccttgactgtctcagtgaggaagctgaattttactcaccacttagaaggattaaatgcagaccatagcatacttctgacatttcattggcttatcaggaaattccatgagagtggggaggagggtggaagcagaagaggtacatacattgaatggtatatcctacttagaaattataaactctaagaaaatattaatagaaggaggaaaatatttatttttcagcacagagactattctctgtttatacattaggtaccagatcataaagaatcacagagagagagagattattcatcccaactggtgtgcattttaatggtgaagaaatagttacctgacttacccaaagtcataactagttgggactggacctgttgtaaaatccagggcttctgacctttctaatccagtacagtattcattcagcacctcatcttccctgtcatggtctacaatagccctgcaaacagtcttctaaaactcatcagagttggctgctcatgtgatccggtccaggtcggttctctaatctgcctacaggtcagttctttgaaatcatttccatgcctcctcatgcacccccaaactcagctggtcattttgcaaatgcaggttgtcagctgtgagtgagcactggtaacagaaagaaaatccatcaccacgagtgctgatggaaaaacaactgggaacgtactgcctagtagaatgttgtttgtggcccgatctttgtataagaaggaaaacatcataaattaaaagaaaagctaccagccaacaactgtatttttaccagcctcctcttcttccagaaaactcattgcgaggaaaataaatagcattctttcccagcagcacaaccgaaagtcttgttagttataggcgagtggctatttgaaagcctggctacaattttcctgttttactaacacttgtaattaaatccatcaactccctctaagattctgtgtaaataccagatgctccctacatttttttctctcctggagaatatgaaaagttgtacattagcagtagaggaacttcaaaggaggcacagacctgagtgaaagtgaagttctgaagatccacactcgcttccctgtgaatttcttagagtgttccagggagggcagcccaccacacttggccagcacaggcccatcccatctctcacccgagtggcggatgttaagttgacatccgtgccccagttcaggagcagatggctctgcgtggggcatggtggtttgggagaatccacccgggcctggcgggaatcctgttgttgagggaggagtagggccctgcctcccgctccccgagggtttgcagcccgcttttcatgtgctattgatgctgcccccacccgctgtcacttggagtcattcagtcaatcacatggagaatcagaggagaggcttgggatggctctggataaatcctccctcgctactgggggtgagaaaatcctcttcagagcacatgcactcctcagagggcatcagtgtacatatatatatatatattttttttttcttctgtatgcaaagaagagtaacttgttcccccaaggtgaaggatttcagcggtaggcaaagcaacaccactaccaccccaacccgcccactttgcttttccagaattaaacgtagttgcctagagctgtcatgacctacagagaaagctgaggaagtgttaagtgaatcatgaaagcaaatcaacagacctgctggtatttaaattttagtgtattccagtgtggatttcttggtatttgtaatgcaaaaactgggaacgggggctccacctcctctcccagcagatccaaccctatgttccaacttagtcccagcatattcgaccccatgttttgtgtgaatttactttaaagtctttcacactcccgaggccgtcagcaaagcactcatatcttatgggcaacccccagccctcttcgcttataaactaactgtccgtggctttggggttgttccctaccagttttattgggcaggttgttagctaagggattcattctagaaccagaggtttgaggcagacctctaagatcctcttgactctgagtgtgtggaggagagtgagggaaaggacagaacccatggcccgcgccacctcagcttctttcagtttctatttgaaactgaaatcacagaagagctgtcagatggcagctgtgcatttggtggaaatgagaattccagattttatgctaattcagtttcaggttcctttgaacctgcagtttatggggccgtgctgaaaactgcaatctgttttggataaaagaagggattactaaagactttttagttgtacaaacattcccagcctccaaaaggaaaggggggagaccagatttattctttcattaaaattgtcatgttaagttttcttctgctttatcaaatagaaaacttttccttattttggcaatgatttttcttatttcaagtttttttgttgttgccgtgatttattttcatttcagtagcactctttctcgaacttcaaagtccttgtcacttcctcccagaggcaggaacacaaaggtggtgcccatggatgtatctcatcctggcatgtgctcaccttcttccattctcgcagtgttgattgaggctgacccagatggttgtttcacttacctattattgctttgtaacaaaccacgaatttggagcctggaaatacaatgctgccattagggcagggctctgcagagaagcttcctctctgttccacatggcatctgctaaggcaagttcagctggagctggcggagccacacccaagatggcttcttcacgtggctggcaagttgtcaggggctgttggctgggaactcagctagccctgtggtcccaaggcctcagcttacttccatgtggtactgcttgggcatccttactatatggtaactgtgttacaagcttaaataaccagaagctgctgggcccaaactctgaatctccagcatatcacttcctcctcattctattcatcaaaacagtcacacgtcagtcacaaggacataagtttcaccttctaatgggaggcatgacatgcacatacagaattatttgggagccatatttggagatgagcaaccacaatggttaatgatatattttttagaattttgattttcaggagaatgtacccacgctctgttgttagccatatgggtttctatattctgtgaaatcccaaactgttggcaattcgtggaaaggactttgcagtttagttttatgtttgagataatgtcttcattctcttctgttttagttggcagagatctggtcatttatttatttactcattgatctgaccactgcgtatcaacccatctcttacatgtgatgcatgagaatactgtactagatgttaagggcaatggtggtgtgtaagagtacatcacagtcctggtccttgagtgattgaatctacagactgctctccaaagcagtatcttgttcccagtgaggatacgtgtgcccctaaaggaatggcagtgtccagaggtgagccgagaaacaactacatgttatatattgtcttagatctatgtttccattaggaagcattcaagaaaagctgtagtttggagcagaagaagaaatttctggtgtaattcatttgcaatacagatctgtaaatggaaattacataggaccagagaggagctggcgggtctttgtaggcacacaggcttgccctgaccctatgtaacagcggcatatgatcataataactggcatttctgtaacagttaaccatctacaaactgtgctaatttgattgataaagccccagagatggaggctattggaatggccatagtagggtttcccattccattctgatagcatggaagagacagagagaaaaactaaggccagagcaagagggaaaatcagaaaccttgctcaataagaatgctttcaggaaatcgaaactaagggaattctacgacattctagctcctcagctactaccccagcaagtgtatgattccccaaaccagtagaagcaaatattttgtcctcagccaacaagaattcctgcaagtcaatatttggaccatcaggatgcttaataataaggctagggaaaaaaaaaaaaagctttgttagatcattgtatattagcatagatgcaggagtcaaattttcagtaccctaaagattattaatactttcaggtaacgtttccaggaggagatagcaaagcctttgagtagaaggatggactaacatgcggttggccaccattctcaggatgtcagtaatctttcaaaccacaaaacctgggaaggtaaactacttgtatatcccaggaatagtcacgtgacttatagacagccttaccatgacccttcagatcttaaaacctctctagagtttagacagcagaatgattttgtcttagacatctggccagtggagggagaaactgagatttacccagcagtggggataggatggtgtggtgtggtatggtgtggcgtgatgtggtgtggtgtggcgtggcgtggcgtgttgtggcgtggtatggtgtggcgtggcatgttgtggtatggtgtgtgtggtgtggtatggtgtggcgtggtatggtgtggggtggtgtggcgtggcgtgtggtgtggtatggtgtgttgtggtatggtggggatggacagtgggagcatggtattagggaaggaatgtgacatgcctgctggcaccatgctataatcctcattccttcactgcagaggacctccttacactcctgtatccatttccttatctaaaataaggaagaaactctccgttactctctttgcctcacaagattgatgtaagagcaaacgacattataattgtagcattctggaaaaatatgtgttactctagggcatttttggcagcgtcctttggagaggctgaatcttagaaccagtaaatggcaccgtcacatataatttatggctcatgctcttttttcagtctagggttcacttcttggttggttgatttctccctcccttccatttcaaggcactgaaatgaagactagaatcatattttgagcttgactcagtcctagaatagcagcagtctttccctgggactaaccaaagctagaaatgagggtcctcagatcagatacagaaaagtagttcttggctgggtacagtggctcacacctgtaaccccagcactttgggaggctgaggtaggtggatcacttgaggtcgggagttcgagaccagcctggccaacacggtgaaatcccgcctctactaaaaatacaaaaattagccaggcatggtgatgcacccctgtagacccagcttctcaggaggctgaggcaggagaatagcctgaaccagggaggcggaggttgcagtgagcagaaatcgcaccaccacaccccagcctgagtgacagagcaagactctgtctcaaaaaaaaaaaaaaaaaaaaagaagaagaaaaaagagaaatagttctccctcagtagtcctccctcaaactgagctgaaatgataataacatatgtggtatgacttgttgaatggtaaacatggtcggagaactcccaaaaaggtagtatttctttcaatattcatattagtcattccagcatccaactgaggaacatctaaggtggtttcagggccctcttttaccctgaattgttttttaaaaaaagaaaaaactgcggagagctcagcctaaaatggctaaaatgcctcttacctagagaactggaaaacgcgatcagttcaccagcagttccccgtttcccacagtggttgtttctaacattgccacttagtgcatctgctgaaacacagatggtcgcatccctaccagcaattgcagagactcccttcccaccctcccagaagctgcacccatgcccgggagcccatggctacagctcttaatttatacatgggtgcaatgacagccactgtttgctgagcaagcccccgccccagcaccatctcccccagctcagtccttcttctttcatagtaagctcctgtctgggatcctcacctgtcaacagaccttacagcaaggctgcctttgtcaggctaccatatgtcctgtccccttaggggactgggtgcttgacaaccttcatttataaaactaagaggggctgctagaagtcagctttcctgaaactataagaatgtctactcctaggtgacttgtcactaatgatgaaggtaagttgctgttccaagtgctttacatacatgaattcatttaaccctaacaacagttgcagcaaagtaggtgatgttatggccatactttctagatgtggaaactgaggtacagagatgcaaagtcctctctccaccatcacacagtaagtgggagtggaggataagctaggatttgaacccattggttctttcatgagtggctaagcttttaaccactagaccaactacctcttagttgtccccaaacatagaaatggctggcacctgtttaaaggccctttttgttttgtttttgtttttggagacagagtcttgctgtatccccctggctggagtgcagtggcgcaatctcagcttactgcaacctcccgggttcaagcgattctcctgcctcagcctcccccgagaagctgggattataggcacctgccactatgcccggttaatttttgtacttttagtagagatggggttttaccatgttggccaggctggtctcaaactcctgacctcaggtgatctgcccacctcggtctcccaaagtgctaggaccacgcacacgtgagccactgcgccagacccgaaagcatcttttcattcattcatttatttgtttttaaatccaatcgaatttagcagtggggagttgtcttaagtgtcttcttttccgctgaacacattattttcctcaatctgtcatctctgatgactgacttacacattgtgttctacgccgatccgtcctttcagctcatgcagacattttgtatacattttcattttaattaccaccccccaactctgccccatgttcatatggaaatagaggagccaggtgttggatacatgagccggtaactaaggcaggatgcgtacctggacttagtagggtcccccagggagcatggactcaatatgaaatgcaggtcgctagaccccaagtttcaaacacccatcaatatgacatgatgtgagaaagagcaaaccaagtccagacggaaacgagacagccatgaccaggggaggcagagaggcctcacagttctcatcacatgcactgctgtaaaaagtaagatgagatacctacagccaattgggtgacacgagcagggattggatttatttgtatttttcattgcctttctttgcagggttgtcagattctgaatattaataccttaatgtagatttggtggttaagtaagatatattttatggattttttaatactttttcccctttgtagtttatagtacattgtgaagtttgaaagtaaaattcctttccttgacttctacactcggaaaatatttattcccccctgtgtctcaatggtatgcatcataaactaatccagttcagtttatttacttccctcttgttgcagatccatgatcaattgtagcaacacgggcatataatggcagaggtttttactttacagcagtacgagcatgagctattgcactctcctttcagggtgataaggaaggaagcttccattttcagaatcacccattcagaaggggttggggggcactgagcagaggaactgggggccacctgacgttgattagccctgaatcgctaaggaagacatcccaatccatagtttcaaatgaatcagcctacacagaagaaatccctgggaaccagaaagagttttaatctcctgggctgaacagtgtggaaggcagaatattaggaattagcagaggtgacaagtaggacaacctcggcctgcctcccagtggcgggcaacctgttgactccagttctccatcctaggacccttgcttgactgccatgagtaagagcagtgggcaccgaagtcaaaatgcagatccctccaggcttctcagtagctgttgtctgccctgagcattctcccaaccttatcagttacccagacacttgttgggagccctcagactaactagcatgctgggacaatttccaccgtgtcttcattcctctcatcatgggtatgttgagcaaggcctcctaactctgtgctgggtacaaattccaagatgtggacaaattctaagatgtgaattctatccacaagaaaccaggtgagttcagaaggcatggctcggggcatacaggaggatttatcatcacaaacagataataaagtgttgtctccagacacacatctgttatttatactgctgctgtggcatggacaaagacaagcaagacacagtccttggatagtcacatttaaagccaaattgaggtggtgggtcctccatacagagaaaataaacaaaaaaaacaaatcatggccgggtgcagtgactcatgcctctaatcccagcactttggaaggccaaggtgggaggatcgcttgaggccaggagtcagagatcagcatgagcaagataaagagaccctgtctctacaaaattaaaaattagcccagcgtggtggcgcatgcccatagtcccagtactcaggaggctgctgcaagatgaccccgtgagcctagtagttggaggctgcagtgagctctgattgtgccactgcactctagcctgggcaacacagcaagacgccatctcaacaaaacaaaacatgcttctgcaccagtaagacatcatttttatagtcgtaggcaaaacggtagtcctcttaaaactggaaattacaatttaacatgtctaaatgacataattgggatgctgctattttatgttttaagaaattgaagccctcactattaagagtttcatcacatcttaaggctggcaggcttttataacattttgctggattcagggtcgactttataatctaccaagaatatccatgtggctgggtgcagtggctcatgcccataatcccagcactttgggaggcagaggcaggaggatcacttgaggccacgagttcaagaccagcctgggaaacatggcaaaacaccatctctagaaaaaaatttttaaaaaattagccagatgtgttggtgcacacctgtggtcccagctactcccagctactcccaactactcaagaggctgaggtaggaggatcacttgagcccagcaggtcgaggctgtagtgagctgtgatggcaccactgcactccagcctgggtgatagagcaagaccctatctcagaaaaaagaaaaagaaacacccttattaggagacccaagctatccactgtccaggttctgaccctgtctggagggattctttgcagtaggtcctctataaagatgtcgttcccagccaggcacggtggctcatgcctgtaatcccagcactttgggaggctgaggcgggcagatcacgaggtcaggagatcaagaccatcctggctaacacagtgaaaccccgtctctactaaaaatacaaaaaattagctgggcatggtggcgggtgcctgtagtcccagctactcgggaggctgaggcaggagaatggtgtgaacccgggaggcggggcttgcagtgagccaagatcacaccactgcactccagcctaggcgacagagcaagactccgtctcaaaaaaaaaaaaaaaaaaaaaaagatgtcgttccctagtagagatggtacaaaccactgtacccactttatgggactggtgtcattttgatgttcatgtggttattttcattattgtggtgatccccactgggagaacccagtagaaggcaaggctatggccattgtggccctaataaaatagacttttattttgttggtctccacggtaatcaaaagaagtgtgtcatctgtaatcataatagacaacaaatatatcctccttactaagtgccaggcactgttactgatgaaggccccaagaggtgtggctcctgttatctcactttctagataaggaaactgaggcagggagagtgaagagatttacccaagctgtcctggctcagaaatggcagagccacaattattaacctgatgctggctccagggcccagctccaaacctctaccctgaagaacaagtagaaacttggattttcagagcttgcagaacctttagaacttgaaaagaatggagacttccatagtttcagaaataaaccaggcatggtgacatccttgccgaggctagttggagttatcaccctccttcaatcacctagtgatcttttaaaactacatcatccataacgaaaggttcgaggaaattctggtgaagacttcctcttcctttaaaccacctcaagaagcacacagcacatgcgctgttagagtgcctgaacttcattatatttaggagggggagcacaatgaaattaatgaactttctctgtataaaacgcttaacagaagactataatttgtaagaaatattttgctaaaatatatttagcttaaatctggtaatttgtgatataaattgaatcccatctcagattataatttttaagaatttgcaagtataggccagacagagtggttcatgcctgtaatcccagtactttgggaggtcaaggtgggagaatcacttgaggccaggagtttaggaccagcctggtcagtataggaagaccttgtctgtacaaaaaataaaaattagttgggcgtggtggtacacacctgtagtcccaggtacttggaaggctgaggcgggaggattgctttagcccaggagttccaggttatagtgagctatgattgtgccactgcactccagcttgggtgacaaagtgagaccttgtctcttaaataagttaataaattcataagaatttgaaagtatagattgacttacaagaatttccctttgtttttaaacctagtttaaatctttagatgtatttttgagatttgaggaagaaggctccatattttaacgtagctttacattttttttaaactgattaatcataaacttggctaagatctttgggcatatattaaaaattatttctgaaatcattaatctaacaccagagtggaaattgagtccacattcttgctctctgctttctattagaaagggttgccgctttctaagacttgttctccttagattgggttcagaggctaaaggtgatgttaagaagccattagtgtttagtatgttaatccacctccatgtaacagaaaagatagcttccagcctttgacttggcatctttatattaaaactccaataaaaggaaattaaatttctcaaggaaaaaaaaaaaaaacaatcttcctgattattgaaagccctctgacctggattcagtccctaatatatggattatcaaatttagtcttctttcttccttcttcctacttctgatgctgttgtgtacctggtcccctccaattttgacattcattcccatccccgcttccagaaagcatagggaatagagcagtttggaaaccagtcagaaatgggctcatttgtgagtctggagagaggatgagaaatggagcaggtcacagtgggtggtgttctgcaaccgggccagccaggggaccctggggagcagcactggaggtggccacagtggtcagaggcttggcttttggcgttcccaggttcctcttgatgagagatcatcaaaagatctggacacatgcagatctggctgaggccgtcatctgaggcctaatccctggtaaccattgatgacaatttttttttttttttttttgagataaagtcttactctgttgtttaggctgtagtacagtggcatggcgtgatctcggctcactgcaacctccacctcccaggttcaagcgattctcctgcctcagcctcccaagtagctggggttacaggtgtgcacctctacacattttattagtagagacggggtttcgccatgttagccaggctggtctcaaactcctgacctcaagtgatccacctgcctcggcctcccaaagtgctgggattacagacgtgagcaactgcgcccagactgatgacaatctaatgcaaggcatgataaatgtcagaagtgccacctaatgaaagcaccctggagggccaagtggtttcagctggtcagctaagctgccatgccatcgtgctctcagtttaccctgtaggggatggtgcaggagctcaggcagtttcttccctgtaacaccgattttgctagaacaacaagataagaaaactgttccattttgattgttccaaaagaaacaaccttttaatgtcttctctagaacatttcatgtccacctttgagctatcctggtattgtctaaacagcttcagaatgaatgccgcctccctggaggaccacagctgggtattgtgacatcttgtaagcaactggaaaatccatctccaaacctataccttctgagatgccttttcttttgacttctcaggaggcagtggtagagaaaaatcactgttacctatatttttaaaaagacttgtataacaccacattgtgctaccagtttgggggagggggtgatgaagctagagagagaaggcttcttatttccaaacttagaggctagaggagggggaagtatgccatacagcaagcacccccaccttttttttttttttttaacttgagaggtttttcaagagtgccatgaaatcaaatagtgatagacatgcaacttcaaagaggcaaggagtggccatcattactttaaaccagtctgcatgtcattcatatgtggtgtgcatctctcccaacccctgttctcttcctctcttcctccagccacactccaggtaacggtggcactgggaggggacttagaactgaagttttcctctcaccccaccttggtgtgcccactgtactccacaaccctaccggttgcaacctagggcttgcttgctctttttcttgtactaggaaaattgcagcagcttttcctctgcaccaaggagggaccttgtcaagctgcaggtgtggaattaaaactccagatgttttcagagggtttcctcgcccggggtgcgttctggtgggagtgggttgctcaggggaatctgctgagtgcctcatttctggccattcagtcccccacaccctctgggggcactgcactgtgctctaggggatacagacacgatacatgttaggatgatagacgtaactgctgcccatgtagcgaggctttgccattgctttcattctttccctacattcggtgaatgccaggggaagcaacaggctccacttttgtggatgcagggtgtgcacgtgtcagagggtgtgaggagctgggaggagaggatttctaagtggccagttcatgctcttaagttattcatcaaaccgagcacactgcggtcagtcggctgtggtggggaaggaggttaggtgaagacctttgtgtctgagacccagaccgtgatccccgtctccattttccacaatgcaatgattattttgtattgagcgcctactatgtgccaggccttttacatacatgactttaccactgagccctcacaaccgcccagagagcctgctctttgcagatgtgactggcttggtggcaattcaaccccaggctgcgggcctagtggcctttccctgccatggcgcaatcttggaagcggcaactgcggggagggcgaggagcggtgcagtttccgccgcgcccgcccgcaaggaaggcagccggggggagccgagggctcgagccgcggggggagcaacagctgtcgatgtcgcgcctggggaccgcgcctccgctgggccgacccggcgccggggacgagaggaggggcggcgaggggcggggcgcgcggggcgggacggaggaggggcggtggcaccggcggctcgggctcggcgcgccgaggaagtcccgctccgagagctgcgagcgtctggaggaggcgcgctcggcgcagtcggggagcgaagtccggagcaaggggcccccgcgtagccgccgccccctcctgctaccgtccagccagggagcccgcggcggccgccgatggagttcacttgagctgtgaaccggcgggagaggcaggcgcccgcaagccgagcgcgggccggagcccagccagccccgggcgctcacccgccagcccgcaagctccggccagaggcgccgccgccccgcgccccgccgttgcagcgcctcctgggccgcgcgccggcgagatccgcacaaaatccagactcccggagcggctccctccagcaccgcggcgggcccaggaccaggcagcccgcggcgcggctggagaggcgggaccggctgtcggggagccccgggcggccgccggggagaagccgccgcgcgccctcctcctcctcctccctctccctcctccctccctccgcacatggtctcctttgtcctgtcgccgccgccgccgcctcgctcttagctccgcgcgccgcggcggcggctcaggccgctcttctccgcctcgccctcccgccggccggcccgggacgcgccttgttagcccccgccgcgccagcgcggccccgcgcgccgcaggagcggcggggagacagtggcgagcgcgggccgggcgatctcggcgggcgcgctcctcccgccgcccggggcctcggccgcgctggatgtgtgcgcgcggcgccggctctcggtcgccccgaagctgttgcccggttcggatctggttcggcgcctccgctctcggactttggcgaggaaggagcccagagactcttgtggacagagccgggtcgagagttgggcgttttctcttcgtgtgttttggtggtttcccccctggtctttgacgatcgcccttcgggagccctgctaaagaaccaaaccatgaacttggggctgaccggaccgtttaaccctttgcaaccaggtaatgaagcccccggggcgcggctcgcttgcctacctctcgcggtcggaagggaggcggccggatcgggggtcttttgttgcggcggccgggccggcgggcaggggtggcaggggcgggcttctcccgtctggcgcgcccaagcgccccttcgctacccctcctcccttctttcctcccccctctgcggccctgtcgcccgcctttgtactttcctccctcggccggccgggctcggccggagctgcgcggtcgtgcccgggagggcctggcgttcgccgccaagctccgatgtgaggagggggccggggcctgcgtccgcttgagctgggggccctagcgtggcgctgcccgctcctggggtcgcgcttccccagcgcggaggtcgggatcccggcccgcacccggtgccaagggaggcgaaaggagatctgggctcgggttcggcagcgggagaaagaactcgcgcttaagtttccaggaggtttctgttttgttgttcgaaagccccccttctcgcctgtgcgggtgcggagggcggcccccggggtctgcgtccgaagggagtgagggtgggcctgaagcaggaatcgctgggtcccaccccgtctgcacgcacggctttttataagttttccttattctccgcgttcccgcctccaatctgtttcacttacttaactttcctttaaacgccaactacggcttctagcaatattttttttacatccaaaaaaacaaaaaaacatattcccccttcccttaaataaaaagcagccaaaagagagctttggttttctgtcagttttagattcaaccacttcatgcccctaccctccaaaaccgagcgaggggatgaaaggaagtgagtaaaatcttcaagtctgtagcgggtagaggtgcccccgtgttcgagagaaggaagagctcaattcgtcggctcattctgggctcgccgcttttccatttgaataataattttttttaaaaagccaggaaaatggtccaggtaatagaaggaaatgcagactattttctgaaagcaacgaaaatgataaacatccccaagattcagacccaaggaacaaatcatttgtacaaatgccctaaaaccctaagtagaaggaaagttcgttgaggaaaagcaaagggtactcgtgtcgtttcccctgaagattttggcaaagaatctctcttctgacttgttaggacagtggccggccacagttgtaaccacctggataggagagagaagggatccagaatgttttcacggtcagccagagccccattgcagtcgtcatcttttgggtgtttttctggggaggcctttctgagacaccccctttcccagttgcaagaggcatggtgtccagccctgtgacttgtatcagccaagtaagggcttagaaagcttttagtcgaagatacactcctaagcctctctgaatatccggtcagacttacttccttaataacttactgatcggcatcataataatggcatcctcaagtttggttcagacatgaggatcacgtaagtgtctgtctgagaatcccatgtggagctgacaaaggtggcagaagcaaaaggcctgttcacccacagcttctgtccttttcactcgaacacacacacacacacacacactaagtgcaaataaaaacttggtcaggaaccatttactttccctgtttatgctttttgcattcagagacagtaatttgtttttacatttcttggggccaattagagtcactttaataggtaatcccagaattttcaaaggttatgtcagtttggtaaaacactttaataaacaggcttttttttccccttctatcagttcattaattttgtaagccatgaatttaacatgaatttacattcaaaaagaattccaacccgttctaagaaacactttttcatgaaaggatggtaaaatacacatatctcgagtttttagctgggaaactcacagtcctagaaatctcacttaatatttcagtgtagcatcatcatgcaatttttggctttataactcactattcttgatctaggtatgacttgtttctctcccattaacatttttttttggcagtttgtttttatgtaaaggtactgttatatatagtttaagatgtcaggaaggccctctgtatttttcattattcctgcaaaataggaaaaaatctatctagggtttatgttaaactgcatgtataaatgtatgcacttcaatgttcgttttgcacatacattcattgtttctggattggttaatcatatggacacccccataaaagtaatgttagaattaaaataaagcaaaaaacagtcttaatacaaatattttgtctttctatatcacttgcattgagaactagaacatgtcccccagatgtacacaggaatatttcatctttgtcagtattacatggaaagactaaattgaatatcctctttgtccctaaaagctagccccagagtcaaaatatgctgcacttcagaattccccccccccatttcctatatttcctttttccatatttattcaacattctaggcttttgctttctcagaatatgcatctctgtgtatcaagtgtgaaagatgagtgatttctcatgagggttatgtagtgaaaacagcacaaatatagcttggccattataactttaaatgcagatatatcctcacgttatgtagtggagatgcttaatttttattttttcaagttctagaaatattcagtgctgaaacattacagcattttccttcaaaccgacttccatgtttattttccagaacattagtgtataatttaaattggctttagttttactgtttaaacaggcttatttcaccttcctcaagccactgtaataattagcagacatgttctctagaaaatggaaaggaaataatgctggtggcatgcatagtggtcggattttggggcaggccggcttgcatctttttgaacaccaaggtcgtttggttactgcaagggacagggatcttggagtcatcagatgaatcttaaaaaaaaattaatttctggcagtgttggcttacactttttagtgaggaaaagcttagcattaaataataggcatttctgatttgtgaaagaaaattgaaaaattggcatgtctgcaaataccacgaaaaacataacatttccaaaataatgatctgtcaacgaaattgcaaaatcattatgtgaatgagctgaattgctttgtgtatcatctcatagaaatatgttttgcacagataatgtgtctaataaggacacatttttaaaatcagatttttttccccccagcaaatagctgcactgcaggtctctctcaagcagtcaactagcaccaccttatggatgatttggggacattgctgcttccctgctaggctttcgtaaaatgtagtcaactgatttaaaataatgggaatgttgatggtgatgacaatattaatgacaataataatgcttttttcccccttcttgtttttcaggcatcagatgccagctctgaaaaactcttcaacactgttattgtaaacaaaggtaagacccattcattctcctgagtaatggcttatttttatgttagtttcattgtcattgcctaggaagaaagaagagctagagtgatctttctcttataattctgaagctactgttgatgtttcatgtttttgcttgagatggaagtctgcatactttgtgatgcattaacattaacaaccagtttattttaaaagaatacattgagtccctatttaaactgatttgactaatcactactactatgtgactttaatatagaaagctgtactcgagaagaatagttctcaaaatgcctgaactttattgttacttatcaactacccagcaataggagaaatataaatagctgatgtgcattgcagactccagtaatcaatggatgtttagaattcacagtattatggtcataaaccaagccttactctgctgtgggctttctgtaaagttaataaacgagcgagagggcagaatttaaatatgcactatcccattaatttcttccaaaccacgatctagagtaagagaggctaatgatatagcagtacattaagggaaaactaaccttaaatcattgccagtaggtttctgcgcagctttcatttgttagcagtatcgttggaaataaggaaatttaggggagtctgtaatcactggctctgaaaggtgtgtaatttgaaagggacaaaccatataaactatttaatcttcccctttccactgtcgagcctgatttaggggctggcatgataattgctaagtaaagatgtgctttctgtgataatctctttctgggttacatgggcgacacttggtagcacttgaacagacttgggccttcacaaagtgaaatttgagaccatttcagccttctgtagttgccttggctagcatttttgctagctggttagtaagacatttccaagtgcagttattttgagctcccagattattttagaatttgaaccaattgcaattttaaatagtacattatgtttagagttcccttgaggtgtatgtgattgccgttactcccagaattactgtcatattgaattttatctttttttattgcataatggagtattccagttttatatttcatcatattttctgatggactgaaagtttgtataaatgtgttatccataatgctaaaagcccaataaaagaagatgtgtgccattcatagcatacagtactcgtgtgtaaaaatgcacaattgtctaccacttggcgtttccttgtgagaaaggagggtgatgggagagggagactggggtagagggcaggtcaccaaaggcagggcttcttcgtttctgcagccccccaggacctctgccacatgtgactgtgtctgtcttctgctgatttgctactgaaagctttggaatgtatttcccctttctgggatcaggccctagaataagagttggctccaagacctgcactctggccgccactgccctgaaagattgtcttcagggcggatgaacagctcgcctctgcctcttccctctggttctttccccccctttttttccttttccaatcaaacgtttcccacattcttatttttgtttacttacagagtgtgatttgtggcatctatttggttgtgaatagccctccccctgacagggtgcctttcttctgagctgcttttctaggggtgatttagttgccttgaaaggattaaggtttctttgtgtacactaaaatcaacataggctttttctaagctttgcttgggaaaccatacacaaataagcattttagttgatggcagattattcctttgccccttatttccatcaaaatggcctttcttttctcctccagagtttccccttaatgccttatgctaattcctgttggtaacatgaatgacaagagacggaatcagtgcgaatccaggtggtgcaaagtagactgactggtatcccgcaccccctttcctccctggggagaaagagattaaggggggtgtggagggggaaagcatcggggacagttttgttaaggggattagtattcaaactgctaaatatcaggaaaacaacttcaaaaagggattcattgtgtagcgataatgtcaataattgcttcaggacaggtgcagagtctccttataggcttgtggttttgggtctgtttttactccgggtagtggcagtgtttacaggatgaatggctgacaaggccttcaaggaactgtcagcttcatgcacatcaagttcaagttttcctgcaaggcggcctgcctgcctgaaagtcaggtctcctatctttgtccagtatctttagccaagagcaataaaaagcatcataagaaagggcaaatttacaccaggtaacaaacacaactggggaaatcttcaaagccccagcttatgggacaatctaaccagagtgcaggggagctgacacgtgtatccctccacctccagatgtttaagttacacatcacttctccctctcaagagactggtagtattctggccttagaggagtgtggctttaagctgctggtgagattatgctgctgagcctggtggcaggcagatttggtccataaaatttcaccgtgggagggcagtgctaatctcacaagctgattgtggtgggggttgggggggcgcagccctgatgttgggctgcacagtgcggagatgaagctcaggcagaggcagcaggggccgtggctcgaggcccatcagtcagcttgtgagcttgaataagtcatttaccctctttaggtcaagattttcaatcataacaaaacctattccagggccaacatctctggtggggataaaacaattaattgggaaggggcaggggttgaaacagagtggatacagtgagtatattttatatcacgtttgttcatcgattttattttgactttccctgtgttatagatgccatccagtttcatagagatttttgtgtttaggtgttccgaatggtcgttttcttctcctgccttttatttcctgctttaaaacaagttaatcaaacagcacatgcttgcatgtacacacaacatgcctaatgaggactgagcatttcgaaaggggtgtggcattgagcagggcttagcgttgtagacacaaaaaaacagtttaactttaatcaaggtcatagttgccatatttaatctttatgtgtttaaatgtttacaggatgttcatgtgaattttatgaatccttctgtctttgtgattcaaccatctgccaaagaaaaaattaattttcccactgagacagaggcacagagagagacttagtaaccctatttagttgattgaaatgctataggagcaacaggacctgtaccccaaattctggggtatttattctataaaggaactttcagtctattcaacatggctagtatttattatcctctcttgcctactgtagatccttgctggtgtcaccagtttggtctgtagacaaaagtgcagaaaatgagttctttgctgcacacaattatcctgccaagataatgaatctttcctaaaactcttggattgctccagagcagagctgcttgaggaggaaagaaaagaagggaagcctgtctgggaggaaggacaacactagtcaggcgtcaggagttctgtggagccctctgtttataggatgccagtcctggcatgtggctgtggtctaggttaggggaagagaaaaatccctgaattgctctcccttcttggttcagagccctccttcccaggatttagcccgtaaccaagacaagtcacagatagacgatgacaagtcaagacaactcatagatagacggtgagaggggcacagtggtgtattttaccccgtgactttctcaccccttctctttccttcaactttgtctcaaattgcagaactgggtactcctggggaaaagcctcctgagtgagccatcggggagctgtgcccagctaaatgggcatttctgaatggtttcctccagcagggaatgaggcccctcattctgcttctttctactgtgggcacccagtgtctcctgaaatgtgaacagcaacagagcagctgctcaccctcgtaggcaggaccccacctcacctccatcagcctgggaggttctagtggatagtcactcaccaagaagagcaccagacgcaacgctctggccacctggagccctctctgaccaggactgcttttcctctcccgggccctaccaggcctattagtggaacacacccggcctcttcttggggttggttttgcactgagaatttccggtggaacacagatgaggttggagcctttaggttagtgaagcctttggatatttttggcagtatggttctatcagcattgtagaaagaagacctagcttaaaaattgcctgaaatctgaggagatgaggtaagaaacaagttacccagcgatactgctggcttagtaaccaggtacctaataaattcttccatggcgaccatatgaccttattctttaggtttagacacaagggatttccttggtttggtgacagaaaggtaagagttatattaccatcaaggtcaccatttgacttttaagaaaaacccattcccgccgagcatggtcactcatgcctgtaatcccagaacttttgggaggctgaggcaggaggattgcttgagctcaggagctcaaaaccagcctgggcaatatagcaagacctcatctctactaaaattccaaaaacctagctggggttggtagcgtgtatttgtagtctcagctacttgggagggtgaggtgagaggatcacttgggcccacaaggtcgaggctgcagtgagccctgattgtgccactatagcctgggcgacagagtgagacaccatttcaaaaaaaaaaaaaaaaaaaaaaggcctttccataaaataattctatgcatgaaaataatgcagttgactgtggaatagctctcttaagaaaaaaatttggtttacagtttaaaatccctttataatgaacatatggagaccattttacaattcctcctagggtcttgggtttagtcgcagggaggacatgatgtaaagtgcatttccgatgtgcacaagagcaaactgcccgtttcagtctctgtaaattagtttggtttttgtcatgccttaaattccacataagggagagttagaacatcactcatttatttttctccctctggaccttctttgtactatttcagagcattttcttgagtttttaggagatagagatgtctggagagttaagtagtatttaagggtaattggtacttgatgcaagagacaaaggagttatgagtagttcagtccctcctcctactccatactgcaaatagcatgcaatcagctccttttgttatggaaattgaccttcctatagaagccgactcttggagaatttgttgtatagaatcatcctttgagcgttcttggaaacagatgccttgtactgttagtgtgaaaccaccagtaacagtcaaaaaatattccatgttgcatgaaagtgtctcccgaaaattttccaatagttgctttggccgaactgatcttttgccgaacttgtgaatgcgtgtggtggtgaatcctgggatactggatcccatcactggaattgtgaaccgggtggaagattccaggcattcgaagtgatcttgatgatgccttttgggtagaacttttgacagctgccacttttccatcctgagtgcccctgtgatggaggaggcgtagattacagtgtaacccattccattcttttagtcagatgttcaaacatcactctggttacttttgagctcagtggaaagcccttgacttatactgggcgattactgctgtcctttgaaagagttttctctatccttggcaatattgaccaaaaagcttgaatgttcatcagcctctcttcaatccattcatatttagcgttttgtgtagttaatgatgtagttagtatttggttgtctcagaaagtaatatgcattcatgatagacaattggaattgaaaaatatcagatcagttctctagagtctaatgagaacagttgagtgacaaagggctcaatcacgcgggccaaccccagacaggagggttcctaaatggaggaagcccgtggctagcccgtggcctctggattatttctagtttctgacaactgcagaaaaatgttgttttctctgaatatgtatgtttatttaactaggtttctttttgcttcacaatctggattccattcagtcagttaccactccaattaactaacaattatttaacattaacagtaattacagacgccagttaagcgcctacagatgtcaactgttagctttgtacctaatcactcaatgaaatggagaaagttcaacaaacatcaattagctaagcaattagtatgagttaggaaagagcatgttatcatgtgtgagctgattcaatttattttattttggcagtaaaatacacacaggcaagcagcaataagttcctcagataagataaaactctattgttttgcggcttatataagaattccttcctttcctgtgcataagtcaaatacactctcgtctggaatttatttaacagaatttgtctcaattactcagaaagcgcagtctcaggaagcacctttggtgaattatgaatccagtgactgtactgtataaggaaatgccagaaaacttcagtggagaaaatgattgattcccactcgagtaatccgctccgtgcatttcggatttttaccagtttattcctgaacctctggtggaacgagtgcaacagtgattttattaatttcatagtgcctgaacttttactcagctgtcttttatttagcccggagctaacatcaaagtattttacctacttgcccagtctgtgcttttaaaaagtagaaacagctgtctattgaagagccatttcatgaattcaccaaggagattccagactctcctgaactcagaggtgctgttccactctcttttttcccccttcgcctcctccaccccacagacttgactcttgtcattagctgagcttgcctggacttactgggagagtgcactctgaggcctgattgtatgaagtggcccagaaagtggagattcattttacctccaagaggaaagctgggcataggagctgggcctctgggtctcctcctacaaatgacttctcatcaacccttaaagcccttggataggagtggaagaagtcaatccctcgtggggtgctctgataggtctgtgtgcatcctatgtgcagaattttccatccgaacaagcctctcagcatgaactgaatgtgggagtagggaaaaagtattctgccactggtatggcttggggtgaagggccaccttgtcccatgtgcagtttctattataaagcatttcctcgtatacaccacgaccccagtacatgctggatcttgacagatgtctgctcttctgcatcaagtcactgggtctctgtgagtctgctttgtcaaattttgctgcagtaacaaaatagctcagagtcctacaacaacaaaagtcttatgttaggtgtcatctgccaatcagccgcaggtttctttgtttttattctgggatccaggccaaaggaggagtccccatcgtggttattcggctggtaaaggggaaaagagcagagacagaaacagagaatgcctccacttggaggtgggtgtggcgtttccaaaaatctcattggccagacaaagtcacatgaccaagcctgccatcaatggagtaggaagtaaactcctacagggaggagcagaagagaagagggatccacagggatccacagggccttggaaggaagggaaagcaaaccctgcatgggtaatgctatctgccacaggcccatcccagaaacctaacaaatcaggagctgttgcctcttactgtgttaatgcaaatgggatggagggtggcttgcatagctttgatgatctccgtaggcttttctgttagagacctggttccctaatagccatttggttggagtttatattaagttagatctgataagttgtcaagaaattaaatgcttttttattgtttatctggattaacttattgctggcttggaaggacttatggaaaagttgccccagagtgcagaaatgacttcagtgatttgcaaagaataattgttggactggccagatgtttagactctgcataattaacctgaggaagcatgattgctgtaaaactttactgcaaagtagtatgcgttgtcatggttaccttgaacatgggctttggatttaagattctcacagacactgctttgaatctcagtgctttgaagacgcttactagctgtggaactttgggctagttaaaacaccttagaaccaatttttccttctgtaaaatgggaataaccaaacccatctcttacaggtgctgtgaggatgaaacgaggcaatggatagaaagtgcttagcctaccttgtaccatattttgatctaatgatacagtgggctaagtattttacatacattctatcccctaatcttcacagcagctcttaatttagaaaagaatttagaaatagcatctgcattttataggcagggaaactgaagttagatatgaatagctagcatttattgaggactttctttttgctaggtattgttcactttatatgtaattcactcattttttaagtgagtaaactgaggctcagaaatgaggcaacttgtccaaggtcgcgcacctagtaagtggtggagctcggtccagctgactcctagacatgctcatagcagtcatactgtgctaggctctggggatatggcagagaatagaaaggaggaggatctctgtccttcctgagggagacacaaagcgggatggtaaaaattcggattgggggaaactgggttctatgggaagacactggcaggaaccctcaacaagggcttccctagggcttttcctcccataccttcccaaagtatttaatcttctcataaaacataaggtcccggaggttctcatccaggacttctccaggatgtcaaccattatcccatcacctgtggccagagtcgccatagttactgcagcgcagtggggctcagcttaaggcacctccagtttcctcgctcttccatgcccattcttgtgcctttgcgtgaactgatctttacttttcagccagattttattagaaatgatttaggaatttcaagcaggggcatttccctagcaaccgatgacataagcacaaggcccaaatctgtgctgttaacagggaatggcgttctgtgggctccgatctgcgtctctgaccctcgtaaaccttgtcttctaaaggaggaggctgagagcacatcattgcttttctaagagtccttttgaagagggaaatgtctcaagtgtgcccgttaatagactgatgtgggaggcagttatatttggatgcctttaaaagccacttggaaaacattttccccctcttatctatcacctttcacatctctcagcagagtaacactaaaacctaattttagccaagattacatcattttctcattctctgttcatagctgggaaaggtttttccatagtaaagctcctctccccgaaaacccagctcctccgcaggacctcttgggcttctgtgaaggcttctttatccataaagtttagtttgacaaggggtcttctgaaagcagattggtcagctgttaaagaaatgacatcagtggtgattccattgattcgttcaattggcttaaggtggaaaccatattgaaatgaattcttttcattcacatattattgagccccaaccatggaacaggatctggaggtaacaacactgaataatagatgacacccacctgaccagaagagtaaaagagtttaaatgtattttgaaatgtttttcaagtggtataatagcaaactcactaattaaaaaaaaaaaaatagccttaagactttcttaggtggaaaagcttatctgaggtgagccccgaagggtcagcagaccaaaaattgaccagccctcaaactgcagaattatgtctcgcatttagagagccccagaatctgccagcttgtgctcatcgttagactaaaacctacccctttgagttttccattttaaaaattgatgctattgttatatgagttaattaagctattgcaaaggtttttggcagtgccataaagatctgtacatcacctatcaatacagtccacttttttcacgtttcttcagttagattttattgtttaaatacttttttttttttttttttgagaccaagtctcacctcattgcccaggctggagtgcagtggcaccatctcggctcactgcaacctctgcctcccaggttcaagcgattctcctgcctcagcctcccgagtagctgggattacaggtgcccgccaccacgcctcgctaattttttgtatttgtagtagaaatggggtttcaccatgttggccaggctggtcttgaactcctgacctcgtgatccgctcacctcggcctcccaaagcactgggattacaggcgtgagccaccgtacccggccttgttgtttaaattcttaccaggttggcccaccgcaaggaggtggcaggagggaagccccatgcccaagcctgagcaagactatttgtaaagttgagcagatcactccatttgacttgcttttctcatgggtatcatgagaaactggggggtggcctccaagactccttgtgaatctaaagaccaaagtttgtgttagaaatattctagggccagccagcacagtggctcacgcctataatcccagcactctgggaggccgaggcgggcggatcacttgaggtcaggagttggagaccagcctggccaacatggcgaaaccccatctctactaaaaatacaaaaatgaggtgggcatggtggcacacgcctgtaatcccaggtgctcgggagactgaggcacgagaatggcttgagcccaggaggtggaggttgcagtgagcggagataggcgctaccacactccagcctaggcaacagagcaagattctgtctggaaaaatatttacatatatcttttagggcctctcagaacctgacgcttctgctgagggcacacattttccctgctagctgtgaaagagattctgaacacttagcattcaaaagcagtagtgcctcgtagccgataccaggacttcagtcctgaacttgtgaacaggaataagcctctctcctcttcaggagattgcatctgtgtaagaaagatcttaaaggtaagaggggattgagccccggcacaagggaggagtggaaaagacagtggctacaatttgaataccagctgttaaggtattacggtattaacctccagaataagagtaacaatacagagtcctccttctctgcttgcctgcatcttgggtgctgttaaaagagatgatttatctgctcagtaaatgtttataaaaccccactgtatatataagtacttagggttcctttgtacttgacttctcaagtggaatgactgtcatttggaccacttcctaggcagggattgctgcaggttagatgagggtggggggcaggggcgagataccagagaaagtgcccaagagcaccccaggggcaactgccaggcagcttctttttctatgagatgactcattttaccaccacgaattgaaatgaggcttgcatgggccattgtagataatcgaaagaatgtcaccaccctcccatctgtcttcagctgtcacagactcacacaccaagcatttcatcagagttctagttcttcaagttcatctaggtctttttgactggagcaatctgacttcctacttttcttttgctagaaggtgataataattgcagcttcattcactcagtgctgcatttgctgtttgttggtttgtaattcgatgcgcagtcttcttgtgtctttgcgggagagttggttttagaggtggcacacaccaaaatcatgaatggatttaaggagggagaggctgaactaatttgattgttaccaagtccataatgtgttccttgggaaaattccacttgtctggactgtgctcctcactttctgagattgagaactggagaaaggaggaacgtcacagacaagacagcaagaagcttaaaaaacaaattcctggatttggagcagtgtgctctggtggaatattagatgataaactacactttgtggttttgttttgtgcagttggctgtagaggccacatggccctgtataatgacctcttcccaagatgttagacatcaaatcagtttgatttctacccccatgggaagaggaactccggttgtaaagaggcagcttgagaataactggtaaagggtgacttgccatttccccgctggtcttgcctcccaggagtaactgttatttgaccacatgacccagttacaacctgttacccctgtgtggccagggcctcacccccccagagcacaccttcgggtcaggctcatgcctgatttgtgccttctttccttctcagggccctccaggttgagggaagacagctttacacctccaccttctgtattagctccaggataaacttgaaaactgcctactctgagggtttttttggcattttaaaagttaagtctgactttccgagccctctcagcatcctgccaggtatcttatcttattcaaatatcctaattgcttctggggctgcacatcatcctagcacctaactgacaaaatagaccttcacctgagggcctcattatgctttctgcctgtgcatcaggccaaaaatacctccacaatacctgctcgacatcctgggcttccaagtgacaaacaaataattgggtgaaacaaaccctgggcgccgagcagctgccatcagtgtcggagcacagaagagtccacggcagtaacagtcacagcgctgcctggttcatgtcagagcaaatctttgaacagtgggttgtgctgacaccagagaatgacagctttggaaatggcatgctagttactgctgcaagtgaggcctctcatgtagaccatgacaagcggctgtcatttccatacaggtgaacaactgacatcctagaagggggagggcgggagccacgcaggaggctgtgtttggcagtaggtggggccagacttcggagaggggtcccaagtaccggtgaccctggcgaaaactagcctaaaaacacagtctctttccatgcccctttactcactccccacacatcttctctgttacctctttggagttcatctgagagagggctacagaaatacaacccaacatgcttaaaggatgtttgcattttcactctgttccctccacatcttttcttctttttctttccttttttttttgagacagggtctcactctgtcgcccaggctggagtgcagtggtgcaatctcggctcgctgcaacctccactttctggctcaagttatcctccagcctcagcctcccaagtaggctaggacttacaggcacaagccaccatgcctggctcacttttttttttttttttttttttttttttttttttgcagagacagggtttcaccacattgcccaggctgggctcgaactcctgagctcaaaatgaaccgcccacctcagcctcccaaagtgctaggattacaggcatgagccaccacgcccagtgtcctccacatcttgatatgtcagggattagctttccggtcgcaatgcttagttttatagaggatggaaaaggcaaggtttctgctgataaggaactcaccatgaaaaggaatgggttagatgaaattaagtgcagaattgggtctagaccggtggttctcaaagtctccatcagcaatatctgcatcctctgagtggttgttagccatgcagaatctctgccccaccccaaacctacagaattggaaactctggggtagagtcacaactctgttttcacaagccttccaggtagttctaatgcagacgactgtggtccagaaaaaacgaggaagaacattttggcagtgaggttttgtaaatgctcagacgatccacagagtcactgggtgaaatcatactctattgcacagggaataggtctaggttcgtagttgggcagccttttttttggaggggacagagtctcaatctgtcggccaggctggagtgcagtgtcacgatctcagctcactgcagcctccatatcctgggctcaggcagttctcctgcttcagcctcctgggttggtttgtttgtttgtaaatatcaacttcacctgatctgttcaaagtgcccctgcacctaccatttccaatccttccactctctatagccttgtgaacaggcctactcatgtttagcgtggttctgacagatgctaggcctgtacctagggctctgctcatctgaatagagtttgaaaccatgaccttgggccaatgttatgctgtaaccagctgagctaacttgctcaaccgcttctgaaagacaaactgttccatcgagttccttcttggcaggtgctgcatcaccaatgccggcctgccatctgtgtgaagggctatcacagcacacaacacacacacatactgggcaaatgtgccgtgattaccactaactattttgtaaacaaagtactgtgttaattctgttttaaactgctttatccaggattgtagaacaatgggcagaagtgttttgaaatctttttttcttctgtattgaatattagagttttaaggccataaaattaacatgtaaattgagttttcccaaaaaatgtaaaactcttaagaagtttaagtaagttacctaaatagtaaagctttttcagttgtccttcaagaataggcatcttccaaaactagttgtgttaaagtagtggttctcaaactttagcctgcatcaaaattagctagaggacttgttaagatacagcttgccggccgggcgtggtggctcacgcctgtaatcccagcactttgggaggccgaggcaggcggatcacgaggtcaggagattgagaccatcctggctaacatggtgaaaccccgtttctactaaaaatacaaagaaattagccgggcgtggtggcgggagccttgtagtcccagctactcaggaggctgaggcaggagaatggcatgaacccgggaggcagagcttgcagtgagcggagatcgcgccattgcactccagcctgggcgacagaacaagactccgtctcaaaaaaaaaaaaaagatacagcttgcggggccccacctccagtgatttctgattcagcgtgtctgggctagggctccagaacttgcatttcaagtaaccaggtgatactgatgtttccagtcccctaagagcactgtgtgatctacatgggttaaatttaaatgcctttttcaatagggaatattttcaacagggaatatcacaccactcaaaggtgtgaaatgtatctttacatgtaagatgaaattgacacatgaaagtgaattcaattttatcatgaatcgggagctttttacaaaatgaaaattttcaactctaattcaatatagaaaatgtagaaatgaacccccatatatacccattacctagattcatattaagacttttccacaattatttttaggtgataggctggatagggcgatgtccaccttttttttctttattgctgaaatattttaaagcatgtctcagacttcatatcattttacgactacatactttagtgcacatctataaaaaagaacatttcttacaaaatcacatgttgttatcacactaactaaatatgcagtaattcctcagtgtcatctgaggaatatacccatccatgatctcatctccatgattgtcccacaaggggtcattttacgtgatctgtgcacatcaggatacaaacagacacacatactgcatgtcttaaatctagagtgctccaccctccccagcttcccattctttcaagtcattgacttgttgcagaaaccaggtcagctgtcctgaagactgccccacattctggaagtccttgcggtgtcatttagcttgttcctctgtccctcgtatttcctgtaaatggaagttggccgtaaagctttgattagattcaggttagagttcctggcaagaaaacttcataggcattgcaacgaacctcatgttgcctcacatctgggaacacacagtgtctgggtgtcccagttttagtgatgtcaaaattattcagtaagtttaggttgtggcaacctgatacttgcattggcatgttccccgtcaagcttttatctcatggtctcatctattgatgatgcttgcctgatgcagtaattcattagagatggcagagggtgacttttctagcattattccacatttattggctgaaattcttcagtacaatggcactttccctcatcaactagagttctttggttacactcaaatataatacaaggaaaaaagtaaatgctcaattctctccttctaattgcatgttttcagagcaaaaagttggtgctctaccaggagtttattaataagtctgaacagttctctgcatttttcttacaataaatctaacctatgctttcagtgcattgagcttttcttacatggtttgtgtttatcaattggagggacaaaatatctaaaaattagaaaggtactgcaagaacaacatcgtcaaatgaggtcatacacacttaagtgtgtgtgaatttagtcatacctgcccttcatagctctgttcaaatgccacattctccaggaagccctcctaccttcccaaggtttgaacctttcctgtggcacttcctgcatcctgcctgtctttttttcttttcttttcttttcttttcttttcttttctttttttttaagatggtgtctcactctgtcacccagcctgtagcagtggcatgatctcagctcactgcaaccttcgcctcctggactctagtgattctcctgccttggcctcccaagtagctgggattacaggcgcatgccaccacacccagctaatttttgtatttttagtagagatgaggtttcaccatgttagccaggctggtctccaacccctgacctcaagccatccacctgccctgtcctcccaaagtgctgggatttacaggcatgagccaccatgcccactgcctgcctgtcttttattgaagttgtagatgtcctcttccccttttctctgaattctacccctatcctacccatggtgacccacagggtgctttgaattaaaatgaattaaaatataatatcctaaaagtgatttcaaactttggaatttaggttatatcctgagaatcttaagtgacttgattcaagaaagtaggcaaaaacctgaatcgtgtttggtctgatcaacccatttggaattaatcgaaaatctgatgatcccaactgggtacttttcaggaaaggagtgggaggctgcccacgtatattgagtgcctacagtgtgccagggcacctgctgatttatttgattcatacagtagcctagccaggtccgtctattacctgtgagaacactggtgactggtaagtgacagtgagttcttgccatctcctgttctttgccctttctcttataccagcccagcataaagaggatcgggggcttcagtttggtgaatttaaaaatgtctcttgttaaaggccgggcacagtggctcatgcctgtaatcccagcactttgggaggctgaggcgggtggatcacgaggtcaggagattgagaccatcctggctaacacagtgaaaccccatctctactaaatatacaaaaaattagccggatgtggtggcaggcgcctgtagtcccagctactcgggaagctgaggcaggagaatggcgtgaacccggccgggaggcagagcttgcagtgagcctagatggcgccactgcactccaacctgggtgacagagcgagactccgtctcaaaaaaaaaaaaaaaaaaaaaaaaaaaaagggaagtctcttgttcacaacacagcttctcatccagcctgacctgtttgaagtatgtctggggtggaagatcctggtgatgcaattccagcctgggaaaacttgaggagaggttcagtatagcaccatgggcggcaggctgtcagtgtgtgttagatgtattcggttacttcgttttatgggagatttcatgtgatactaagacgtaacctcccacaaaatgagatttatagaattgggtatatgtctaatcaataaacatcaaactggaaaaactgtaaaggcatttcaagtgatagtagttatggctggaaatctcagtggagttattttttttttttttttttttattactgtttaagccttgacacttttatttatttagacactgggtctcactctgtcacccagactgtggtgcagtggcacggtcatagcttactgcagccttgaactcctgggctcaagtgatcctcctgccccagccttgcgagtagctaagactatataggtgcatatatacgtgcgtgccaccacacctggctaattttttaattttctatggagacaccgtcttgctatgttgcccaggctagtctggaactcctggcctcaagtgatcctcctatcccagcctccgaagtagctggaactacaggcctgtaccaccatacccggctaactttttaaatatttttgtagagatggggtcttgctgtgttgcacaggctggtctggaactcctggcctcaggcgattaatcctctcacccctgcctcccaaagcatcgagctcctggtgcactttctaactcacccttcgaggatgtgtgtatttatatgtgtcagggagaggaaattgatctcctgaggggtgggtggaagagcacttgtccctagttaatccttttttgcctgttctttaaaaagcgtgatagataggccaacccactatgagttttctggtggcaaaagtacaagaaatccctgctatttatccactatctgtgtagcttcctctttgaagcacctcaagccctcgccagcctcttcttgtccgttgctgatctttggctctgggtgccagtcagcctcaggggcggtgctgccttttttggcagagtatcactgttaagccactttttctctttaaaaaatgctacacagaggtttttgaacctgaaatgcaattattttaaaggcatcctcaccactcacttcccgagtgctctgttacacccagcgccacctgccaaccacagtgaacatccagccatgtcatttcttccattcctgccctggagtaaagtagatttactgagctgatgacttgtgtgcatttgtacattgcaaccttagcttacctcttgaagcatgtagagcattcatcacccaccattcattcactgcctactcccaccacagctgtttcgtggtctgtctgctccctgtgccacccccaccccatcaggtgggccttttgcaagtgatgaagtcacctgtgggggaagagctttcctttcctctcctcaactcagaaggcctcttcctcttgctcaagagggtgctgctgctttctgcctccttccccggccggcctccatcccagttcaccttttcagacatggcccctcagtcaactcttcccttttctcctggctttttatttctcccagtctcttaagagtatccttagctttaaaaacaataacacagaggatgggtgcagtggctcatgcctgtaatcccagcactttggagcctggggcgggcggatcacttgaggtcaggagttggagactagcctggccaacatggcaaaacaccgtctctacaaaaatacaaaatattagccaggtgtggtggcgcacacctttgatcccagctacttaggtggctgaggcacaagaatcacttgaacctgggaagccgtggttgcagtcaactgagattgcaccactgcactccagcctgggcgacagggtaagactccgtctcaaaaacaaacaaacaaacaaacaaaaaaacccaataacacagaaatgcaaacaacagatctagccctgctgcttcttcatatacttcaaacaaagaaaccttttttgatatctttttttcattccccctttgtataaaataccttgcattggtatatctttttggtgataattaaggtgactatataacttactgtccaggcctggacacttttgagagtgaaatcgactgtttcttcatcattatcctgggacaacaggcctcaccctggactgtccatgtaaaccagggcatataatcacccaagtgatcatccaaggtttttcagtttgtcagagtggttcaatccactcgtgatgatactgccatttattgagtacttactatgagatgagctttgttctgatcacttcaattaacccatggaaccctcacagtgcccttttgaggtagatggtattaacactgttttgactgtgaggaaactaaggctgaacaagttgctcaaggttacacacctagttacgtcctccacactcaccccatgctacatcagcccccaaggtcaacatccatatctcccctgagctgttagcagagatttctaaatgtctgctcaattaaaaggagtgtacactgtaaacaagagtatcgccttccaaagtaagcgtttagggttgcctggttgtcaagggctcaataacaggagtgaagtacttaattcttctctcaaatagtatgtggagccggctcggaacaagcagggcttcccctatcactaatattctctaaaacacactccccaccccacccacccccgaaatggagtctcactctgtcgctcaggctggagtgcagtggctctgtctccactcactgcaacctctgctgccctgattcaaacgattctcctgcctcagcctcccgagtaggtgggattacaggctcctgccaccatgcccagctaatttatgtatttttagtagagaccgggtttcaccatattggccaagctggtcgtgaactcctgaccttgtgatccacccgcctcagcctcccaaagtgctgcgattacaggcgtgaaccaccgcacccggccaagacacacatttttaaaacaaagaaatggaaaagtctagactctaagctggttacaccccacacagtgaaattctggttatttgtttctgctgatttttctcatctcacaggtttctcattcccgaaggtaatttaggatgatgttacttaagaactggagttaacttagtgaccagatattaagccatgaatttcttggtcttcctaggaatgggaattttacacaagtacaagcatctcttttgagaacttaggcctctcacagatctctagcctgacgtctcattcgtatctcttttctttcccttgctgttgctgttcttcttcccctactttaaaaagcctttcctgccaaaatctgaatcgttactccacggagtttattatttaggcagatccgaagatcaacacgaagtctttttgttgttgttttcttgtatttttttttttaatgccaccagggtgacaggaagatttactgaaagctgaacttattttgtttgctctaatattcacaagcctcaagagtttaaggaagtggtaagtacacccgctgcctcggggaatactgttagggtatgagcataaagttatccacactcgtctccaaatcgcaggcgtcaatctgtagggattatgcagcgggggaagaaggtggctattacccagaagagagctgcttgagagcttttcagcattcttccccacgggcacagagcatcttctcttcatgttcctacaaagtgttatggagaggaaagtagttggtagggatctttttattgtacatatgttttaacacacacacacacccctttctttcagctctggttccctctaaaaaggtcctgttctcatcctggccaccagacttcttccaccaggggtcccttctctctttctttgtcaccaggccaagtttgttaaccatcttcagaattacaggactttagtagctgaggaattccttttaaagtggttccaaactcagcacctttaggcaacacagcacattgttctgctttgttaagagaagcttgttttgaagagctaggaaaatgagttcaagctcagatttctctgggtagaaagggtatcccatatcagatgatgatgtgaagaagcagattgtgaactgtaaagtgaaaaggtcttaaacacgagagataagcaaaggggtgtgtatttcaggtaacatacaaacacaagggaaacagacctctggcatctcatcgcatctataaatctggatgatttcaggcaaaaatgaaaacatttgcttttcttcaatcttgggaatttctaaaacattgagttttttaataataataataataatagcaccatttgctgagccccaaatatatgtcttctgctctactgggctcctgatatacgttctctctagtgggcccaggacctgcaaggctggtattgttactgctgtatagaggttcaaggagatgacatgccagaggccacacgactgacgtgtgtgacagccagaatttcattcgtgtgtgtgtgtgtgtgtgtgtgtgtgtgtgtgtttccgatggagtctcactcttgttgcccaggctggagtgcaatggcatgatctcagctcactgcaacctttgcctcctgggttcaagctgttctcctgcctcagcctcccgagtagctgggattacaggcacctgccacaatgcccggctgattttttgtacttttagtagagaccggttttcaccatgttggccaggctggtctcaaactcctgacctcaggtgatccacccaccttcttttgtcaatttatccagtgatcaggtatttgagtgcctacctgacattgtctgagagacagtggacactgagatgttgtacatagctttgcttgtagcagttcatgacctgctactgggctagtcagatattgaccctgagtctattggaccgtagctcactttctttttatgttgcaaaattgcaaacctgtagaaatgttgaaagaacagtatgacaaacacccatatacccttcacctagatccactgttcttaacatttttctacatttgctttagctctcttttttttagataagtcatttcaatgttaaaagtatcatgatgcttcagtattcatctgctgcactttctgcataatctcataccattatcatacctccgaaagttagctgtgattctgtaatgttatctaggatataattcatattgaactttccttgcttgtttccaaagtgtgcttttttacaaaatagtgagcttttttttttctttcatttttgaatccaggattcaatgaagaccacacctttttggttgatacgtctctttgacctcttgaaattaaatatagcccccagtcccggccccaaccccttttaaaatctttaaatgacatcagcagtttaaagagcccaggctggttgtcttttaggaagtcctactttgtgaatttcctcatggtggggtttgttacccaattattttttaattaaaaaaaaattccattttcagtctgtgttcacactgctttatgagtccagtttgcttagattttttgtgggggtacttagatgtagctgctttgggaagagggacacgtggaaaatatagagggagatggggaatatttagttcagcattttatatgctataaataattatagctgtatagccaaatgagcttttagagctctggattccattggaatttaaggatttttctcttcccctcttttcttgtagagattagtttgttgccaacaaccctggaactggcgaactgcttaaggcataatgttttcattaagaaaggatttaactaattagatttgactagcaagctgacaggttaatcaataagggaagtggggctcagcaccccttaagttgggagtctccattaagtcattatggtgtctgctaaaacattcttcttcacaatgattcttaagaatttttacgtgaatccctctaataaatgttagaaaatcctgtccctttcaaattccgtaaagatctgtattgtgttcatgtatttcagattcaaactgttgagtattttagggagcctcgcagtgtcagacaggcccttaaatattgtcttatttttacttttgaagacccagtgggcctgttcatcctttgtcatgttacttcagcttttacaaactaacttcactgcagtttattatttaaatttaatttgttcccagataaacctgaatgttgattaaaaccagtaatttggttaagtgtcagaattagaagaaggatgtggaaagtgacgagtcggggataggagtagagaacgtgagcttcttgagtcacctgcaatgggtggtgttttataatgctctcttccctaatcatgttaatcaggagattttccttttggaactcctgactgaaagcttcttagtttacacacatgttcctccaggatgaacgctgaaaataactttttcggttttgtttgtttgtttgttttcctctatacaaccccttgcaattgctttggtttagaacacctttggattctaagtttcatggttgttctgggagacaccacattcaccctctcaacccaagaccttgaagatgggaggtttttcggacctcatcatagacctccaagggcacttggaagctcagagaggccaaactgccccaggaccagtgggctggcaaatggcacacctggatttggcagaaagcccctagagcctgcactcttagccactctgttaaaggagctcttctttttgagtcagacagacagcaggaagcgcccgctgtacagattgtcaagtgcatagtgcttggaggcatttgaaggaagtaaaaggctctatttttttccccagagaaactgttttaatttacctttctgagttgtagagaaaaatactcgcgtagctctgctcttatttatgtattttcaataaaacaaacttgtgtatttgggttttagtttaacaggtcattggcccacatgtaaagctgatttgttaggagtcattacctagaaaataaaattctgaaataaagatcaagtattcctgaaactaacgttttgtttatagacctttgcaagtatacatgtagactttttgagaatttgagaagggtttttgagacagagtctgggtctgtcacccaggctggagtgcagtggtgcgatcaccactcactgcaagctccacctcccggttcaagcagttctcctgcctcagcctcccgagtagctgggattatgggcacctgccaccacacctggctaatttttgtgtttttagtagagatggggttttaccatgttggcaaggctggtctcaaactcctagcctcaggtgatccgcctgcctcggcctctcaaagtgttgggattacaggcgtgagccaccccatttggctgaggacttcttttataaatgaagatgtggctgtgattttgcaggcacatatatacctttaggtgttttcagttactttcatatgtgcttatcagcaatttgattccatatttgatttataaccctgcaggtgtacaaaactaatattataactagattctctgttttatagtaagcttatcaaaaatcaaggcatagtgagaattaaaacatcagtttatttttggaagaatgattttattttcatcctgacttttttttttttttttttttgagacagagtctcgctttgtcgcccaggctggagtgcattggcgtgatcttggctcactgcaagctccacctcctcggttcacaccattctcctgcctcagcctcccgagtagctgtgactacaggcgtctaccaccacgcccggctaatttttttattttttagtacagacagggttttaccgtgttagtcaggatggtctcgatctcctgacctcgtggtccgcttgcctcggcctcccaaagtgctgggattacaggcgtgagccaccgcgcccggcctcatcctgacattctttatgtgtaaggtgctaaggtggtagcatactgctaaaactagattagtagtacttaatctagagggatcttttcaataattccatacattaaacaatttactgtctccattacaaggtgtaccattgacttaatactggttttttggggagggagtgagtttgagaaacactaggacgttaaaaactgctatgttgattgtaggatatctggatttcagaaacgttagcacatgcttgtgcaggggtgggagagggagaacctgtgtcttagaaatgaagaactatggtacatttatgtaggatatgatatcacattttataatttgtctgcttaaacaatgatttacagatcttttgagaaagagagcaaggaggttgggccttttagtaagacagaaaaatgaccttccgtttaagacttagacaaattaaattggactttgaaagtggtttacccttttcctctcgggtaaatgtcggaagtgagtgccctggctgaacataagggaaggtccattgtcagcaccctgaaagcctgtttgaaatgtcatcaacttggagcattcattggcagcgactatcaacagcccattttaaaaggatgccttgggtagaatggaaattacagtggccagccgttaatcctttttaataagggcaactgttgaggagaattatgttgtaagaatgaatgaaatttgggagcaactctagtccccatgttctgtcgtgactgtcaacaccaaatgtactttcatttttgcaactgcctaaggattttccatttaacaaacttacatgacaaatgggaaagcagtggcattccctgagagtccaaaatctggtttggctctgccgttagcacatttgcctgcagggattgatgtatctgattgaagaatgttgagttcagccaagagttaaggttaaggtccttctatttgttttgggtcagttcctacaggtagagaatttgaaagccctgaagtggtttcattgcccctagtagagataaatggccaaatgtaataaaaatagacagtgctgtccttaattgtcctcccctttatataaaggacctgggaggtggatcacctgaggtcaggagtttgagaccagcgtgggtggtgggcgcctgtagtcccagctactcgggaggctgaggcaggggaattgcttgaacctgggacattgaggttgcagtgagcagagatcgtgccactgcactccagcctgggggacagagtgagactccatttcaaaaaaaaaaaaaaaggacctgggagaagggaaggctagagggctagagccagtttgtattttattaggggtcaggatttactatgttaagttttaggatgtgaatctggaattttcttttttttcatgttttaagaagagaatagaaagatgatagaagatatttgacacctgaaatgctacctctcaacacattagaagtttttatatagagacaatggatgtgtttattagaaatctttatttactcataaaggaaatctcccaaggaatattttgctgtcataccatacatatatttgaatgagaaatggcatttcttaaaaaaaaaaaattacctcattgactcatttccaccacatatttgaactaatgaattgctgtatggaaatatactaaacaacttacagacatcctattgtcgtatatgtgatataaatgtcaacatttcctatcaaaatggcatctgatgttggccctcttaaagttctgtggcttaaaatactaacagtaggaggaaaataaacagagaccaaaatgcaaactcaacaatgagtaaaaataccacagtacaagtggaaccttctataattctgtatcccagaatttttgagaagagaagataacatcttaagcattaagaaatcccaagaccctgtccagcttattgctgttggagagccccaagaccctttaatgctccagtttagaggatcatattgtcaagtcagagaggcttaaacacaatagcatcttctggaaccctagtgacctgtattgagagtggatctggcgcttttgttcttttgagaggcaggtgtaaaggataacacacgggattatcttattttaaagcatctaaaagccaatcccatcccccttcctcattctctttcctctcagcttttagagtctttgatcaggtaaattctaaaggcagacgctagtgaagagtaggtaggtaggcttgtgttttcacttctccgtgccagctttctgtcctcaccctcctcgtcagttagcactgatgaatgtgtagaattagtgaaggctgggtattaacatcggtaatgtaactttcagaacctctgcagtgtctaaggggaggaaggttatttccaccccacctcgtgggaattcaaaggtagctttccgattgtgatcaggttaaacaattccctccaggccagcgtgtgggaacctgcacattcctaccaaagcaacggtaattgtacacaagtgtgttttcagatttctgtcatagcaagcaaaagggaccacagccgtgtttgttagagccccaaatgcctgtttgccacagggctgggttttttttgtttgttttgagatggagtttcgctcttgttgcccaggctggagtgcaatggtgcagtcttggttcactgcaacctctacctcctgggttcaagtgattctcctgccacagcctctcaagtagctgggattacaggcatgcatcaccacacccggctaatttttgtacttagtagagatggggtttcaacatgttggccaggctggtctcgaactcctgatctcaggcgatctgcctgcctcagcctcccaaagtgctgggattacaggcatgaaccactgtgccaggccaggctgtttttaaaacttacgtttcagaggttaaaaatttgtcttaagataaaaagactttcttaatcatctaatgtatcccaggatctatgtcttggttttataagacaggctggcagtaaatttcagacctgacctaacaagttaaaatcctactcctgggcagaagtcttctgtgttagtgacaatgtggaaatgaaggaaggcttccatttgtggataagtgtgattggacaaaggccaggatctgcaggtaatacagtggaggaaacttagcaggacctgattgttcagattcttctatgttcccctcctctgggaatagggagggcacctctcaaatgatggttttatggtgtatttcaggggaaggttagaaaatcctttctaaattttatgacctgctttggggaaagaagggtgggaaggtgagagtgacctgctgctactgctgttttctcagatcccaacaggccgtgttttagggtagtatgtcctgaagcacatcgcttatagaaacaaataaaaaaattgtttgctttgtgatgctgtcctgatctgtggatcttaattgctattactctgagattttcttaaagcatataattctttttaaatgctttatgccagccaaagttagaagagaatcctaaacttatccttaaagtgcaggattatcatggtttttgtagtgcagcattatctggttggaaaactaggtcagaaagacccttaccaggttgagttcctccaagcaatttcaaagtccatctggaggccgggcatggtggtggctcatgcctgtaatctcagcattttgggaggccgacacgggtgggtcacctgagatcaggagttcgagaccaacctggccaacatgacgaaaccctgtctctactaaaatataaaaatcagctgggcatggtggcgggcgcctgtagtcccagctacttgggaggctaaggcgggaaaatcacttgaacctgggaggcggaggttgcagtgagccatgattgtgccactgcactccagcctgggagacagagcgagactctgtctcaaaaaaaaaaaaaaaaaaaaaaagttcatctggaggcagcaccgtgcaagttgtgcctttgaccattttcccaattggtgattctaccagtgagagagaaattcacatcttgtatttttgtgtgtgtggcctgagtaagagtgccaaggcagcctgcattcttaactgatccattaactttcttcctccacagatcgtttccttaacaatgctccctgattagaagaaatgtctcctctcctcccagttactcagtgaacagcgctctctcccaaggggccacatgaaagggaaacccaggcaccacctccgggcaggattagcagcctgggaggagccactttctgttctttgtgaaagctagagctgctctgctcttgagaacagccatttacaaaatggggcgaaaacgacggccacaccctccatcactctttttctcctggtgctttccagagcctttggagacctgtgccgggggtggggcttggagctcccgtgccgatggttaaaggtaccatggctgggccagtgcggaccccagtgctgttccccactactcctctgcctctctccacttcccagttccttcctggtcaggagcccggcagccccaaagactggtaatagcctggcctgtaccagatgccctgttacttccccaggggtctcctccttcccacacttcatgatgcccagtttctgttctgttttctttccaggaacgtgtccctacctggaatccccaggggggcttccatgttccattagagaacttcacattcaaccctcgttttctgttttaaccaatcttgccagtaagtggtgagatccttcagggtaggacccaggtcttactcttcagtaaactcctagtttcaggtgttgaaatttggcagtcagtcaggcgttgttgaaatgaccagtaattgtttctgtactgtaggtaataaagctgcggaaattattctcttcctgaaacctgaagacttcagaaatgtgaggaagccaggcctcaagtgccctcctctttcagatgttaggataagaggttgagaagttgttgtaattgaatgaactgtataagcacaatgtcatgaacttctaatttcctcttgctgaagatcatgacactgtttgcccattgtatgtatgtatgtatgtatgtatgtatgtatgtatgtatgtatttagagacggactctggccccatcacccaggctggagtgcaatggcgcaatctcggctcactgcaacctccgcctcccgggttgaagtgattctcttgcctcagcctactgcgtagctgggattacaggcacacgccaccacgcccggctaattttttgtatatttagtagagatggagtttcactctgttggctaggctggtctcaaactcctgacctcatgatccgcctacctcggcctcccaaagtgctgggattacaggtgtgagccactgcacccagcctgtttgcccattattaagcagtaaaaggacaaccagtttttttttttgttttttgtttgtttgtttgttggttttttagttagacttcacagaccatgaaattcactcttttaaggggtacatttcattgacttttagtatgttccaagagttatgcagctatcactacaattaattttaggacattttcattcccccaaaggaaactctgtacccttagcttctgtacccctcatcctcccaatccctcagcccaggcagccactaatctgctttctgtctctggctttgcccgttcctgggcacttcatatacatggtgtcatacaacatgtgatctttcgtgtctggcttctttcacttagcataatgttttcaaagttcatgttgtggaatatatcagcatttcatttttaattgccaaataatattccattgtatggatatgccacgttttgtttattgattcatcagttgacggacattcaagttgcttctatttttttggctactttgaataatgctgccgtgaacattcatgcacaggtttttgtgtggatgtaagttttcatttcaggtatgtacctaagagtggaagtgctgggtcatgtattagctctatggttagccttttgaggaactgccagacggttctccaaagtgactgctcagtttttcattcccaccaacagtgtatgagggttccagtttctccatatacttgtcagcacttgctattgtctgtgtttctgtttatagtcggtgtgaagtaatatttgattgtgggttggatttgcaattccctgaatgactaatgatgttgagcatcttttcatgtgcttatggccatttgtatatcttctttggagaaatgtctaccccacccatttgcccactgttaagtgggctatttgtttttttattgttgagttgtaatagttctttatacattctggatcctcgacctttactcttaaaatgatgtgcaaatattttctcccattttgtgagttttcttttcactttcttgatagtgtcttttgaaggacttctttttaaaataaaactaaagactgatcactcattttatttcaccttttagtgagtattcattccaaatgacggtcaagaagatactatttttttttttttactttttatttgggaataattttaaacttataggaaggttgcaagaataagaatagcacaaagctcatatatcccctttacccagatctttttttttttttttttttttttttttgagacagagtctcgctctgttgcccaggctggagtgcagtggtgcaatctcggctcactgcaagctctgcctcccgggttcatgccattctcctgcctcagcctcctgagtagctggtactacaggtgcccgccaccatgcccggctaattttttatatttttagtagagacggggtttcaccatgttagccaggatggtctcgatctcctgaccttgtgatccacccacctcggcctcccagagtgctgggattacaggcatgagccaccgcgcccagtctcctttacccagatctaactcttaatttgttgctccatttggtttctatttccgtttcttcctccccttcccctccgccatcccccccgcacaaatagacaatttttttctgaaccacttgaaggtaagatatatatcataaccttttatgtctaagtaattcactgagtatttccgaggaataagggtaatgtctttcataaccacagtacagctaccaattgcaataaatttttcactgatgtgatgcctttatctaatcagctcttcagattccaggtgacaaaatgtcctttacggcattacttttcccctccagtataggatcttgtctagtgtcgggtgttgcatctgagtgaaaaaattaatgtctataagggtatttcctaaacatgtgattaataatcatactaaagtgtattatgcattacagctttcaaagtgttttcttgtttctttattattaaatatatttatttttcctcatagcaaatacttagaatagtgcttaggttagcatagtaactaatacttagattggttcgtgcatcagaatttctagcaggtctcatctgacccatctgccctttaggattcctcacatggagaagaggcttccatgtcctgagcacttccctagagaagagggggtgaaggagatagggatggaccagtctacctgttgagaaagagacagagaagtgggtctcagtatccgaggttcctgggttgacctgcagacatcacagggccaggtcctttccttcctagcagtgctatttgtcaagacccctgtctgtctcccctgacagaaacattgcggtggtgggggttgtgggggtgcatccagcatgaattctccttatcgttttgactcttcctgttcccgcctggctctcattgaacccacttaatcttcttcctgatgagttggcccaggcaggcccagctttccctttaacaatttgtcatcttatacatcaccagattccaaactctctcaattctagcaattctgctttaggataagaaaaaagcgtgtattacttttgcaaacaggtgcaaagtaaattggtaatcgtactgaagtacattatgcattgcagttttttaaagcattttcttgtttattgtagttatctggcctcataacacacacttgaggtagatgtggcacatgtgatctccattttgtccacagaggaactgtggtttaggaggtggcccctcaccaaagctcacacctgtcttctctgattttgcatcttatgctatttccacagggctgtgcttcctaatcagtttgttaataaaactcagtattgtgcatttggtaggaattggtttatacaccattcaagaatagtaaacatttacaccctagatttttaatgatctgagacagcaccgaagtatataaaaaagttaggctcctgagcacttaattcttcaaggaaggggatggaggaaaatctctatctgcagagataatagcagcttaagggtatcttaaatgggatgcttctcaggactcttggagacttagagctagtggtgtttaataaccacagtttacatcactcagagtcatggaatagttctattgcataaacagagcattttatggaaacttagaaaccctcactgctgcaggacaaatgctgtacaaaatcgaagatgccaattgtctagattattttcccctaacaattttgtatgaaaaatttcaaacatacagaaaagtgaagatcattgtacagtgaacagctttattcccacctcttccactcccacctgtactctcaccacccccctacccccacatctagattatgcagttgtaacatttttctacgttagttttttgggtttttttgagacggagtctcactctgtcacccaggctagagtacagtggggtggtctcggcacactgcaacctccgcctccagggttcaagtgattctcctgcttcagcctcccaagtagctggaactacaggcgcccgccaccacaccctgataatttttgcatttttagtagagacagggtttcaccatgttgaccaggctggtctcaaactcctgacctcaagtaatcctcctgcttcggcctccaaaagtgctgggattacaggcgtgagccaccacgcctggcctctacattagttttatcacataaatccaggctatttttgatatactttgttaataaaatcattaagcatctttgatgttttggatggaaggcaccctacagtctcttggtggctgagtttccttttatttttcagaatccctttgaaccccggcaacatgggacagagctgagagcaagggccttgattctcatactcaagcctcccgacagcccgctgcatgcgccaggcttcacgttgtactcgtttgtccagataccatgaaaaccctggtcgggtgtggtggctcacgcctgtaatcccagcactttgggaggccgaggcgggcggatcacgaggtcaggagatcaagaccatcctggctaacacagtgaaaccccgtctctagtaaaaatacaaaaaaattagctgggcatggtggccggtgcctgtagtcccagctactcggggggctgaggcaggagaatggcatgaacctgggaagtggagcttgcagtgagccaagatcgcgccactgcactccagcctgggagacagagtgagagtctatctcaaaaaaaaaagaaaaaagaagaaaaccttgataaatattagtatggggatacattgtcccctcccccctttttctctcagttaaaaatctgtcccagaatgaggtttggcgggacatatggtttggcgtgcttgtgggggctggcagggtgaggtatgtatggtagtgtagttatctggcatcttatctgctcactggaaatgttgggcactgaatagattagtcagagtttccagaaatagaaaataaagccatataataaatgcagaagtcccctagttaatgtcagctgttgtgtgatatctgccctaagtcattttattgcctttgtaagattcttaaactgtttatcattatccctgccttttttaaaaatggaagcaacatcttcctaaagaggttgttatgagacattagaaggcctgctttcatgcctaatagttatcaaaactgaaattcagtatagcagtgttgaaggtgaaagaaggtttgggtacttttaggtagcaagagagataattataagctttcaacccaaggtcaagataaatataaatctggaggaggaaaaaaaaaaaagaagtctagcttctcattagtaggacagcgttctcattttataagaccttaatacccaataggaaatggccgtcaattctgttcatttcatattctcacagcctgtctctcaggtgggagaacacagctaattcttagggtaagtgtcctcttttagaataaaaccttaccaaaggagagctgaaatgggttgtcccccaaggctgggagatgtgtttggttccctttgcctcacttcgacctttctgaaatcaagaaacaaacaaaatgaaatcgacttgtgaaaggatgtcaaaacgacatggcaaattcagttggtttgttcagaattttcttcctgtatttcctttttgaagttacaacagtcattcaggagcacgtccagaggagaagagctgggagggaggacgggtggcttctagagtcaaggctgggtttgcctaaccctgaccctcacgggggtgatgcggatgttccgaagaatgcattagcctttgactttaaggaccgcgaggagagttttcttccgaatcaagtgaatgcgggtgcatcaccctgtcttcctcattccctgtgtcagggaatgcatcggtagcctaaatgactttccctggaactgaagcatgtgttggctctactgtggtgctttaatgtttcctgaaatcctccatttggaggatagagtgcccaggagtgagagaatactgtgttattagaatgcttgttaagagggaaaaagaaaatagagcattaacagacaggcaatgttccattcccccgaggaagatttatgtgacctagatgaacggaactacaaatcttggagggacaagagacttcagaaatggcaagttcttagtttgggaggctaggtattgaagtttatccaaattaatttggaagtttagatcagttgcaatcaaaatccttatttgattgacagtggggatggataaaatggagtttggatttgaaaatctacataggaggaggaagtaatagtatatctattttattatacgtgtgtgtgtgtataactataacaattagaatatcataacactgttaatagaccataaagtgacaaactaccccaaaacaaatcccattttcacataaaaatttaatatatgataaaaaagccttcacaaatcaaaggggaatgaaaggcaagattattcatcagatagttaggtcttcatcttacaccggaataaattcaattgaactgaagagttaaatatgtattacaaaaaaaaaagccagcagaaaaatcaatagatcatatcaatcactcctctagaaatggacattatgaaaagtagatgtcagtatggaaaaatacttttactaccaagtgatataaaatgtggattgaagaaaaaaggtgaaatgactggcatgctttattgccagttggtttagggggtcaggtgtagatatttttgttacttgttttccaagatctgtgatgtggttggagtaattcaagagaaatgtatttataatatgcatgctttaaggtacgtctattcctacttttaaaagtggcagatttgtgttttttaatgcataaattagttgaatgttcatccatccaaagagggatttcttctgatagattggggtgattagctgaaagactcagttcctggagaagagaacactagtggaaaatgcccaactgttaggggaatgaggaacaacagtgctgttcactgcattcctaacgccggcttatcagagttttgttttctgtttcatacacttaggaaagtattgttgccacaaagtgcatctctgcctgttagaaggatccagacatagcgtagacggattgtgcaatggagtcagaaataggctgtcctgctcccagtgagtgacttccccaccccttcatcctccttgtaaatcaccggcattcctgatcactttccgtggttccagctaggttaacaacagaagggatcatttccctcataacagtctccccattagtcaaaagttttactctcaagtgactaaaacgttactcataactgcttacaaggagaaaagatttattttccttttacttctttaatgcacatctggtggagaccctgataagcagtaagaaatggaaaaagcagggacctagaaagtgaaagtagacagatttgggtagtgcatgcaggctaattaatgatcccaggtgggctggagtgttctggttacattttccatgggtccagccctagagcagagaccatgggcatcagcctgccccttcccattatgtggctcaagcaccaccgtgtgccaaagggcgggaacattagatttccccaccgctgtaacatctgtaaattccacagtccatagaatcaaaatggaagagaacctcacgtttctgattgccagtcagaaggaatttatttttgaaacccagtttgctctgttatttgtagtgcaagatagaaatatcttaaccgattttatccagttcttatttaatgtctgtgattttaggaggaagagactattgtgtcataggtatttgaaattcacaagcccctctccaacctaattttaccgaaatgtgttggtttcccctttccttaaactcacggaccacagttactaaatagtttccagagtggactgacatgcatttttctttacagctctgtcattactttctttattatcagagagtacacaggatattgaaataacctaaaatccagagaggaggaggagccaggggggtgaagagaagtcctgacctattttagagcccttgggcttcataggtaaccttgaaaatggaaacacatcattgcccattttattgaggttgtgattagcagtaaaatataatgcagactaattattatgttgcagccaattagcaataaagagaagcattttaatatacaaataattagattttaaaattttggctttgggaatttacaaagccctctatttgaaggcttgtacggaagacattctgaaaccaactttttgtcagataaagtccataaagctgaaaactgacatgaggaggtatggccgggttttcctgcgtctcacagtgcagttaggaggctttgatacttcatgggcccttctgcaaactttccttagtattaggaaatgaagtcttccaagtcagtcaagttgtaaacatgcaaaaatgctgggagtggcagtctctccaaacaaatgacccgttctcactgcggttttctcctggtgctagaacctgtaactcctgagttgattctctccaattggccagagaaatgggcgttgctgctggagcagatgaaaaggctattaaggcttcctgaagcacttagattaactagcttttttttttctcttggagcaaaaagttggaacaagttttttgttttttttttttttactttttggacatatgacaaatgtgtataaagttgtgtgttgtgcctgaggagctggtgaatggagttgctcttttgagagttgcttttatatcattgctagctgtgaggtacgtggtgggcatgaagagaaccagtgtcagtccctctgcagaagcagaggctgtgagctccactgtgagctgccaaggcccatactgctgggggatctttaatgcatggcgcaaggctcctgtgccccaatcccggaggagcggtgacagtccagggaagagaggggaccacgtgagtgttacatgttcttgatcacatttttctctattggaaaggaggatgttgaaagttaatcatgtggtttttctagtcacttaagtccttaacacactggatatacatagttcaaatacaaggaaattaacctggtttcaaatgtcttttcctcattttatggcacatggagtatagagcatattcaaaaccctcccatcccccactttgtagacaacacatctactcagaaggttttaacttaactttctgtattctggtgatgtccacgaggttttgaggccttttttttttttttttttttttttttttttttttgagagagagacagggtcttgctctgttgcccaggctggagcacggtgttgctgtcatagctcacttgcagcctctacctctagggttcaaacaatcctcctgcttcagcctcctggttaggtgggaccataggtgtgcaccactatgcctggctaatgttttttatgttttgaagagacagggtctcaccatgttgcccaggctggtcttgaactcctgggctcaagcaatcctcctgcctcggtctcccgagtagcttggactacagtgctcaataccacaccccactaatgttgcctttttttccttttttttttttttttgtagagatgagatcatattatgttgcccaggcccctctcaaactcctggcctcaagcgatcttcccaccttggcctcccaaaatgctgatattacaggcatgagccactgtgcccagtcacattttttatctgttaaaaaaaaacaaaaaccaagtttggatgttatgatgttagtagtgtgtctggttctgaagttacaggataggagatagagaaaaattgtgacctgcccaaagtctcaaagctaattctaaataactaaagttgtagaatcttttgtttggaggaccatcttaaaggtgtgatctgtactcagccatttgtctgatgtgtaaatcctcagtctgtagcttcccggccacgtggtcaccaaggctgtgcttgaacatccctgagacgcctttcaaggagcaccgttctgtctttgggcagctctaattgttaaaaaaaaaaaaaaaaaaaaaagtcttccttacgttaggctgaagtctgttccccatgtagttgttccccttggggccatgtaatacaagtctacttcctcttacaaaagacagcccttcaaatgttggacaacagcagtattcccggccctcctggctcccctcccctcatccactaccaaggaagcatggctgtgagtttgttcatcatcctttgaatgtgctccaactcatgcacagcccctttaaaaggaggtgtgcagaacctgattctcccagtggagcttaatcagtacctgtcatccccattttcccagtgacagatttttattgagacagccaacacttggattggtgttgcctttgacgaatttcaggttactgcaaagtgaatccaaataccaactattttcaaataaaagaaaggagaggcaagacttagcagcagcaggctttttacagtccttcaggtttcaattgtgggaccttacacgtggtgctattgcagctccaattttgtttttttcttttaacccatcatttcagcttgttaaactttggagattcatattctgtcattgagagttgtccttccttcctttgctgcttcagaggacttagtgatgcctttattagagcttttactacattgcattatggctctttatgtctttcctcctgagttctgctaggatcataatcatgtctcatcatattcctcttctctcttcaacactgacagctcatagtaagtgcttaatacattttcattgaatgaatgagtcaaaagtatttgctcttccaaattctgcttattgatagtttattaataattatatattattcatgctgtttcaatatttatcgtacttatttgaatatatacatttatatttatataaagtaataaatgtgggtattttattaataaataagttacttattaagtacattgaagaggacaatggctagatgctgttttgcagcccactagaaactttcccctgggccaggcgcagtggctcatgcctataatcccagcacttagggaggccaaggcagacggatcacttgcggtcaggagtttgagacccgcctgggcaacatggtaaaaccccatctctactaaaaatacaaaaattagccgggcatggtggcatgtaccagtaattccagctacttgggagggtgaggcaagagaattgcttgaacctaggaggtggaagttgcagtgagctgagatcgcaccaccacactccagcctgggtgacagagcgagaccctgtctcaaaaattaaaaaaaataaaaaaaaaaaagaaacttttccctgggatgactgttgatctgttctttgacattctttttaagataaggtttattttatcaggaatttccctaattttatagtcagttctgttacaacgctacatacagtttccttaaaatcaccatgctgttcacagtggtacaaatgaagccataagacttatgggagaaatgggattagggaccaaaaatttatcactgacagaaaaaaaaaaaacaggaacccagtaaaaacagtaacttagttttacacatgctaaatggttaagaaataaataggccgggcgcggtggcttacgcctgtaattccagcactttgggaggctgaggcaggcggatcatctgaggtcaggagtttgagaccagcttgaccaacatggagaaaccccatctctactaaaaatacaaaattatccgggcgtggtggcacatgcctgtaatcccagctacttaggagactgaggcaggagaattgcttgaacccgggaggcggaggttgaggtgagccaagatcgtgtcattgcactccagcctgagcaacaagagtgaaactctatctcaaaaaaaaaaaagaaagaaaaaaaaaagaaatgctacaataaatatggcatctaccttgtaaaaagcctgaagtttgctcatgggagctgacatgaggagggttggagccggtggttatagtggcgtggtggaaggaggattatctgaacttggaaagaaggttgtaacagcagatctgaatgtgctacactcgtagcacacacagtcagctgaggaaggcaagggatgcttgaggctgtatggttaatgtattcctgtgggctccagaatgcggctcagttttctccattcaccttgtactttttgcagacaaaattgcacctaagcaaacgttacattcacattagaataaactcacatttcaaagcaagtgtcgcagcagctcctgtttctttgttgtgttatttgcttgatcagtaaagcatcttttttgttcttatagtaattccaggcactggtatataaggatacataaattatactacccactcactctctaaaactcttgttcttaaagattggcttatttttgctaggaggaatgaaagtacatgttaaagagacatacttggctgatctagccattttccaaagtctccccccgccagaggaatatctcataagtctggttcctaattacatttagcagatttctctaaaatctaaaagctggagtttgaatggttcttacttttcagctagtatctaaaaggtgattcacttaggagcagcatagaggagaaacttgtatttcacctatcaagtttctgatttaaaagtgaaatttcagccaggcacggtggcacacacctgtaatctcagcactttgggaggcgaaggtgagtggatcacctgaggtcaggagttcaagaccagcctgaccaacatggagaaaccccatctctactaaaaatacaaaattagcctggcgtggtggcgcgtgcctgtaatcccagctactcaggagggtgaggcaggagaatagcttgaacccgggaggcagaggttgcagtgagccgagatcgcgcccttgcactccagcctgggcaacaggagcgaaactccatctcaaaaagtggaatttcacctcatatcatttacatgtgtgtgatttgatgatggctttaactgaaaatagactaatgccaatagaatcggagactcttagaactggaaaggaccacagatatcaggaagcccaaacttctctctttttcagatgaagaaaccaaggctctgcgaagtggagtgttacatgcacagtcacttagctagtggtaaagccagaacttgaatccagttaattttgaaactataatatgttgccttgcaaaattgtatcatagaaggacataaaatctgtgcatttaggaggaaatctaaactcatattatttcagctttttagtctgtttagtaagggagtttcaccaattcagttactactgataataagcttccccttgttttatttttgtttctttaagaaatctgggccggacactgtggcacacacctgtaatcccagcactttgggaggctgaggtgggcggatcacatgaggccaggagttcaagaccaacatggccaacacgatgaaaccccatctctaccaagaaatacaaaaattagccgggcgtggtgacacgcacctgtagtccaaactacttgggaggctgaggcaggagaaccacttgaacttgggaggcagaggttgcagtgagccgagattgcgccactgtactccagcctggctgacagagggagactctgtctcaaaaaaaaaaaaaaaaaaaaaaaaactagtatgacacaaactcaccaaagtggctattcctcagactctgtgctttataaattcacgtttgttagggcagacagaaaattctgtttctttgtacccaaaaagatttaagcatttgtcgtgcattgatctggggttttgagggggaaacatccttggttatgtctgtgggatttgtggtgccttctggaggattaagatgtcattgcctctagtcagggcatgctctcttttccagttggtgggtcttattttgtttacatctgcttcctcccagcactgacagatttgaaatgtgtgcctgaagtgcacctttgtgccaggcccatagttttgactggggccctcatgacccattggccatggtcactttgcctgggagcaatcatcatttctagggtataggaacttgaagcaaagaatttgctgcattttcaaaaagcaggaaggggtggttaaagtgtggatggaggggtaatctccccccacccccgccccagcccctgttttgtaagagaggctatccaactcatgtatttccagccccgagtgttggcaaaaacattttcatattgttctcacttttctgactgagtccaaaaagttcctgggaaacaggttttgtttttcctcgggggatgtttggatttgaaaacaccaaatttcaactgcaatcgtttgtccaagtgtggtgttgaaagtactgtctagatctgagtaaatcagaatctgaagaaatatagccaacgtcactcattaacaatgggttttccaagggtgagtgacatgaggccatttgtctgcggtgaggtagatgcgctcctcttttcagtggccccctgaggccaccaatgtcacgggcaagcacatcctcggtttggggccattagctgaatgccctctgtttcatcttgccttttctaggccgccctctcctgtctttaaggtcagggtttcagaatgtccttcagttctgctttagtcaggactaaaagccttccacagtgccttgacgaggaggacatataaggaagaggcacaattcaagtaaagtcagtctgtattgattttgtgaacccggggaacagtaagccagccttcagtgccgcctggctgccgggcgcatgccgttgtcagaccgatgagcgaggctccatgcagacaggtgacatattcgaggtggcaagagcagcaagagcttctagatcctgtcattttgcttctgacagtgtctttgtgtctttgtacagttggaggacctgactgacacgtgagccccccttggcagccatcatcttcagaatactgctttcctcccacgggaggagcttgtacctctctcatgtgtacagggtgcttatgtgctcatgagcaggcaaaggagcaggggacggtttcttccagatcacccttccaggtgctctggagttgatgtggcctggccaccttttcatcatcgcccctccagttccattgcagtgatgcattgcaggctctcctcaggaaaatggtgatttcagtattatattaataattagcaatttttttttttgcagttttaaaaaattgactcttaccctctgcatttgagaaaagtccttattatacgtttctgtattgtatcatctcccagtttgatgtgtatgtatcccgattgtatttcactatcattacggagatttttattgtgtcaagacaaaaccctgtttctgtctccccagccccatgtactttgagcttagtcattcgggcatcatttcttccagcattcactgctcctcagtgtttcatttccatttaatttttctatttagtttttagcagttctcgttggctaattttaaaaagatttgtactttgatttgcttataatgagtgttttaagttacctgctgactgcgcagttgtttgactttgtatcaggtttccggatttaaagccagtgttctgttgaaaatttaaatactatagaaggctgaaaatatgaatcctctgacagctcctcataacaattcccagggtagcagctgtttatattttcttatttttttctttctatgcacataaaagtgtgtttgtcctcataaagagtgttgactgctatagacggagcgtgcagaccacaggcgtatacctggaggcttctcccacctttgattattaacactgctcgcctttaacattatttgcttttgattgctctttttgttatacaaaaataaccaagctattagaatcttttatgatttaaaatagaacattagttttattgtatattgaaaatagttccttaaacttcataatggcttccaattatttcacacttgcttgcgttatatactattattttattgcagtatgatgtccaattatggaaacaactccagagagacatgatttttctggcttaacatgtaattgtttattgagtatttttctcattatgatttttttccttttgaattgcagttataaaggaacttgcttagattttgtaaattattatgtggttaaagaaatcaacgatttatcaagtgctcactctgtggaaggcatcgtgtgcagaatcgaagtaaaggcaaagattgaaagaaatcattcctcaaaaaagttgtgtgtattaaaatatgaagagcagtaaggttttttgttgttgttgttgttattttgagacagagtctcactctgtcactcaggctggagtgcggtggcacaatctcagctcgctgccacttccgcctcccggttcaagcgattctcctgcctcagcctcctgagtagctgggattacaggtggctgccaccaggctgggctgatttttgtattttcagtagagacggggtttcaccatgttggtcagactgatctcgaactccggacctcaggtgatccgcccacctcggcctcccaaagtgctgggattacaggagtgagccaccacacctggcgtaggattaagttttattgtcattcaaatatgaacatatttaatcttgtataataaaatataatttattctataagaaacataatgtgttgcttgctaataccaaggacattaagtgtagactagaagttcatcagagcagatggctagcaggggctgtgagactggataggggttaaccgtgaggctgaaagatgggattcgaaagtgcacctgtgtgggaaaggggagagcgcaggatcttggcgcactggacggtggctgaaggagagggagaggggggcaggccttgatgaggagttgggagggattctgtctgtgatgagaagccactggagagctttaaaccagcttttgtgaacacggggagtagcagtgttgttataagtagtgattattgtcagcatgatcgatttacattttaagagctcactcagggtgctggcggacagtggattctgtaaccattattttgttttaaatagcgtcacataagcaataatttacccatgaaccaccagttaatattgggggaatgaaaacaatggatgctgtgattctgagcttagatgatggggacaggacagagtgggagtggaagggggtgggtgtgattttcgtcctgttgagctggaggtaatggtaggacagccaggtagacaaggccctcaggcaacaaggccatttaggttaatttgtgtagctgcttcttgaagaagaaacaaatgaaggccgtattaccttctgccttcttttttgaaagcatctctgaagataaagttcaggtgattgcaggaaagtagaagtcattctgacatgcatttccgaagcatcaacttggttgtctgagagcatttcccttccaggattataattgtgagtggtaagcagcactagtgtattggtgacttactccagctgtatccaaggacaggtaaaacttcccactgtctctttctagaggctactttgtagcatttcagatgtgaaaggtgactccagcagagagctcatctatttattatttatttttgagacggagtctcactctgtcgcccaggctagaatgcaatggcgcaatctcagctcactgcggcctccacctcccaggtacaagtgattttgctgcctcagcctcctcagtagctgggattacaggagcccaccaccacacctggctatgttttgttttgtttttgtttttgtttttgtttttgttttgtagtagagatggggtttcgctgtattggccagctggtcttgaactcttgacctcaggtgatccgcccgcctcagcctccccaagtgctgggattacaggcgtgagccactgcgcccagcccagcgagctcatttctttattttattttattttattttatttatttttgtttttgagacagagtctcgctctgtcgcccaggctggagtgcagtggcgcgatctcggctcactgcaagctccgccttctgggttcacgccattgtcctgcctcagcgtccccagtagctgggactataggcacctgccaccacgcccagccaatttttttttttttttttttttagtagagatggggtttcaccatgttagcaaggatggtctcaatctcctgacctcgtgatccgcccgtctcagcctcccaaagtgctaggattacaggcatgagccaccgcgcctggcccagagagctcatttctaacaagctattatcaccatcctcactgctttctaaaccttataggtatgtagcttcaaagtttatatttgaacgtttttcctttattgatgacaaattaaggataatgaaatgaagtaatggcaagcgatgaaataatggcaaaagattttattttcctacaaagtatttattacatggatgttttatagaaaatcaatgtaaaggttgatagacttgtcctttaaaaaagatacatttcttcaaatatagggaacagcagaatgctccctgtcaccccctttgtaaaaacctctttcagctttgcagccatcatggctggggataagtagatttatttcttctgttcctaaagattattatagatgaaaatcatttggtgtggagattcttcatttacagctacgtaggatgtagcacttatcaaaatttctgcaaatcaaggagaatagtgttcatgaacctaccagtgagatattttaaaagaccgcgttctggaaaagtgaaggaggataaagaagcagtgttcttctgagggtgctaccaacatttgggactctcagaggccctgtagcccagtccccattccactccatgggtaacacctcatggttctttcatgggtgttcagcattctcttgaatgcttcccctaaaggcagtttgttctcctgtgaggcagcctagtccatttcacttgaaaattttcttctgcaatatgcattgtttggtcctggttctgtccatgatgccatttccaatcaatctgcttcctcttcagtgtgagaagcatcaggtccttgaaggtgctcacagttgtacttggggcaaggctctggaactcccttttctgcatggtccagtgaatctgcatagagccggactgggaacagtgcctcaaacaggagctccctgttgctggctttcgtgaatatgttgtttttgggggtagctcctaatctggtgaacatcaccactgcctcccaccaccgcatcctgtccaacctacatgtcggtagaggacccaccctaggaaggaatgaaggaaagaatttctaaggttgggtcttgggaagcagagacagagaaggatccgcagccttatggacagcctccctcagcagtggggcttgctgaggctctttaaccctcccagcagtgctgtagaacagctctgtgcaaacttgaatgtgcatggggcagggctgggcggcacggggaggggggtccgcgaatgtaccgtcctaacaagctcctggatgatgctagggttgctgggccgtggaccacactgggaatagtgaggctgtagcatacatcgaagtcatagtgtgagctggtagattgtttgggaccagaaagatcaaaacttacttagaaaaaaatgtcaaagtcctcttttccctgctcctcctcctctaacttaaagaattaagggctgtgtgatagccagaaagctactttcatggattcattttagcagcatctctggtgctcacgcataagctagtcagggagattgcagggggttggcagcacccaggtcccctgggccatagcaggttgtgtgaacagacttgaggagaagttttgtcttctgtcctcaggagtacaaacaggcatgtctgaatgctgacagagaagtcatcgccaaaggatagtagatattacccaaggcaaagcctgcttctcagtgaactgttgcctatgggacaagaatgatactgggaaaacagtgattgcttttaggatatttgataaagctctaaaggaatagaagagcttccacctacactacactccaagtgacagctgtgtgaacttggtggaaaacttgactgaggtcgctgagactgctggtggaaattaatcaccctcctgctctgcagtgatattggcaaaagatgagcttagggccagagtggtccacatgcctgggtgtctgtggtccctcccctgcagaacagaatgaaacagtcactgccataagatatcacagacacttctttctactagggtaacttggagcctttctttggctacctggaccctgatgagagggtaatctggaggaataggaagtgggcacagggatagtgcatggtacaggtgactcgggtgcggagagtatgtgtgtgtagggccagagctaagaaaaagcctaggataaactcgacagatggaaagtcttttttttttttaaacagggtctcactctgttttccatgctggagtgcagtggcattgattacagctcactgcagcctctacctcccaggctcaggtgttcctcccacctcagcctccacctcccaggctcaggtgttcctcccacctcaccctccacctcccaggctcaggtgttcctcccacctcagcctcctgagtagctgggactacaggcacacgccaccatgcccggataacttttgtatttttttgtagagacagggttttgccatgttgcctaggctggtctcaaactcctgggctcaagtgatccgcccactttggcctcccaaagtgctgggattacaggcgtgagccaccacacccgtccaacagatggaaattcctactttgcctcttggcatgcatacccagcctcttttctaaatgggtctcagtgattgtccaatgtgtgccccaaatcagatgaaatacaatcatcagatgcaaagcaggaaggtggtagatgacggacagtatgtaagtcggtctttgctgctagtggctttacttcatccttgagaaaatcatctttggtaaagtcataagtgttgaaactcgaaactagggtttaccctagacccacccattggccaaccttaatgggcacactgactttttaagagtgtgaaagttattagctaaatgacttgttccatggccccattatatcacagacatgttgatgtctctgttatcaaaagacgtgcaaaacaccccaaaatcgttgatgacattaacaggtaaaatgacaggggcgcgttgcaacacagaatgtgtgcttcagatggtgaccagggctggattagcctcatggttatggcccatttggggtgtggacatcagcttctcggatgaaggtgttagggttagcagagggcagcggtaggaaggaaggtgtcagatctataatgcaccccatctgtgagcctcgcggctttgccttccacacaatatttagtaatgtaaatactggaagcagggctgcctgtatctttattttattcaacttaatgtgaaaagcaggatggttagatactgggaagactatctttttaatttttttacaccaaacatctaaaattattcctattcagtgccttggtctcacccttgggaaaatttccaaaataagctaacattttccccattgtcttcccgcctaaggaatgtgtgctgtggcttttaggtcaatgatagccttgtccttcaatttcatctttactcagagtaggcgtgctgtgtggtgcaaatccatacatgtttgtttgaaaatccttttagaaccttgccttgttaggacctcctacacctgtgtcacagacacagaagtaccgtgtttaagtattgagcatacactagttttttgtgacagaatctcactctgttgccaaggctggagtgcagtgggacgatctcggctcactgcaacctccgcctcctggggtcaagtgattctcctgcctcagcctcctgagtagctgggattgcaggcgcgtgacaccacaccacctaatttttgttttttttttttagtagagacagagtttcaccatgttggccagggtggtcttgaactctggacctcaagtgatccactggccttggcctcccaaagttctgggattacaggtataagctgccacgcctggcctgcatacactggttttaagggtggctgtgcttgggctgtgtatgtgcgtagtacacagtgtcatgtgagcacttagttaacagccaggcaggggtggacaggccaggacagctaagaatcgcggaaggagtctgggggtagcaggaaggctgcactgggaatggaaagcaagcaggagatgatcttatccagaggaagcagctaataaatattgaggctggcaggaggatacaagcaaacaaacaaaaagtggggccgtgtctttaaaagctttctccgaaaccaatatttggagttttcctgtgttcttggaagtgactggagattgcatccttcataccttatttctcctgtcaggtctctacatatcacatcacaggattcagctgatattggcctaagacccttggggtcggtgcagtgggaacgtgttatagatataaatgccttaccgttgataactcagaataagatataggatatcatcattaagtctgattatctaagcttatctgtgagccttacagaaaacaaaaacgaaagatcaggaccacaggttctttgactaccatttccctatttttttcatttgtcctgaacagggcctaacacaaagataggcacatgaggcagggtagtacaaatgagtttttcccccgtatgaagtgacaatcacatggattatatgtgaccttgacattgttgagtttctaaagactttttaaggatgccatacccacccccaatagatcacaacctatttctctcattctaatgttggtcatttgattacatagtcctttgtggctctgtttgcttgagactgcaaaataaacaaaatgtttgcaagtccaggttgaccctaaaagctcttcattctgtaggccaaagccatgattcagagaacctgtggtctccacagtcaagattgtggttgatacaccccccttgaaggcagatgttttggttttaaggcatcaggaatgtgggcatgtgcatcaggattgatgtgttttggtgtggggtttaggagcaataaacttgaaacaagtttaagtacactcaactgcggtgtgttgcttttcctttaatccctagcagattaacccctatcagggttaatctgctcaactagatgatagccaaactagcttctctgataacagcagcctctaatccactggactccacacagctctcccagtgggctgctggtgttttggcagatgcaatggctattttttcctatttaggattttgcttttaataggaaccctgaaggccctcagaggtttgtgatacagacttcagcccacagctcagcctcccagatggtaattaatgtttacacaacatgacaagcacaaaatagaatctcttcgagccctgccaagcacccatcattccccctgatcttccactcttgcagtgtttgaaaattaatttgccttgaacaaacagtgggttttcctcaatttatttgtacagtttcagtgaccaagaagaagagctgcaagactgaatgtcatccttccattcgttcaagtaattgaatcttctaatggaacaaactggtctctgcttaatgatttgaagaaaagagggagaggaggaaaataaagtgaagtgtatgttagagaaagtggacatttttctgcaaaacatcactgaatgtagaattttggagatacaatcaaaacttagcagggggaatttaaagtattgctaaattaactcagtagggcggttggggttttaatacgtatatacaatgtgcagtctttgcttaaaaagagattttgtttgaggcaacagaatagacaggtgaaggtaattaaataatgaacattggccgggcgtggtggctcacgcctgtaatccccgcactttgggaggccgaggcgggtggatcacgaggtcaggagatcgagaccatcctggctaacacggtgaaaccccgtctctattaaaaatacaaaaaaaaaaatcagccaggcgtggtggcgggtgcctgtagtcccagctactggggaggctgaggcaagagaatggcgtgaacccaggaagcggagcttacagtgagccgagatcgcgccgctgcactccagcctgggcgacagagcgagactctgtctcaaaatagaataaaataaaataaaataaaataaaataataatgaacattgattgggcagggtggctcacacctataatcccagcactttgagaggcctaggcgggaggattgcttgagcctacacgttaaagaccagcctgtgcaacatggtgagacctcatttctacaaaatataaacaattaaccagcatggtggcacatgcctcagcctcccagctacttggagactaaggtgggaggatcatttgagtccggggagtcaaggctgcagtctgctgtgattgcaccactgcatcccagcctgggcaacagagtgagactgtgtccaaaaaaataaaataaaatagacattgctaccagcttgaggtaattgcatgttgattcacagaaatttgatatttccatatgtctctgggattgccagtgtttaaacatttcagtcccttattaatgttcgcactttaaagtctgggttaattttcttatttgactgtgatctgtagtctttctgtgtggtgtgctctttgtggctttgtcatttggacagtaacgagagaagctaactggaagatggaataataaaaataggacatgtctctttctaagtcataaggattagatattcaaaaagatacggatgaatggatgatgcatggatggatggatgttctaggagctagtgccccccacatagttttcttgatgcctttggaagcttcttcaggtttgctgcggtaatgaccttgtagttagtaagtcctgttaggagacttcgtaacagaatatgaagatgtgaagaccagaagtgcagaagctgtactttgggagagttggttttttgtgtatttttgtttttgttttgtattcctcctcctccttcatcaatattcaccctttcctttctgtccaaataatacccagttagaaccagttagaaattctgaagaacaggtggaaggtttaatatgcaccatgttctgatgtgtgcctgtagtcccatctcctcaggagactgagtggggaggatcacttcaccatgtgagtttgaggctgcaatgggctatgatcactccagcgtgggcgacagagcaagacccttttaactttttttttttttaaacacatgcaccatatttttaaaaattaaaactatgcaccatacacagagtcaaatatttatctgtcctcttggtgaagagatttttaaaaaatctattcaatagtccaggcatggtggctcacgcctgtaatcccagcactttgggaggccgaggcgggggtggatcacttgaggtcaggagttcgagaccagcctggccaacatggtgaaaccccatctctactaaaaacacaaaaattagctgggcatgatggcaggcccctgtaatcccagctactcggaaggttgtcagaagaatcagttgaacctgggaggtgaggcagaggctgcagtgagccaagattatgccactgcactccaccctgggcgacagagtgagactccatctcaaaaaaaaaattcagtaggtaaggcaatttaaaaagacttgaacgatcactttctcagttggcttattttaatggtagaggtgtattgtccgcgaaaagagttaattttaaaatatagcatctctttttttactttaacaataataatactcttatttactttaataaaaatttaataagtatactttactaattacagtaaataatactattatttaataactatatataattatttgctgtgtttaataacaaagtgaacattgactttaatttttatattgtgcttaactttccaaattttctataatattcatttgttttgcacttttcctcctcctcctcctcaattttgaaagttaaaagcacaatatgagaattaaagtcaatgtttatttctggatgatgggactgcaattaatgtttatctttccagtctcttttctgtgcatacttgtatacatttacacacgtagttttcactattgagatcacactgataatagtgcactttatttaatggcaattttgtcatgagatattttctgtgacattaaatacttcttcacaatagttttgggaatattgattgattacttacttattatgtgttgtgcattgtggaaagcactttacatggcctaatttatttccacaaccaccctaggaggttgttactgcatttgtgcagtaagtcattggacttttagaagtgtaggagttcatcagagtataccgaatctcaaccctaccagacccagcataataataagaaatattttatagcgcattcattttttactttctggaatgaaatagatacttaatgtacccatctacatacataatttaaaagtatatataaagccctaataaaatataaaggagaaataagtggaaaccaagtcatttataataacatacctttaagtatgtaagtgcttgtttatattagaagacaatgtttgactttatatctagaatggtatctaaatacttctactacaaatgcagactcacacaaatacatggtcatggagattcagatacctggagcagccttaccattgtgtcatgattttcccaaatagccatcaacccttgcatatgacccagatataacaaagtacagtccctgcattcctggaaaaatcagcgtatattaaaacccatgcaaagaattactttgtgtttatatacaaaaacagaggtggtgggttctagggttttcagctgcacaaatgtcgggtggaatttaggaagtgcattgagatgttgtcgtgtggggttgctgcgcacgttgcagcaaatcagacatccctaagagccaccagtgacctgcagtcatagtgatagccacacactcccacaaatttccatctcttcccatagggagtagtatcctccaatgggaactatctattacgtgactgacttagttcgcgcttttttgcactgaaaaacactttgaaaaaagcaattttgtgggggaagccatttctgaaggtttacaagccctgtaattttcttgttaggttcattcccaggtgttatggtttttgttattatgaagtggatcctttctaaacttcattttctgactgttgctggtgtatagaaaagctgaggttggttgtggtttttctttatttggatatctcattgcactctcttattagttctaatattttctcagctggttgcctctgttttccagctaggtaattatattttttgtaaacagtttttcctctttcttttgttgtataatatttgctgttggttttcaatttagttgacaggaataatttgtttcttaaaggtttggccaacattgtctgtgaaacagataccttttgggaggggaggtgaaggtttggattattgagtactttttccttttattttgatgatcctgttgggtttttaagtcaattttagcaatttatattttttcataaaatccattttattttcaaatttattacacattcacagattacattttcttatttttttatgcatatatacacacacacacaccccagttccctgtctatccagttctcactcctcccaagcccctaaacaggtagtcactgctgttactgttttcttgagtattcttccatggcttctttttttttttttttttttttttttggaaacagggtcttgctctgtcactcaggcttgagcgtaagtagtgcagtctcagctcactgcaccctccgcccaagtagctgggatcacaggcagacaccaccacacctggctaatttttgtatttttagcagagatggagtttcaccatgttggccaggctggtgttgaacttctgacctgaagtgatccacctgcctcggcctcccaaagtgctaggattacaggcgtgagccgctgcgcccagccacacggcttctttgtacgtaaaataagatgaatatatatattatttccctccattttccacaaaagatagtaaatgctctacgttgtacattcggcattcttttttacagctgcaaggtgttccattgtgtggatctgcaaacatacgtaaccagtctcctaatggttacatttaggtggcttccaaacttggtattcaaaccatggtactatttcattgtgtctgtagactaaatccttaacacaccacaccaagggaactccatttgttattttgctaaacctccacagaggttgtagagtttgcattctactagtaaagtacaaaaaaagggcccattttccccaggcaacttgtatcaaacctatatcaaaatgaaaccaatttttcctaatctcttaaagtttgtttattgaggtacaatttacatgcaataaactcaccctttttaccgtaaagtacgcaatgtaatttgaatttgcatgtattttagtataagcatgatgaactatttttataatcacaagaagagagagttttaaaccccaaaatgtaatgaatacaacatttaaataagactactcaatttgtacattcttatgtctttcaaattcagcaactttcattctttcctttatcctttggcaaattcagagtatgcagtgcaataccaagcgatttcttaaaatgtgttgctgccaattttggagaagtacagtaagacaaattgactgtcaagatggaaaagcttaactgggaagatacatttattgaataattgaaaggaagaggaaatgcattaccgattagccacaaaaatgcctgacgcctgtgcctcaagagactcttgtaaatggggagtcataaaactgtttcagcccccgaagttcttaccagctcaaactcatcactgctttgtttataggttgcagtaccagagcaacgatggactgattgctttcagggctggctgaagtgcagtgttacagccactctttgtagctttactaaccctctacactttaagtctgatgtacttaaatattttaactgaatcctggatttatcattacctgctttgctttgagacttctgctttttaggaggcagcatagtatagattggagaaaaggcagttggtgttggcagagttgggactggaactcaagccttctggtttacaaaacaaggacgtgacttccagcaagcaagttccttcacttctctgggcatattccctatctggtcagagagtgttagattagatcctgctactcaaaatgtgatcctcacatcagcagcctcagccttacctagaagatcctcagaaaggcagaatctagagccgcatcccagagctgtggaatctggatggggattctaatcagatgttcaggtgatttgaacatgcattaaagttaaaggagtgccgtacagatttgcagggttccctggagaggttggggtcttcccttcatctctggtagcttgttggaggtggtgctgacggccacagccttggcaccactcctcatgttctagctgtggttaggttgagattgagacagtgaggcaacagaggagacaagaaagtcaactccagtggcctttccggggccttgggaagcgagcccacgcctgcaggatgccatctgcaagcttggctgtgttatccaaattcttgaggctcgttcaagaacaaggaggtaaacagagtcaagctagatatctgtagtacttccttatgtgtctctgatgtgcctccttaccagcataagtaagtgtgaatgatatactccaagtggtgtcctttggaaaaggaagctgattttgggagggaatttgaatgtatacttaccaagatagaaagtatttattgatgtcttcaccagcccagtctggagaaaacagagtaatacaaaaagatttttttttttttttgagacggagtctcacactgtcgcctaggctggagtgcagtggtgtgatctcagctcactgcaacctctgcctcccaggttcacgccattctcctgcctcagcctcccgagtagctgggactacaggcacccgccaccacgcccggctaattttttgtgtttttagtagaggcagggtttcaccgtgttagccaggatggtctcgatctcctgacctcgtgatccgcccgccttggcctcccaaagtgctgggattacaggcgtgagccaccgcacccggcctacaaaaagatttttaaaaagtgtttctgccattgtaccaagcataaaaatcctgaattagctgtcagtgtgagaagagtcctgctcatgtacctagaacttctcactgggtgaaacccctcctctgttttgtgctgttaggatttctgggctgttcttactttctgtcccagacctgactcaaaggcctggatcatgcatatgaagcacgtgatttttcaatgcctttgataatagcttgctgtgggaaaatcctgtgaaagaaaaatatgggaaattttgtgaagacacatggagagacacagagctggatccctaactgtgacatctctgaataaagggccttccttcctcattggatccaggagctttgctagctggatggggacctatccgcagcaagggcttggggtgcccctttagccctgaagttaggaacaaaggttttgagaagcctttcaatttcagctttatcctaagcaaaaatcttcccagaaaggttgataagacagcactggacagaaatgtcggaagtccagagttacttttcatcagcgctttgccaagtgctcggtcttttcatacctctgaagcatgtgaagaaggcagctttcttcccatctcgctggtgttattgttccaggctgtttggagagacctgaagatagccaagttctgttagccaaaaatttgctttgtttataaacccaagttttgtttttgcttttgtgcatgttatcggtttgatctgtgttaccaaaagaacattgaaaataatgaattgctttgatgagaattccaaggaataatggcaaacaagtgtgtatatacaacagtacgtaaacagaaatatgtaagccgggcacagtgcaggcacctctaatcctggctacccaggaggctgaggcaggaggatcacttgagcccaggagttggagctgtagtgtgctgtgattacacctgtgaatatccagtacagtccagcctaaacaacctggggagaccccacctctaaaacaaaaaacagaaaaccccagaaatacatagaaccaacaagaataccacatacttttcccgtttgatacaatgaggtaagaggagaaagttaacgcccagggcagttcatttaagaatgcctgaaaaacaccttcatttcaaaggatgttgtcatctattctttttctcttttgaaattgtgtagtaataaaaggatgcatcttttcagcacaaaaatatgggaaggataattttcccccagttgtatacaaaagtacttactcccaaatggggccattcttttctattgagtgccctactggtctttcgttattctgttttgagatttttatggagtttggcttatggggtaatcaagccattctactaaatgtggcccttttgacctttggagggagatcttttgacctttggagggagtacatcttttacatccatacaggagcagctattttctatatttctttcacgattgtagaatttcacttaaatttaatatccaaggttagtctcaatgtccagcacccctttaacttggttgagtggggaaccccatgtggtcccaggggactttcttaaaagctctagcaagtgtagttgatgggaaactttatttcagttcccgtttgcacctttgatctcagaagttgctgggatcaggtgacgggcattaagagacctgccttttcacttggaagttgagcacttgctgaacaaaaaattatctgtaaatgtcaagtgtgtccctttggtcaaaatggaaagtggggaggaagggaaggccaagaaaaaacatccgtgtgatgttaaataatgtttgactcatttcaatagaaaacacttctcttttgtatgttcaacaaatgtatttgttttaaaagggaaaaatcaacttgtcaactattgtttcttaattgtgatgccataaaagactttctggagattaaggaaaacattcattttcagaatgtagtctaggctgctgttttttctcatacagagacagagtctcgctacgttgcccagggtgctcttgaactcctgggctcaagcgatccttctacctcagcctcccgagtagcttggactgtagtacacaccaccacacctggctaatttttttttttgtagagtcagggtcttgctatgttgcccaggctggtctcgaactcctgggctcaagcaatccttccaactcggcctctcaaagtgttgagattacaggtgtgagcccctatgcctggcgctaggctactttcttgaatgcagtctcctctggccagttggcctttctctcccttcccacacccccagggtcattgctccccatggtcaaaggctgttcctgcatctttctctgtccaccattgaccccatttgctgtgggcgcatacccccgcaggtggtggagacaaggacccaagccaggagggttggtgccaggtcctgttgctggagttgtgtgatagccttggagtttcctttccctccttatgccacactcgcatgtcattgcctgtggttttgtctttgctctctcccatgcagatccggagttaggtgttggcacgctaccagaacatgacagccaggatgcagggccgattgtccccaagatatcgggtctagagagaagccaggagaagagccaggactgttgcaaagagccaatctttgagcctgtggtgcttaaagacccctgccctcaggtcgcacagccaataccccagccgcagacggagccccaactccgagctccttctccggaccctgacttggtgcagcgcacagaggccccacctcaacccccacctctgagtacacagccaccacagggccctcctgaggcccagctccagcctgccccgcagcctcaggtgcagaggccacccaggccacagtcccccacccagctgctccatcagaacctcccacctgtgcaggcccacccctctgctcagagcctctcccagccattgtcagcctacaacagcagtagcttaagcctcaacagtttaaggtgagtggcctgctcttctttggcctgacttttgccctctccctggggatcaggtgggtgggagtcggggagggatccctagggagactgaggtttccttgttggaaacatcatccttttctctgagactagagacagggaatggggctgttgggtgagactcgggtctcttgggaaaggacaggttgggatgggtgggtggtgaggacattgtaaagaagtaaaatatttatgggcactcgagagtggaggcggaaggagaggaaggcttggaaagccctgggccagggagacccagcagcagtgggaggcagggagtcgaagcctggggcatatcagaggccatgcagtgtgagcagatcctttcaagagaggctctctgcctctgatggaagaagtgttaaagaaaactcgtctccctgcagctccaaaggcaggaagattgggacctgatgagtattccagcttaaggattttttttttcattctgatttacttcctcctatgtgggtcagagaagtagggaagaaacaaaacaagctgcatttagagaaagtgagaaatttctttatggaaatccaggctctctcctctgtcttgtttttgccaagttacaaagaagcgtctaaaaagcagcacagaggaacacagcaaagaaaagagaggcagaaacccagtgtgcagcgccaagtagagccgagccctggtgccccgggggctataattctaacccggcacagctcctgaggctgtgtgtctttgttactgtttttcttttgaaaacctggtggctttggtggttccgggccttgctttttcctaagaggggaaagcacagtctttggggggcaggtttcctccttccccaaggagccgggcccggcttctgccccctcggccgtttctgtggcctccagaccataaagtgatgtgagaacccaggcacctgggtttcacctcttctttgtgtgtcttcatttaagaggtaacaagacagatggggggaactcagatcatcgctttttttattcctttttgttaaccgttgctttataggagatgtagctagtggaggatggaaggctggggattttctaggggcattgatgagaatctggccacaggagcgagagaggccctgaggtttaggcagaatgagctgtctcgacaccaagatgccccacagccctgaagcagcagtttcggtttgctctgtctgcagtagcgatgggaaagtttgcaggagttgtgatttcagaaagtgtgctcgtacagggaggatctgtaaagaggaaggggcaagagagactgtggtgagggtttaggggaaggaggtaggattcttttaaagagaatacattgcttacctttttttatttttttcttttcttttttttcttgttccgatagcagcagcagaagcagcactccagcgaagactcagcccgccccacctcacatctcccaccacccctctgcctccccgttccccctctccctgcccaaccacagccccctgcacagcttcacacccaccctccagccccccgcacactcacatcaccccaatatgtttgcccctcccactgctctgcctcctccaccaccactgacatcaggaagtctgcaggtggccggacacccggccgggagcacttactcaggtaggacggaggggcctgtgctcgtgaccccgacccccaccgcccctcgctgtgacctcaccctacctatgttgtcccgattgcaaggttgcatttgcctacaattttttccttccttactgtgatcttcctcaaacgctctctggcctgaggtccagcaaaaatacctgtcagcacccatactaagctagctcagcccctgtgaatcagacactgcccgaagagagtgggtttgtttggagttaggaggcatttccagctaaattcagccactgagtggtcagacccaggtagtgtgtcccgtgtcgtctgggctcccctgagggcgatggaagcgtccccaagcccatgtctgtctcgctccaggatcttagattgtgtcctggtttaaggggtttcttttcattgggcagggcagggccttctcctgtctccttgggaggagatgacacactctttgtgacaatatatcccagaattttaagggcagatctcatgttagacacagggtccttgtctcctcacctgtgttaatcaggtcaagcgtcccagttttggtccagtgtagccatgttatgccgccaatacagagagccatatagcagtaattgacacttgaagaggacatgcgagccctgccgtgtgaacagctgacatttattagtgtgctatcactgttcccaagcacttaaacgtgcaaattgctttaaccctcaaaaatcaaacccatgagttaggcaatattattgtccccctcttggagatgggaaaactggccctcagatgggttatttgccatgcccagggtcactcagccagtggtgacagctggaaatcggactttggcatttggcctggagtttgttccccagattgatagactgcctgtccctgaaagctgggagaccagctagagaacagggagacagggtgcgaccgggccttggtctcgtctgcttcattgattgcccccgtttatctcagggcccagccacaccctgtcacccctgccactgtgtcaccagccccgtacccctccacaggaaggcagtccgatgtccttttctgaaggaaaaggcgtcatcgtctccctcttcttctcttccagagcaagacatcttgcgacaggaactgaacactcgttttttggcctctcagagtgctgaccgcggggcttccctgggccctccgccctacctgcggaccgagttccatcagcaccagcaccagcaccagcacacccaccagcacacgcaccagcacaccttcacgccgttcccccacgccatcccacccaccgccatcatgccgacgccagcacctcccatggtgcgtaccccaggcagaaatgtgaggataagtagagcacgactcttttctttatgcagcacgtgggaccgggctgggcagcggggccaccagagatcgaatggggactgacggctgttggctggagagaagggaatgtgtcctagtgccctgcctcaggcagctctgacttcaggggcctaaagtaggaacttctttctaggcagttgtatccagcactgcgggcggaaatgattccatctgccctcaaaacagtcatgtccagtgttgatggctaacttcttaaagggttgtttagttttcttgaacttcccgggggactgtcaccaggcagaaaatgcacctgcttgtgctttgcatcaagtgctagcacatacattcttgcagggtaatgggggtgaagaagagagaagagaagggagagagacctctgccaggaggctgggactgcattgggtgccacctgtgcattccgatggcttccctaaacccactttgttggaggtgttatatttcttgtgtttcataagacagtccctaatctggtattgtgctctgtcagccagtgttcagggatccccgcagggacagaacgctctgccttggggcaagaggaaccactggccatgacatggtcttgctttaactgggggctagcacatgtccagaaccagtgaggaatttttttttaagttaataacgataattcatagtgccatattagaatgctaaatattctcagatagagtcctgtctaacagtgagtattagagtcattttttacttatttaatttttaatatttcaggaaatactggattttaaggccattactataggcattgtgagaataaattgcatgattttaaaaggagtccacttcacccaactttgcttcctctccttcctctccctccccccatcttgtttaacttactttttaaaaatgtgtttttaaagtttgttttataaatttcatttcaaggaatattagcaatgaggccttgtgaccagaaatatgttcttaatagcaaatcctgtatctcttttttggatgaattatacttaacaattagattttgaagatcctaagattttgagaaagttttctgctggcctgtgtgagctgtttcacaaataaatttaaccaaaggtagttatagcatcaatatgatgacattatttagagggaacaatagtatactctttttctgttccaatgaaaggctgtctggcctaccccagatcactttgtatttgggtataatacatttcagaagacagctgcatggcaagacagtttttctgccaaagtgaagatgaaaatagggggaattcactgggtaaatcagaccaaatgctcacctctctctgatttatctggataattggctgttctctcctgtttagaggtttggttcgtgccaatctgtagaaagaaaatagtaggaagaaaggcatcctagtacgtgcagaactaaaacgtaccacttggtttttaattttgttcttccatttctgttggcttcttgtcagggagactcaggagctcagaatggtttcatatgtaatgaggttatggggtctcatgacagcttaatgacagggaagctttgtagggccacctccactgtagcagtgaacaaaaatgcagattaagtaactagcttttgctttgatccctttacagtttgacaaataccctacaaaagttgacccattctaccggcacagtgtgagtttcattaccatgctacacattgaatgtaactgctttgccatttttgtgctcttgccacagatcagtcaatgactagcagccttccttaatcatctttgcaagagttcccattgctcctcgccactttggatgcttgcttttgtggtgttttgcttttggtaaagatgcagtatcatcttctgaatcaaaagatcataagcattccaaaggcttgaaagcagagttgctctttagtggcagtcaggcatctgtcctgcaaagtgagatgtctgcaatggagtcagtagagttccaggagagtctgaaatcacagcatttcagtcgtcagttgaaatgccactaacacagaagttctggaatgcaacctgaattatttcctcttaaatagaaagtcccttgtctttttgactcatgactcttcaacaagtagattttcatttgctctagactaaatgtagaaccttcttccacatggctggtattgttctgttgagtttgttacaatagaaagtaaaaatatcacttaattaaaagaaactcccaaaattgaaatgagtgatattttctctttaaactcattctcctttatttaaaaaaaataaaaaaaacttgttttatgccattttaagagtatgttctggaacttcaattgataacaccctaagttataggttcagttaacttgtaagacaagagcttatttttattcaaagaccttgaatatttccatgatattttgatgatggggtgaatactgcatcatttttatctgaaaatttgcaagtttctttgccagtgatttcttttttttttttttttaatgaaaccagaaaaaagagaaggttaatcatgcttgtagccgtgttgattcaccatactcaactgttcttgcttaggtttgtagatagtgttatcatttgagaagtgctactttaatagatcagcaaagactgaattcattcatattctgaaccagataattagataccatgttagtcaagaggttagctgagaagtcaaggctagaaaatattagaaatcaattgaaaattatgtactctaggggcatttagaaataacgtaagatgaaagacctcttcaaaaagaagttagaaaagtgtatttgagtgatgcctcctccccctccctcccaacatggtccccgctgttctgctcagtaccagaatacaaaaacatatttcacggggacacccaaagcccagtagacctatgggtttcctctttgggtctggcccatggatgccaccattctgcccttagtctatactctgctgatttaaagtaaggaccagctaacaaaataattcaggctgggtgcagtggctcatgcctgtaatcccagcactttgggaggccgaggcaggcggatcacaaggtcaggagacggagaccatcctggctaacacggtgaaaccccgtctctactaaaaatacaaaacattagccgggcgtggtggcgggcacctgtagtcccagctactcgggaggctgaggcaggagaatggcgtgaacccgggaggcggagcttgcagtgatctgagacggctccactgcactcctgcctgggcgactgagcaagactccatttcaaaaaataataataattaatatagaaagttgagcacccaaaaagtggctcagatttactttctaggacccactgcggtgccttctgatacgcatattctacagtcctaggccaaagatggagaataagcctggaggcctgaatttttggaaggtgtatgtattattacttaggcgcttcaggtttttagtcagggggaggaatagtcagctatatttatattctaagaggtcaatgatggaataaagcaaaaagaaagtggtaagaacatccagtttttaaattgtaaacattaaagggaaaagcccacctggaggcagaatactagaaatttgagtgtgtttcactggggcatgtatttaattactcagctttattcagtgtactgtgggagagttatttcatattaggagttatagtggataatatatgaagtactcagtctcccctgctttggggattaggacattataaggggaattaagatgcaatgcactcaagtatctaaaacacaattttagacttaaaagtagttttaaatgagggcacttggcttgcaatcactgtttaagtggatttagttcaatatcaattagtctgaaaaactttgctgcatcattgaagggagcaaaatgaaataaagaccaacagaaaaaggacgtgctctgaacacgggattgcgaaatgtgaatttcagtcattaccaaaaataactaacacaaatactttattaagacgagcttcaattattgttgtaattttgacataataaaccaccacgaaggtggggcattatttaaaatatttgtatggtggcttgataaatggaaacaaaccaataggacctcaaaaagattaaatttttagaaggagggaaagttgtgtttgcattgtcttcagattctctgtatttttttcctcaattgtgtccttttataggctgttgattcaggaaaattcatagtcttcattcagaatcattcttttaccatcatagagtggactcctacgtgaagggcttggcttgagtatcctccaaagagcttgttcatttaatagcagataccattcagaagtggccataaaaactcagacttcatatgttaatacggaagtgctttgagtacctgagacttaaacaagagcaactgaaagctcgatagtgatattccagactcgggttatttctgtgcaactagaatccatcttctagacaaattggcagctccatttaaagtatacatcgagtcgttttattttaccctttcacaaatatttgtcattattttagatgagagaattaaattgtcctctggaactgccacttctgcaacaacctaatgaagcaaggattgtgaatatactctcatttcctcaaactattaaaagtctgaaagtactaattgagttttaatggtataaaatcctggcactcatgaagacttctttttcttccccctttttttttcttttttctgtctttttccccctctaattaacttgtaattttctgggcatcttatttggctcaggatccctcctgtttttgaaatgcattaaaatctccaatcatttaggacttctatctgatttaacaattaataattagaaaagctccctttctaatgatgccctcacccgggatgtcatttgctggctgattgatcctgaactacttttaactttttaagttacacattcgtggcacgtctgtgtgatcattccatcatggcttcttgactaatggcatcaaactgagattacgtggcttgctcatgtcgatgtctttctatgggacgggaatttgaatatgtcacttgcctcctactaaaatcttttttccccctctccgtctttggccacagctcttccattcctatcctcctgcagtgtcgggcatcccccctatgatcccacccactggcccttttggttcactacaaggagcatttcagccgaaggtaagaaacctcacagtgaaaacacacaggcatgtgtctaagtggcgtcccgggccaggcgtgcaggaagttctgcgtcctcttgcctgtgcagtgactcattaatcaggtcctaagtgaccactgggattagagtgagcctatttttcttttttttccaagtccatctagttttaaatggccgtgaaaatttacttttcaaactgtactacccagataatctcagttaagctaagatttcttgtgctcttcaaaatatacacaatatttatttttttactaccaatatcgtggacataacttctggtcaggaattctatgaaatatcagacacatgtgcgccaggttgttccgcaggtgtatgtaattagtaaagacacaaagctgggtccttactgattttagtagaagtggggataaaggttccacaactaaaattgtatcctatgaattctcattctccctcatttccctcgccaaccccatcggctgcaaacagggcctgccggcaggtggggtggtcgcctcccattttggtcctcctttctttctccctctctctcagccatcccacccctgccatggttacactggccaaggccaagactttgtcatcagttactaacatcctagtgtgaaattaacctttcatcctttataaaaatcaaattctgttctacctagtcagtgataatgccgtccagcgttggctacagctgtctctaaaggtcaatattgaagagtcattctcgaaacactctctttttaaatatacttacaatttctattttaccttcacacaaaaataaaaagagccgtactttcatgtgggtaaccattctcagacttgaagatattctgctgtgtgccattgggttttcgtttttcttttccccaccatctcatggctaaggtaaaacacagttttggtccagagtcttccaggataagcacataactgcatttccaaagacgtgtttcattaaaagaattaaaaggcattagaggtggggtcccctcccccttcaaaatcacctgcattgaattgcattgaattcagttcatctattgaatttgcctgcattgaattgcagcctatatgcaaggttacagatatacagggcttttatgactgcctcgttaaacacctcctgtctggagataaaatgatggtgattttaaactccttcccccagtctgcacctcactactccctcagaccctggtctgtcccctctaggttacaccaaatctctggggcctccccaaacagactggtaggtcatttaataaattagactatttccctcgctcacaattatccaatcacacagaaaactacatctgggcaagaaagtgtctctcctggtgttgaaataggcctttccaggccatcgtcctgattgaatatgtagattgcagttcattagtggagttcttcatatgtatgcaaatcaggttgttaacaactccagcttaattgttagttgtactgcagctgattgcttttctttctttcattcttttcccccccttctccttgtaggcaagcttcgggcctaaacttgagctccttttccccacgagtttaacttcctggtgtggggggtgttcatagaagttgtgatttcttccataaaatagctggtgtcgtgtcctgaatcctttcccactagaaatagtgattgtgcccaaagtaggctttttattgttgctaattcaaaggacagaagctcacagataaggttaatattagcaatatttgagaatggtggtgggaataggtaagagcaagcagaattgctttagaaatcatcaaagagcagatccgcaaggtccctaaattaggttctcttgtcccatttccaccactgctaatgagtaattactgagtataattccttattattgtctaccagttaaaacggagagcttaatgtctgtaaagtacttccagttattctgatgagaaacacctgatactgccaattataataatgttcacttaagcgtttcttggaatgtttggtgattaagcaaaaaaacagtggcagtccctgccatgggttcattcagaggaagaggagttccaggacagcatttacgtttgttgcttctcttttttggtcctgtgctttttattgcagtgaaatgttctggggacctctctctgcttttacatgccattgctggagagagcaagctgtggtcaggcccccttgagaaagagcatgtgtggtccctgagaaaaatgaatcttgcgtttcagaaggaaacaaacaaatgaagtttggcttctctcatttagcagaagggaaggatcttgctttcatgtcacctgttttgtgcttcctaagtaagctgtggtctaattaatttgtagacatccaaccctatcgatgtcgctgctcggcctgggacagtcccacacactttactccaaaaggacccgagggtacgtgcaaagtcaggcttggtctcaggtaacaccagggtgtgtgtgtttgcacgggacggccagcccagtgctcgcatcttccttagctcctttgagcgagctgctgtttcagctgttcttctagtttgtggaagaaaatgccaattactcttagaaaacacagtctctcctgctcactgcgagcataggacacaaagagaccgacttgccgatgggagaaaagaggaatgagttacggtctgagcccagaaattggacagtgtcagcttgtatagtttttacttaaccaatcttctctgtctgtatctccttaaattgtcttacacaaatgaagtagctacagaatgttttgaatggaaaagcactaaggcgcttttcttcctggaagtcaggctacacacatccccccgcttgcctggggtcaggaagttattgtactgcacggctctttggccctctatttttaatgtgctagggatccttttgtactctagagctaaataaaatatccattatgctttggttatgttgtttattcataatttattaccactgcctgcttccaaaaaaggaatctgaagttatacgatagatacaatcttgcctcattgttatttgtagtcatctttatacgaaatatgaaaaaatctttaacaatattgtctttttacctacataagggcagtcagaaattgataaccagagttagatagaagtttaaaatgactcaactatgtaagtatgtcatgatgtatagtgaacttctggaaaatgtctaatagctataaataatgtaaagtcatcaatgtaagggtattggtaaagagagcctaattctcctggatggatggaaaggacacctctccccagataccagttagtagacagctttaaaagccaggggtctgaaggccattctccctcagacctacccggtgtggtttggagctcaaaacagtgaaactcctggtgtgtgatgtgagcaaatcatgttgccagagggcacattgctattgattaaacttgtacaggggcttgtcagcgtagatgtaccaaggcttgtgaagtgggggaggggacacttggcacttttgatagtgtgaaaatgggttaattattctctaaaagggcttcatttaaaagtaaaattctaacattttaatttcccctcctaatgaagcactacaaatttgttaattagagcaattgtttgagtgacaggcatgtaaccaagttgtcattttctcttcacagttgacagatcctttcagacctatgttaagggtaagaaagcttcttatagaactgttttgcaacctctatttgactccctgtgggttaaaaatacaagtctattacaaggaaataagccatagaaatgttggaataagacattggaatgacggtgattgggtttttcagatagtgtgattgaaaatggcctaaactgttttgctttgaccgttggaggccattggctttttttttttatctctacaacagagaaaagtcaacgagtccgatctcttgttagcagttctggtaaaaggtttgactagttggaacttaaggggaaagactgaagctataggctgaagttagtctctcttgcacttagaaaatatgtagctgggtccatttattttggctggtggctccctctttctgtagtaagtgacattgacttgccatagccgtttgacctccttttaaggtgcaggaaggaggtactataagcatctggtttgttaacatcttgcttaaagcaaattgttctcgaggtctggagactggccagtgtgatgacctctaaatgaatcctggtggttgggggtaagacagacatgatgaattgttggacagaagatggatggacagcagatttcttgctatgcataactcatttctagggcacataatcagataatttgatttctccaggggaaaaaggagaattgtgtcatcacttaggtgaggcagtatattatttgtgatttcaaactacccataatttcattgcaagagaagagaactgacccagacttgcatttaagtatatattttcggaactaactccatactgtagaaaccagaagcttctgttcttcgccgatgtagaatgaggctgtgttttcttctcatctgtccagtagtcactgagcgcgcacgccgagcttatgggtagattacttagcagaaatgaagtgaaaaggtggtccctgcccgctgactggtagaagagaatacactcacagcactccactccttataaagcaagacatgaaataattggggagatgtggattcaaattcaaccccagagggtggaggatggacttgagatctgcagaggcctagatagagaacaggaaggaaggaatattcttctctttgtttctttctttaaacttaggaacagcgcccaccaacacgaatgggtagttgactcttagcatttacggtaactgggcttcaatcaaaatgtgaatttctttgtaccactttgggggttaaaataaaaaccaccacggtcttgggggaggttaggacaggttctgtaccctctcttattttgatttgactcacagacattcactaatgagctcttctgaacagctgatttgcattatagcatggcaacatttgttaagtagggcttcccactctaccaggtctgccagctggcagcagaaaagaaagagaagaggcacagagtgggattcaggcttttgccgtcttgtccttggtaaccggggaggcccttgtcaatgtggttttctgagtagcaaacccacgtggggagagagggggagctggctgtgactcccttatgactgggcgctggagagctactgatggaaggcacttggagagtacaaagcactcttgtttcacgaaaaaagcctctgcagccaaaatctgctgaaagctttggggaaattgaaggtggttttctctgaaatgtcttcctcctaaccacgttgctctttcttgttccagaaaccagggaagtggtgtgctatgcatgttcacatcgcctggcagatttaccaccaccaacagaaagtcaaggtcagtccgaccttcgtggtgtagggaagaatgggatgcacatgtgagtgtgtgacgtgctcgggagaacctgatgaaggaggcatttaaaacacattttacagacccatagttaggaaggatcaagcctctcttggaaaagctactcagaagtcttacttattttttcctagagtcagggtctcactctgttgcccaggctggagtacaaggggacaatcatagctcaccacagccttgaattcctgggctcatgtgatcctcccacctcagtctcccaagcagctgggactttaggcatataccaccatacttggctaatttcttgattgttgtttttgtagagatagataggggtctcactgtgttgcccaggctggtctcagactcctggccccaagcagttctcccacctgagcctcccaagtagctgggattacagtgcaagtcacagcagccagctcagaaatcttactgttaattagggaaaccactagtgaaattacaaaacaaaagcaaactgataatgccccagggttttgttccctttataattttgtcattttattgatccaaaggtcttgaatatggattaaatgctaaaataaagcttttggaaataaaattatagtgaccaagaattagaatacagaaaatactctgcatctgggaagagctacaaatgaatgttgggtttgggtttttgtaaaaatagtgactggtgcattcttttcattttatggctgtgggaaaatggtagagtcatgtgtgccctatatgaagatgatgccgctgaactgtcattggtcctcctgatggtcagtgccagggattggaatacagtcagtacttgcaggagccacgttctggctagttacctcgctgtccaaagacgatttttcctttttgtctatattttcatcatagggatgaacatattccatgttctgctagagcctttatgactcagtaggggagagatcaagaacttctgcaagtccctggatacagcatcagcgcttggcttagggaacaaagtaactgacaagtctgtattttacagtctgggtatttataggctatgttacgatgcctgcaaaaatgggagcaaacaagcaatcaagtaactccaataagcttcacttaatccatttcttcatgaacaagcttttagtcctaacagcatttgggagttctcatgaaagaaatacaggagaccaatgagccaggagatagatagagctcttcatcacagaagagacatgtttttaaaagggttacgtgatttttaaaataaaacaacccaagttccagtcactctagaggctgaggcaggagaaccccttgagcctgggagtttgagtccagcctgggcaacatagcaagatctcatctctaaaaaaaaaaaaagagtaaaaaataaaaacccggttaaaagttttaagatgcaaacctcagtaaatgaggtcactaagatattttgctttggttgtcagatacctgctctttcttataacatgccatcagtgagtttggctcatttgtactttattgttaggggaagtttaattggaagccttgtggtctatcttagaaaatgtgtgtgctttgaagagctaactagattttgatgattagttcaattcagtttttgttctggttgatgtggttagtggaacggtaggtaaagcacatcttccttgtaacttctttggttaaaagagatgagggatgttgcacgtgccactttagcaacttctttcccataaaagtgtccccagtgacttaaactttcattatcccaattcaattagaaagacctcttgaacatgagataacttcgttcatcttcccttttcagcaaactgcttgtaatccccaagctccattttgcttcatggccctaagttgtggttaatggaactgtgctatgtaccatgcaatattagcactaaataatttggccaccaaattaaaggaggtattcaaaagaattttatagattcatagtgaattagaagcttggttttgaggcttggctattactcgatactgggactttcattatagcattccctgtagatttgagcagaaattacatcttccctctctctgtaacgttcatttacgcattcttttagtcgttcacccagtgtttattgaaagagcctacgcctgcaggttccttactgtggcgggctgggggcatgcatccttcctggcgtctagttgcttagagttcagtaatgaggatcagttgtgtgtaaaaagtgaggaaagtgtgtgtgccctcttaatgggtggtgtcatttccagctggaggtgcacgggtagcttttgctttcagtaggggtgatgggtgagtgggacgttgccgtcagcagtaagagaacagcagacttccctgtctcagatcctcacgccatgctctgtcaatatagatgccccctcatggggctttgctgttgtacagcagggcaaggatccctcaggacatgagggagattgagctgaggctagaatggggctaaaggggctgagagcatcagatgagtccgggagatcagaagagtagccaggcacgatggctcactcctctaatccaagcactttgggaagccaaggcaagcactttgggatcgcttgagcccaggagttcaagaccagcctgggcaacatagagagagagacctgtctctaccaaaatgaaaaaacattagctgggcatggtgacatggatctgtagtcccagctactcaggagactaaggcaagaggatgcagtgaactatgattgtgccactgcatttcagtctgggcaaaagagcgagaccctatctatctcatctctttaaaaaaaaaaaaaaagagtgaaagtcagaagcaggtactaagggcagtgaaaacccaggagactgatggggaagaggtcatagcaagggaaattcaactagaagcttcaagtcccaggaccccatgccttgggagcagtgcttatccaaggcagtgtgaagccagttcaaagagaaagctgtcaagaaacaaggaggtggggcagctttgaaaccatgctggtgcaagggcctccagcctagagaaggatgccaggggaaaagattgagaggaagattaagacccaatttctactgcctaagaggatggtaggcggaaagattagcctgaggatagataaataagacaaaacagagtgatttctgtccatgataaggacttcacacaagagtttgttttttttttttggagacagcctcggtcacagcaacctccgcctcctaggttcaagcaattctcgtgcctcagcctccccagtagctgggacgacaggcgtgcaccaccacgcctggctgatcttttgtattttagtagagacagggtttcaccatgttgcccaggctgcccttcaactcctgagctcaggcagtccgcccgccttggcctcccaaagcgctgggattatggtttacttgtctggatggacactgccctcccccaaccttcctcaggtaattacaggtagtaggaagagaaagggcctctgttagttaaattaatactcctactttgtttttctttgttattgttatataacagtgatcatttgaaagttagcttatagacatgcaaatatttcttcataacttttggttactaatgtactgtgagctattagagtatggcaaagagtcattaaacaaacaattaatttatacagcagattgttcatgcagaattcctaataaaatgagctttaagacactattattttaaaccttactaaaatgggcctttacagcaaaacactgaactactttgggagtggtggcagtctccataaataggatatggttttatttctcaagccattaaccttgaagaccaaacatagctgggtgcggtggctcacacctgtaatcctagcactttgggagaccgagatgggcggatcacttgaggtcaggagtttgagaccagcctggccaacatggtgaaaccccatatcgacaaaaaatacaaaaattaactgagcattctgggaggcacctgtaatcccagctacttgggaggctgaggcaggagaagcatttgaacccaggaggtggaggttgtagtgagccgagatcccaccactgcactccagcctggaaagcagagtgagggagactccgtcacaaaaaaaaaaaaaaaaaaaaccagaccaaacactagtgttgtcactagacatttctggtgtaacaggcactaccggcctgcagatctgacatttgagggtgaaatggtttttgtgtagctgctttctctcacagtgtttgtaaacttgaacccaagtgcaccgttcacagtctccagctccagctcttcactaacacctttattccttgctgttggccttgggacccttactgttccccttgctgtgtagaaacagatgcagtcagacccacataagctggactttggactgaaacctgagttcctgagccgccctccaggccccagtctttttggagccatccaccacccccatgacctggcacggccttcaactttgttctctgccgctggtgagtgtgggtttgggtggggggacagagctgagaaatgtagttctcaggtaactaaataaatgaggtttgggctctgagctgccgctcagtcaccacctacaaaaatacagttaatgccagcttgcaaggcaacatcgcagcacatccagggagttgggaatcttcattgatacactctctttcattaaaggaggaggcagagatcatctttcccttacagggattcacattgcttcggttcattatttgcttctatattaaaccagtataactcacaagcatgtcagttgctattgagaaagatctgaaggcttgcaagggcagatcggaaggaaacaatgccaggaattatagaaggatgcggtcgcccttaatacggtgcccgcagagcactgtaattttgcaccgggatgctcagtcatgccgtgttttaaagtcctgaggataaagaaaggcgattaaggcagttgccaggagtatggtctgtgatagggaggttgggccactcggttgctggttttctctgctacaaaacgtaatactattgcctggttggttatagcggtggaagaaatttaggaaacggtgtaaacacccaagtgacctgctcatcggatctgtaattcatttaacctctgagaatacacactgtcaagtgtgcgtgtggaaggggtgaggtagagagtgacgattatgctcattcctgctccaggtacaaacaaaagacagcggctgtaaggactgtgtgtgtgctggatgagaacagccctcttggtattaagggtttcttgtcattctgtcttctctaaagcttttttaagtgtaatttctggcacacagagctcagctcagttaacacttaaaaatgatggcactgagctcattctgctaataacttcatacccactatgctaagtagaatttattcttctggacgtaagcagtcaaggggctccccatttctgatccttacgagacaagtcttacagccatcctgccagctgccaccccaggcttttatccaagactcactgttggtggacctctggctcttctgttcaggaagagagaagcacccacactgcaagaaatcatcattataatgggccttagctaccaaagcaagtgcgtccccctggagggtagatggaatttgctaaggtctcaggtttttctctgtcagtgctgtctggggacatatttgaaggctctgttaccatggcacctaggctctgagacagggctacatgaagagcaatttttggaaagaatagatttctctctggcttccatttgagccaagtggatgaattggcttcttttgcttcaataattctggaactgcaaggcacccctgggggccctgggctcagcaaagctctggtcttcattgaagcattaattagcttgcactacacagacagtatgtggccaaaattttatttagctgacaacactgctaacggcctgatgaatattctggaatatattcacttggtggaggcggggtatcatttttacacttcccaggtggaaaataagccagtatgcagggctgaatagataactcctcaggtgtcttccaattccgaactactgtgacggggatgatgttcctcctgtactgagtggcttcctctccaaacccaggccacaagacttttgcagcccagggaacagcagtccaaaacataaatcgagttaacagagtgtagacagcaacaacccctacgtttaatccattttcctaagggaatttatatttgtttataggaacttagacaaaatgcaaaggattatggaacagtttttagtaaattctttatccaggccttgtttatacttccattctagaatgtaaccttctttagcataagcagtatgggattctgcccaaaatagttatttggtgaaccttgtaactgatgtgtataacttgtacatacttaagaaatccagccattttcatcttgctattgggtgctaatcccatgaatataaactagagacttcttcagatgaccctggcaaatctctcgtctaggacaaagcctgccttccaggaagctagcctccttagctagtaagtagcctcgtattaacaagcccatttggtgccctaaggcctttagaaatgtccttccctaattcacatttgcacactctctttctctgtctccttccttccttcctttcctggcttccttcaggaacaggaatagaggcatcttcaagaagtacacattaggcaaaatacagagaagaggaggaaatgtggatcaagggacaactgaaggaaaccactaaattagacctgagttccctggcaggcaaagcaaaaacctgtcagagtcagttataagattttcagtgccccaaaacataagaatcaaccagcttttcctggcattgaaagttgagagacatcagaggacttcatctcctaaaacctaattgagctcacaataatgagttttatagagtcgggtcttatagtatccttcgatgtgggtgcatgcgaactaacatactcttcaggagaagggattctgcaagtccccagagcagcgtagccaagaaccacagcttcaggaccacccctcctgagccagagatgataacgggctgggtttctggaagtgtttctcaaagtgaaaacttggtcctccgagatgctctatgaggagtggattccatgatgaaatgttcccctcttagagaacgaaggagcctataagcttattaataagcttattaatggctctaagaagcccttcagtaaagaaacttgcttagctttttttaatccagtatttctccaaatttacttggttataaagcctcccctcctcccatgacccagggcagttatctctgtctttgtaatactgtgtgtcatcggcttaaaaaagaaatacctgtttttggtggtggccagccacgctgggaaagagaaagagggatgattgattttctgcttcctaaaaaaaaaaaaaaaaaaaaaaaaaaaaaaacacacattttcttttaccctgtgtcttgcctgcaggggcctgggtggacttcagccatgacctcccttgaacatattttctcacggggcccttaagcaagtagaagccggttgcatcttcgaagttggctttttgtaaactctggtttcgttatgtttgacttaacaggtgctgcacacccaactgggaccccttttgggccacctcctcatcacagcaacttcctcaaccctgctgcccacctaggtgagtcgcccaaaataatgggaactgagatgtgtgcttcaggcaaccctgctgtgtttaccatgctcccgctgcacctccgggcaagctggtgggagtcccagataccctgcttaccatttaggcaggagatggtgctctcttaggagtttcagtacatcccgtccagcttccagatttcatctcttacaccgcattctttcggtagtagagctgtgctcggcagtggttctgcctgaacttcccatggtgcagtgggtgagagccattccttggtatctcagggaatccgagtttacaacagcctgttcctgcccattggaagaagatggtgagctcttgccccatagcaaaggtcacctctaggaagcggaaagaaacacaagctgacgttatggagaggagttattctacatctcactgccccgataaatgagtctcttcctaataaaggtgcatgctttgtgtggcctttgtgtattcgatcccatctgcaagtgtacaggcagattcaggcattggcttgcacaacatcagggcatatcataggcacgccctcagagtttcatcatggattcagatgccacctcctttctgttctgttagaatctgcagagtgcattcctggcagaggcgagactgggcgggaaggcaagttagtacatcctagcttgagtagtgtccccactgggcaaaggaagagtaatacaaaatacacagttgtagaagaagagtcctcagaaatattttgctaacccagtgcctaaatccaagtgtaatgaaaaccttttacaccatctggtaggaaaagtgggacaggccaggtgggggcgtagagagggcagggatcccgcatcgccctgctcccaggaagctctgggttcctctcccagcagagcccctgaccatttccttcttccccatcttgtttgcagagccttttaatcggccgtctacattcacaggcctagcagcagttggtggcaatgccttcgggggacttggaaatccttccgttagtgagtacctctaacttttaaaaatctgccttggactttttatctcctgtgatccgcatatggctcaagacctttctagagaaaaggaaactatgctctggggggaccagtgtaggttatatcactgcaaaagcaggccttcacagtggggtgaggtggaagtgtgcagagccaccactgtgagggcagccccctgtggctatccagttctgaggggcaggaacggcagtgtagttgatgaccacagaaagtttactcaagtgcggagtttcatccacatcccatctctgctctccaagattttggctgcagctcacattacaagtgaaagcaatagttacagcaattgttacatttcatcttgcccgtggcattcgtggaattgaaaaaagcacaatgaaaaatagcaggaagacaccaccaggctgcgacaccaccaggcttgggataatcaagatttggcaccattttattctccatcatctaggaggactctgcagctttctactattaaaaaagcccatctcgattaggagaagaattacaaccccatctcacgttctaaacattagtgtttagtcgctgaatatgcaaattattttctttcatgctacataccatatattccgggtacaggaagagctaaaacgtgtctctgagcataccgtcacaggtcggtctttatttaaaacacaggaaggagacctgtgtgtctggtgagggcaaggtcctgtctggtctctggtgacacttgagagggccacggtgggtagaggagacagtgacttctactgtgaatcaatttagaattgttaatccaaatcccaccatcataacacacccttctgcatgcctggaacttctgcatgcaccagatacgttgaattaggtcatctcagtacccatttggtcccttttcctttttaacttcccctgtccccacctttgcttttggttttaaaaagaaaaaaaaaagctgtgagctacctctccagtgtaggacaagacttcctctaatgaatttgttaatctcctttccttttccagctcccaataatatgtattcattttaactctgaatgctgttaaaagttttttggtaagtaccttcattacagcagattatataatttctcttaaacctttttgttctccacttcaccatttcagcacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaaggtacggaaagaaaccgctctcgagtccccacgggggagcctgctctatgccaagtaccagtggaactggccgcccaccctccctgtcccagcctcgtgctttagccgccccggtagcctcagctcctccccacagccagtgcccgcagcccctcgcagtccccatggcccatagcatatggtgaccgtaggagatagcagagctagcgacagattcctgtctcagtcgcagttatacatcagcacgtcccaagtccctgttagcgtgtccaaacagaagtctttctctagaagacagggagttggagcttcgggccagacacacacagcatgaatcaattccatatttgctttcaagtccgtgcagtccatttaaccatccataggtttttctcgctcttttcctctttttgttttcttttagaaagccatgtttgcattgcctcatcatatttttctcaaattttgttcaaactcaaagcctggggctcacagatgactaataaaattttactcacatagatgtagagaaacgtcgacaagcagttttggtttggttttggtttcactagtggataattttgttaaccgttgtctctgcacttggtaacccatgcctaaaaaaaaaagtagcgttaaacagggaatgtcttggagttttttttccaaagaatatcgtaacgcattcttgacaaaaatgtctttttttttttctttctttaggctatttattttcactttaaatgaactgataaggaatgcacaaatatgcttgacagaaaatacctaatcccaatttccttgcagtatttaagattcaaatttgatccgaatctttaatgtttcttttctttgtataccgtgtatgtatgtgtgtgtgtatatcctagtaatttcaaagaaagaattcaactttgcaggctctaaatggggcagattagtagatactcatcagaggccatcatgctgactgataaaagaaaaacaaattttccttcaaggcagtatgataacaatctcttaaccactgggaggaatgtttatgacattcatctctgagctgtgaactgccaaaatgaggcacgcctagcaacataacctggccgaccctaggccgcgagctctctgtacacagcctgtcactaggtgcaatgcaggatgtggccaccagccctttgcgtgtttttctggatggcgtcaaaatggcctcttggattaaagtcaggaagcttaataaataaaatatactcttcttccatccttcccttaaaagttattcttcttctctgcatgtgggcaagaaacagcccttataggggagcctcctgaatactctgtggtcctctgatccttgcacaccagcaccaagccagcatggcagcctgctgctctcctcaactttgccatatctgtcttggcaccatccgtaagacctgcctggtcttagttttaactcaagttttaccttattgtcattccatttgtttttgcattttctgcccaatactcttgagcccccatccaagacaggtctctaaaattcttgtctcgtgttttcactcacagctgctctctaaaattgttttcaatgtccccatgaggtttcgtgtttagggacctgcttttcctactgccttccctccgtcttctcatcagactttggctttcttatcccatctggtgcacaagtgctctttgcaacccaaaagtcctccaactgtggcttccttttgagcctttctcacgtgctgtgtcttggagatggctctgtatccacgttctttgctctgaaactggtcacttgtccttgtaaggagcaagagacttctgtgacactgatgttgaaccctttcttccactggttcagtgttgcaaagttggaagaaaagtgatactgggcgttgggctcttaaaacgtgattctttacactagatgatcccgggagtccagacagtcgggctggattgccacatcattgccttattgaccacatgcagccatcttggctttctggaagctcttcttctgtgctcttggttgaggctcttaacatgcagagagattcttgctcccagcagactccccctcaccctcatccctggtccatctcccccattaagcttcctctaaaatctaggtaagtaggataagggtggctggctctgccctgtccagggcacggctgctgccttggcgaccatgggaagcagcccccagcctgtcctcttcacaccaccatttcacccgcagcccctggcccggccgactcgcccctttcatttcatctgcgtccttgtcttcccctctctcccccagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgcaaaaaaaaaaaaaaaaaaaagttaactacagaccattgtttctaataagcagagagatctattttagtagtaaactgaaggtttagttgtgagcttcagattttgtgaactccagatgttgtgcggtgtttttttttttttttaagacaacaactaaaaaaaatgcaaggaatatgtacactggaactgtagtggtagctttcagtattgtaaagagattgttctatacggacctttttgctgtttatcctgtatgtaataaagtcctttctagatcctatgtgaaaagaaaagtgaagcaactgaatcttcagcatgttctcatcggcggagccttcttgtgtaatgtaaactgtgccatgttattaaaaaatgtgaactaagcttccagctgcttgtttgtgtgaggtga
